United States Patent 11,001,841 (CCCTC-BINDING FACTOR (CTCF) RNA INTERACTOME) - sequence listing, part 30

SEQ ID NO: 73058 - DNA, 1077 bp, Homo sapiens
ctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaa

SEQ ID NO: 73059 - DNA, 1362 bp, Homo sapiens
aaatactgtcatttgttttccttgtgatgtcagactcagatttcttattttttacaaaatgcctgccaaatatacaagtctgaatagccacagcctgtctatcagttggcctttcaaacaaatatggtgttccatggaaaagcagatagttgagctcacagctcaaacaatcatgaaagtgcctttcctcaggagcctgcatttattcatctaaaatgtaagtttctgcttgtaaaacatgttttaatagctgtgagaaagtcatgacggatgagttgaagcaagacgatactcacaaattatattgccactgtctggtggggaaaaatacaatgagcattagcacagtttagtgccactgcctcaactggtcctaaggcaccaaaaattgcatccaatatcggcagtccaactccttgcacacctgctctctcacagcttctttctcagtctaggccagcatcaccatggtagatgccttcctgtgcacctggaagctctcagacagcaagaattttgatgactacatgaagttaatcggtgcaagttttgctatcaggcaggtggctagcatgacaaagcctaccacaatcatcaaaaagaatggggacattatcaccttaaaaacacagagcatgttcaagaacacagagatcagctttaagctggggatggggttcgatgagacaacagcagatgacaaaaaggtcaagtccattgtgacactggatggaagcaaactttttcacctgcagaagtgtaacgggcaagagaggacacttgtgccagagctaagtgatgggaaactcatcctgacactcacccagggcactgcggtttacactcgcacttatgagaaagaggtatcgtctgcctgcgctgtcactgactgttcctctgttaccctttgactcagcaccacattgcctcatttatttcccctgcattttgtataaatccaccttgttgaagaattcttctgaggtcatgtgcctcagaagacttcagatccagttctagttcctgttgtgtatgtggtttgctttttaatggcattcaaagtgtgctctgaggtcaacaaagcagatccaaggccaaaaaaagaaaaattgtccaatatcagtgcaaagtcaacctcgtgaaatgggcaaattgtgtctttgaattattatgaaaacagcaaaaactcttttcaggtataactgaaaaggtttcaggacctcactttgaaaactgccgaggcagaagaacctaccatgctaatttaaggatttaatttaatcatatttaaggatttagggttcttagtgtcccttgacttcattagcagcaccagtgactattaactcaagtatagaataa

SEQ ID NO: 73060 - DNA, 1064 bp, Homo sapiens
ctctggtcattccagagtaactcttgaagttctcaaagcccttacctctaaatttaattctaatgtagtttattttttaaaaatccacatatagtaatataattatttaaaaagaggacatgtgtcagaggtagaggtaggaagatgtagctgttttgtaaagccagctaacaaaggtgaacgtctgtaataccatcagaggtagaggaaggaagatgtagctgttttataaagccagctaatgaaggtaaacgtctgtaacaccctgatagttgagatttgctgtattttatcgaatctaagttaccaattttcagcctactttgttatttcatgcatcactaagaaagaagaaactgttgattaaaaaaattaaacatgatcatcataggttctagaggttctagttgtatcttaattccagagatatcaaaacgttaaaaagttgtgcattatggaatgcatgaagtacctattagtttaatgtgtctataagaaaacacattgcttatgaaaattactttttcattatcattagtgtgtaggtgtttggcttcacgcagaatagatgtatatgtttaaattcagtgatccttaatgttacagtgtaatttttgagcaacagcaacagcaattctgttaatctattcatttttattgttctgttttatatttcattttcattcgtttgcttattgtcccacttgtgaagcttatctcttaaatactgagtaatctgtctttaaacaacctattcacatgcactaggggcaatctgctagttcaaaatggcatttcatattaaggtaattctggttgggcaaaagattgtgccctaatgttctgtttagattgactcatgttgtaactcctcaaaatgatgagataaactttttatttcattggtgtgctggttcttaaaagttaccctttgagttccttatggaagaataagtatggaaaatcagccaagttaattctgaaaataaataatattacgaacaagggcaggcacggtggctcacacttgtaatcccagcactttgggaggccgaggtgggagg

SEQ ID NO: 73061 - DNA, 1058 bp, Homo sapiens
taaatgacatatccagccacatttcacatcccctacattgcactgtaccctgtactatagttacattaagtttccttcatgaaattttatggttctgtgactttactagagctttctcttctgaaattcttttcctggctaactcctattcattttttttttaaagacacatccagtgtgaagccttccctgaccccagttccctttgcctagtaggagaaaattgttttatactgtgtgtttccttaggaagttgcacaagtttttattatagtttattaagatacatcaaaattatttatatttgtataagcacctatggtgtgaagtcctcagggaagacacttgtatctgtatctgtgattggcattgtaattggcacatgatagccatttaattatttgtctatgaaatagctattaacttctattattattgagcaacttaataaataaacatggatatttgattttaatatcattgacacctgtattttttccttgtagggtcctcttatatgttagcctctaagggagagcaagagtctgtgtctctcttgctcactgctttttccccagaacttagcataagtcctggcacatgccaaataaatgtttatatatttatatggtaaaagttaaataagtatttgttgaatgagtgaatagtctacgtctttcctctctccatcacaactaccacccctcttgtgaggaggaagaatactttttttcttcttcatttccctctggtacaactcttgtttttcttggactgaaatgttcagtctcaaaatagaaattttagcattttataacactttcaggcaacttatatttatctaaaaagttatttactgcctatgttgtttagggagaataaaatgccatagggaatttgtaaacaattttggtgcctttttttttttccccagctgtagcagctatgatggagtgatcttttttcccagttttcagaaattttttgattcatggtagtggaacatttatagtaatttttctgtttttttaattgttgctgttgttattttggttttt

SEQ ID NO: 73062 - DNA, 1015 bp, Homo sapiens
tatatgttgttttgttttttaaattgattgagaataaggattggcattacaaaggactgaagaaaaacacatgtaacattgaatcaatgatttattttgatggttagtggaattaagtggaaagctgtagtttcatatttgtccacaagatggtgaaattctcattaggtataattttttgaaacccatataaacccttaatttataatctgcatttgatgctatttattataagcactgtaatttctttttacagcccatctgctggcaaggctaagattagaacagctcataggagagtcatgattttgaatcacccagataaaggtaggtagaattcctatttttcataatatgtatatcaaaatatgctgtgaattcctttcagattaaagtcatatatgatatatagttgagatggaagtttgtgcgccacatgtattgtgatttttttctcataaatgagcatttaggttggagttcagtgattcacacaagtagtggatttatattatctgctttcaagaacttagttgctggtttttatatatgacttcctgaaccatctgatgcgcctaccatttttatcaagaaaaatcgaaaacacgagttatggactctttggttgtataaactgatttgggcatcacgaattgtatttatgtaaccttcaatgtaaaagcacaagagttagaggatttcctccaaatctgtgaatgtaatatgtcatagatgattctgaatttctgaattttattctggaaggctctgaggctgagccatttgtttttaactggccaggtttttaatgtaaatttatcttacagaaagacaattattataactttaactacactacagctgcttgagagggaaagcccatatgttcattgctgtttctgctttaaaataacagatggtagaaagttacactgtatttcagaagtcaaaggggggtgggggaggaaagtgaagggtttcttggattcttatttacagactttcagtttcctaa

SEQ ID NO: 73063 - DNA, 3768 bp, Homo sapiens
ttttgaggctatcttattaggtatattcagatttacaattgctttctcttaccagtagactgacccttgtaacactgtgaaattggctgttttatttttgcattttaccttaaaatgtactttatctaataattagtataacaatgtcagcgttatttttgatagtgtatatttttttctatttcttaaaagtatagtctcttataacaatatataacctgctggatttttattaatcaactttattgagatataatttatatagaataaaatgcacccatttaaacgcacaatttgacaagttctggcaaatatatatgtgcatgtaatcactaacagtcaagacatacaccatttccataagctccaaaggttcctttttgccccttcccattgccaatccctccccacagcctgggcaatcaccattcttctttctgccacagactatagattaaacatgtcttttctagagtttcatatatatctggaatagtattatatactcttctgtgtctggcttctttgaaggaaaaaagcagtgcagaatgttgggctcatcatagtgcatttccgttatctccaggatcttggccctcaagacctgactgacttggtagccctccagtgcttttatactgatgtgtttatattttatttagctcttctagttgggtgtcagtgggagagttggccttaaacatgatggttcacaatagccagaagcagaagacttctggccatatttagtggtagaagtacaaagatacagaaatactaagggtgaaggtgagtgttctaattaaatggaacccactgaattcccctagaaaactgagaggggttgaagagtgttattttttttgttctttttcttttcttttcttttctttttttttttttggagatagggccccaccctgtcgtccaggctggagtgcagtggtgcgatcaagactcactgcagcctcaacctcctgggctcaagtgatcctccacctcagcctctccagtagttcagactacaggtgtgcaccaccacacccaactaattttttaattttttgtagagacagagtcttattatgttgcccaggctggtctcagactcctgggctcaagtgatcctctcacctcaccctcccaaagtgctgggattacaggcgtgagccactgtgtccagccaagagtattttgttttcattaaatttagggtatgcatcctatcctatgttatcagtcaggattcactgccagcaactagatattataaccaggagagcatttagtacaggttacatattgttggaagatctgaaggagcaagttctacacttggcctacaagaatcattcctaaacaattacagagctactctgtcagggaagctgctgcctcacaggctgccactagaactgtgggagaagcacagttgctgccaccactataccacactcttgcttactagtagtaataatgataaagaggtgcagcaagaaagcctttctctcatttcagccttccaagtcccacaagaatggctctaattaatggaacctaatgtgaatcaaacactacttgaagagactataagaattgtagttttggactgaggaacttttccaactatttagaggtagaatgagggtcaaaagaaccagtccaaaatgtctaccatgtacataaattaaaagccctctaacttagagtgagtggtagagaattcaacgttattctgaataaattgtcatgtcatttttttcctctaacattgctatcaataagtataatatttaataagactctctatcatctgtgcctttgattttttccaactgctgagtgagcatagtatggcctatgatttaaatatccataatgcatatcaattaaaggttatgtttaagttcagttaatattttaatatttgctgaggatatccaagacatcgaggacatcaccctgataactctaagaatttaaacagcttaccacattgacattacctaattcctgattgctagattgtcttcaaagataatcatgaaatcaacatatttcataaccaagtgctttaaacttttatcagctttctttgtaactcttatagcatattcagggacatactatgatatattccataagtgtttatagcaattcagatcttgatatgaaaatgtcagttgtatcctcaagggcaaagaggtaaatatagctttctccagcattaccccttctaccacaacaccatgtttgttgatctattttctttgctttcttttcccttcataagctgggtggtatggtatcaataaaaggccagaaaaaagtcagaacaatttacaccaatactagctagatgctttttggtttgttgtaagctactgagaccttatgatattttcagcagctatagatggtttgcacttaaggggagaatacaaaataaaaaacacaaagagactggtgagctgtaatatgattgttagtctaagcattaaacaatgacagtattgaggactagaagttagaaggtatatgatgtttagctttcatgtgacagtttggtgctagtatttttgtatgtaggttctgtttgtgatttacaatgattctgcatttgaaattcacctcaattttcctcttgctgtttgcattagaaagaattcattgcaaagaactctaaaaaagaactgacttaattttattttttgcactgtaaatccaaaactacactctgtaaatattcgaatagaatcatttcagagaacaaaaaaaattttttgacattatttttatctctcatttattaagattagatcatttatctctattaagtaaataggtttttggcactgggtagtatatagttgcctttttaaacatacattttatttttgtgacattataagacttgattaatactttaaaagaccccttggattgatttaccttcttcaaaaagatacccgttttcacagatgaatgtgtctttaaaaaaaaaaaaacagtcatggaaaagactgttattttacttgcctaaccatccacttaattttagaaaattctctggtcaaatacttgaaaggtgaatgtctgaccagtgcagtagttgaatgttgttcaagttattcctgattataactttctttcatcatttttctcagaggtttttttttattgttgggtagttgtaggacttcactaatcaagtttaatttatactgttttgatttctagttagcttataaaataatttgtcagaggattaatgtgtgagacaatattcaaaaaagagtatttttatattttggggactttaaagtatgtcaatgatgaaatgtattttaattcatttttctttgttctctcaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacgtgcaaaaaatatga

SEQ ID NO: 73064 - DNA, 1008 bp, Homo sapiens
ctatagagttcttgagaagagtgaaatgagttaagcatctaaaatgtgcctcccaattactagccaatattagctccctcttcctccttcctttgccacaaacataccaggaaaaataaaattctgttttagatctgataaataattcctgaaacccagcatagcaaacataaacacactgtcctaaaatacatgggcagcatagtgtgtagccatcatgagccccgcctgcttgctttcccactgcattatgccctgagaaattgccccatgtgttttctggtgtttgattctgtgccagagccattagggtagaagaatgagaaggagttgagttcagtcctttcagagaggacactctcctttgggcatctgctggttatgagggagcttcttgccacaattcaggctgcatgctgctggcagagggaacgaagggaatgcactgtcagaaggacagagagacagagaagcagacagaagcatggcgatggccaagtgttctttagggagaaacaggctacatacgggataagatttttggaacatgaaagaagggttactttaccaatctgaggctgctcaggcagtggtgccagaagtcacagaacatataaagcagagtttttcctcatgcagtcatccctcaagatccatggggtgttgcttccaggacccccttagataccaaaatccatggatgctcaagtccctgatataaaatggcacagtatttgcatataacctacacacatgctcctgcttaatttaagtcacctatagatcactaacacctaacacagtgtaagtgcgatgcaaattgttgttgcattgtttaaaagttttatgattttttcttattgatatttttaattgttttttcaaatatttttgatccgtgcttgattgaatccagattgcggaacctatagatagagagggatgacttgtttttttccttctgttctccctttattccagctcattatttatttcatagaatctcag

SEQ ID NO: 73065 - DNA, 1021 bp, Homo sapiens
actgcctctatttaactaaagttttgtattataggcccaggaatattgaatgtgtcatatgaagtcttttccatgagaatattaaataaacagttgatttgacttcttggtctatttggtgtctcttttaaatgaatcctaatattgttaaatggaaagtgtagactctaaaatgatatctctacagtgattacaccatgaaaaagtgtaatagctctgattcaatgaacatttctatgtgcccatatctgtggtaagccagtaattttcatgctatccttattaaatgttatttccatttgctgaggcttaaagagactaattatctctgtaagggtcatttaacttgtgagaatgaagatacaggattcaaacagagtatcagaccccaaattttggggatattcaaacagaatatcagaccccaaattggccgccctgctgtataaaatccacatgcatacacatggattggcatgctaacacaggacaacaaaagcaatcactgtgctagagcagagggattatggctgatttgttctttaaaatgaattattggtgtaaaaattcatcaaataaaaatatggagaagaaaaaagttgcattaaaaaatatacctgaattttatgactagatatcaagacttgtattgttgtaggttttggagtttagattccattccaaaagctttatggtctctggtctatgtgaaaattaaggaagagaaagaaatttgggtggcaagaaatccacccgaatgtcttctgctcctggcagcattaaagaaaattgctgtccttcatagatgaggatgaagccactagtagctttccaggagtggtgatggatttgctgggagccctcttaaattccctccccatctccttttatatcaggggagggctgttcaggaatggtgctgccagtaaggtagccatccatatgaagggtgaacttggcactttccgcccagccaacccacgccccaccccgccagctgctcgggaggtgggataatcac

SEQ ID NO: 73066 - DNA, 1129 bp, Homo sapiens
gcactgtcttagggaccagagaagaacaggagatgaccaaggcacaaaagaaacctaagatagaaccctattctcaacaagcttgtagcctagttatgaaatgatttgagactcagacatgaactaatgaagtgctaaattgggtagggaagatactctctgaactaggagttagagaagggtgaaatctgtgagtcatgattaacagcaaggtaccctcgagtccatgcttcttctggtggcttccctctgggatgctttagccaacattgccacatttctttcctttctcctctttctacccaccctttcttctctccttcctgccctcattttccttccatattcttttctccttttaattctctcctgtttaccttctttcatcacattttttctgcctccttcccttcctctaccagtttcttgcttcactccttcgaattcctgacttcttgtcttctttcctcttttccttctttctcccttccttcctcccctccctttgccccatctacattttgtatttctctctgtgaacatttgttgtgaggtgtctgtgtgtgctaacactgtgccctgcccaggatgtgaagaatgaacaagatttaaatgtgcatttaaaggctagaagtcagttttgcccatggaaggaagtctggttttcaactggcttccctgacgctccggcctctgccggcgtcttttcagtagcccaaacaggagcccctcttcaccaggcttcccttgcctgatgatacggggtatggagccaaccatgatgagaacaaattgatttgcatctgcttgtgtccatttgtacatgtgattagaggccgggcaaggaggcagtaggcttggcctagagtgagcaaattaaaaaataaatcaagcagattttataaatgacctctgcggtatcaacagcacacaagctccttagttacacacagcctgtttccttctgatgtttgctttctttcttttttgtatttgtagcaaataaatccttcctaaaagaataaatttaagaaagtttcaaacaaaacaggtagaagaatccactgacaatatcaaagattgaaaatatataggccacaaatttcttggaacaaaagccacctgggta

SEQ ID NO: 73067 - DNA, 1066 bp, Homo sapiens
gatagctctccatcttctgaatgaaacgcccacagagctgtcaggttccttctcatgcctggggtagaaagtatattgaaaaagtactctaaaactgctgggcaccagggatcagaccacatgctttctattccagtgaggctgagaggatatttagactttttaatccagagagcaaaatccagtgcccaccctgtactgatgagaacagggaaagcaggctccacccagtcctgtaatgtcactgttgtggtcaggatttccccaaaggctacatatgggtgtaagaatgactaggaatggaaggaattaatttaaattatgccgggcatgtacattgcacatggcttcctaaaaccatgtagcccaataataagctattttccagttaaatattattcctgctgttgatatttgcatatttgcatatttttctcttcttggccttttctaaattacccactctcattcacccggttctcttgtatcagaaacacttgaaaaaggaagattcattcagaggaaaacagggtccgggttgggggcagccatggcttctgaagctttgctgagtcaaaaatcatgcccagagcacagcaggcaaactctttaaaataggcagcactatgatgaaaatggtttctatcagtacatagaatctcccatgtcagccccagggcccatcaagcccaacctcttgtctctccgaagcagcccagaagaaacatttgacttgagcattagcagatgaatacttcttacagtcaagaggagggttcgtctgctcttccctgtttatatatcctttaggagatgaaggctcagttttccaagcgtgtctggttgccccctctacacacctgcagcctcttcccaaggcccatggtgtggaagatttggttctgaaaaccagactcagcgtaatgtggccacagaggctggaggatatagaaggacctgctattttggcacgacaccactgtgaccagcttgagaggtcatgggcatgtgttacatttcccacagaggggagaatcattcgcacttctgtactaatagcatacct

SEQ ID NO: 73068 - DNA, 1082 bp, Homo sapiens
agtgctgggattacaggcatgagccaccgcgcctggtccctgggtgcattttgtaaatactgcatgtgctcacctaaaaatgacaggtacaacaggacctagagaagctggcacatgaggaattaaattcaaaagacagtccagagtccatccatcatatatagatttttcaactacagggttattgaatatgacatcaacttagagatactcccaggaaaaccaattattttttttttgctctgatgatatacagctgtaataacatgccatgcatgagtctcagaagacatgctgatgtgctatcagttccaggaacccaaaacgaacccatatgtagttggtaactggatttttcttctattggaaaacatgtccaagtctgacaactgtttctctgtcactcagtgtgaccaaggtgtgatttttccctataatgcttttagggtatgaacaaagcaattaatgatctgcagtaaacttttccctctttaagtaggaagaattctgtccacttgaaggttaaaaaaatgggaaccagtctctatttttttatttccttcctttcactagagatagctgcttcttttatgttttaattggagaacacagttcatttaaaatgttttctaagtagttattaggttttatttatatatgtatacacatacatgtacttttttcagttggctacttcaaatatttttaaatgatgtgctttatatgcagtacattaatgggagtaggtaggaagattacatttataacatgctatgcctgctgatgtctttggtatcacaaaaaactatataaaattagttaaatcaagtgtgttagaaagaaaaatattagtcaggatctccaataaaaagcatatacaaccaattctaaattttccaagacttttcccctcactgttggtcttttgaactagtttactaatattagcatttgaagttaggagtagagcaaaagagaaacagggggtgacacttattttgaatcaatatatgagaacatttaggtagaagggaggccagagacttaagtgattaaaataaacttaggagtttaactttccc

SEQ ID NO: 73069 - DNA, 1028 bp, Homo sapiens
ctaattttttcaaccctaaaacatcaccaaagcaagagtcactgggtcttatctggctccttgtagacattgttgatgcagcagtatttctttgaaccttgctcagagtccccctttctatgtgactccacttttggacctggggagaaaacagcattctcaggtggtctgtctgttccacccttgcctttctctgctggctcctgacatctgcctgccctctacagtccatttccctcaatgaacctggatcttcaactgtgtgatggccccaggacaccactcagtcttggcaattaatgtgggcctgttatctgctaaactcattctgaataatttcatttggccccaattatcatccaggctgtgaacagatcaccctctcttggagatattatttccactcagctccagggttcattttttgtatttttttaatgatgcaatcattatcctagttaatgttcttccatccactttcttcctacacctctcttgggagaccttacaaagcttcagcttgcgtctgctcaacaatcttaacctcccaggcctggaagtccatctgccatgtccctgtgggacctatttgtccttagggcatacaactaacagaattcagcaggcccattgaccccactaccctagaaagatgatgtgtacacacagacctgctctgttccaatggagaaagtgcctaatcagcctaatcggaaagtaccaaatgttattttatcatagcaggaatttctatttcctttcctgcaattcctctttataaatgttctaatcccatctacataataagcctttggatttgttctattttaaaattcttcattgtgtttccattgaggcttgctcccaagatcctgtttttgatttgtaagagcatctttcatctctagtaacctttgatgtacagctggctccagacttagcttagaccactccccaaactctttctgactcctgtccttattgggattttcctaccatcagcctgaggcctgttataccctctagcc

SEQ ID NO: 73070 - DNA, 1086 bp, Homo sapiens
gagcatgtgtcccacctcttcttcttcattggccccagcactctgcctttgaaatccctccctgttgcagactgtggttaaaagtcacactaaagaagtccgtcacccgcaaacagcagcagccagccagccccctcagtccctgctaatgctgctcctcagccagcccgtgggtggcttcctccctgctcccctttcctttcatgtttatgcaagaaccacagctcaccaggcctgcctggagcctggctggctcctgagtgagctaggactataggcagccctcaggagggatttggtcacagagcgccacaggcactcaatatccacgcaaccggcaacctagtgtagtggttaggactctggagcaagacagcattggttcagatcctgagtctgcttcttactagttttgtgaccttgggcaagtcattagcctcattattcttcattttcttaacctgtaaattaagaatgtaatagcctgacttcgaagagcacttatgacaattgagtttatatttgtcaagtgcttataacacttcctgcatatagtaagtactgtacagatgtttgttaaataaatataaccaaagatgacctagaaagaaggccaccaggataaatgctgtatctggatatctctggcagtaaactacactgagtttttatctttctttaaagggtccttcgtgtgagccgtaactagttctcgcctattttaatctttgcaattggaaatcttagaaaacacggttcttggagttgtctaaagacataatgtatgtgcttccgatccggcaattgaaccccaataaggtggaacatctcagaatgtaaaatatggtcacatcatgatgaatcactgcatcttggagccccacacatctgctttcagattatctctctgatgctgaaaactattgggcctctgaggctccccttatacagaccttgaccatcaaaggctgctgggaaagggcagaggtggtgagagcccacgaccctcgggatgggcagtgccaagatttcacaactgattagatcagcaaggccttgggattgctgccccacaggaaattcctg

SEQ ID NO: 73071 - DNA, 1106 bp, Homo sapiens
ataacagatatcaacatcttaaattgtaaatatatatgtatatatatcatgttcttatcttgcatcttttttgatgaccttcttcccagcaggatcgccacctatgatccttgcatgtgtgtgtctggtggaggggaaggatgaggagggagaactgtaggatcaggtaggaggaatgaaatgcagtgacagcttcagccagcaatgtttaaaacaatttgatctaaaagctttccatgaattttctctcctcctgtccttgtttctgttatagtaaagttgctacctcacattcctctatttgctcaattcacactcccacactggggttaaagaaatcatttgcaatttgtaaagaggtttaattggtgatgctgaaggttgccactgtcaaacagaacaccttcccattcaccagtgaaacaaaaacacaaaagaaaaaagacttttcagtttttcacgtcacctccttaagaaagtaaatcctcagagctgtctttaagtctgtcagagtaaagacgttaggagcgtatggaagagatatgtgcaaagaacattcttcaagtttagtacagcacagcagaaggctatcattaaccatgtattttaatgatgtatgtgagggaacctctgcatgtgctgagtcctctgctcagtttctgaatgtagcttccaccctttaggcagggaggcgtgagagagaatacatactgatgtaccaaacaaggcaaaaaagaaaaagacaacctgtacgaaagaatgggaccgtatcttctaaaggtaaaaaacaactcaggctggattctttcttcccagaacttgctgcttggtcttaggggccccgatcttgaactgggagaggagcagacaaagcagaaagggacaaatataaggtttcacaccttcctcaccccaacccacagctctatcaaaaggaaaataaggccgggcacggtggctcacacctgtaatcccagcactttgggaggccgaggtgggtggatcacgaggtcaggagtttaagactagcctggccaagatggtgaaaccctgtctctactaaaaatacaaaaattagctgggcatagtggcacatgcctgtaaat

SEQ ID NO: 73072 - DNA, 1037 bp, Homo sapiens
ctcttaattttcatatcttggaggccttttttgctgttatcattcatggccatgctgacaccatttattgcaaaaggtctaactcggctcacttctttaatgctttctatatttaatgtttctgaagcagaggagattggtttaagatgataattttctacactttggagtctatgcaagatggtggtgctgtattgtattttgccagatagatttcagcagcaggtattaagaatatgtggcacatttcacaatggcagtatttgttgaggttttctgctgctgctgctgctattattattatttttccttacagagagtctgaagttcaaagacagggcaaatctgagatagttcagaggttcagtagttgctataggtggttgaaagcctatggggaaactgttcctgtctaatgcagccctcaccagtttatccagggcttgaccctggattagggcataggtgaaacttggagacctccaaaggttctagttactctgacattcctaaaatgttgggttccagaccagcctaaatgtgtttaaataacttggaaactttgggggaaggagcaaacttcctctccctctcacttcccttagtgattgatgaatgtgcccatttatttacatatcttgttccagagccacctaaagattaaatgtgctaagttcagagctattcttctctctttaccctgctcctaaatgtgtgattctcctagttgtaaaaatgtttacttgtattaacaaagaaaaattgggaatattgtaatcattggattaacttcactaaagttctacaattatcaggagttaagtaatataggtgatacagaccttctaaatccataataaagttttccatccttagtcagacatctatggctgatggatcagaccttcagctgtattttctctcttcactgatctgcaaaacaggctagatcattgcaactctcaccattaagattcaactaaaagctctctggactccaacacattcttattccataatgattaaggcaaaagctt

SEQ ID NO: 73073 - DNA, 2143 bp, Homo sapiens
caaagtaaccccagttagttttgtcagatgttgggtaagagtcagactttggaatatctgctaaggaataaatgaaagtatttttgaaattaaacatagtgattacatctgaccccttgggtaagttcagcatgtcttctgcaatcttgtttaaactatttagttgcttagtaagtacgttttttttagagaaagagaaaagcttgcactcaattcctccccaaaactcacatgtaattaagtctgatgttatatgtcaaaatcaagatcataataatgttaggggtggtggtgatggtggctctggagatgaagggactgtggaggtgatggttgccatggtggtaaaggtgactgcagtagtgatattggctctggaggtgagggtgattgtggtgaggatggtagctgtggttgttttggtgactatggtgggggtggtgatgaaggtagctgtggtggagaaggtaactgtgcttgtgaaggtaactatggtggtgaagatggccgtggtgggggtgctggctgtggtggccttattagctatggtggtaaaggtagctgtggtgactgtggtagtgacggtgactgtagtgagaggatggtgactaatggtaatgtcaactgtagtgatgaaggcatctgtgaggggggtggtaacctcagttgtgttgctggctgtggtgagaatggtggctatggtagtgaaaatggctgtagtggctgtggtaatgaaggcagccatggtgaggatggtggctgtggttgtgttggtggctgtgatggtgaaggtggctgtggtggggatggtgactctgatgctaatgttggttgtggtgatggaggcagctgtggcaaggatggtgactttggtggagaaggtggccatgttggggctagtggctgtggttgtggtgatggccatggtgaggatggtgttaaaggtggctgtgatgaagatggtgactggggtagaaatggtgactgtgatggtaatgttggctgtggtgatgaagggtagttatggtgaggatgatgactatggtggtgaaggggccatagtggcaacggtggctatggctgtgttggtggctatggtggtgaaggaggctgtggtagcattattggtgcttttaatgattagaaagctttagggaaagagataaaatgagcatattcactaatattttatagggtttttttttttaaaccttgtcccttaaaaattgtggaaagcctcaaaagtgcagcagaccagatgctcccagccaacttcagaaggtagtgctccagagaactgagcaaatgcagggctgcaggcaggagcacagagtgtcaccagagtttgtgacaggaggctttcctttttcttgatcatttttcacttttgtcttctgtttttaatttctatctgaaatacccaccagtcagataatggacctaataggtgggcgctccatgcccatcatctttttcctagtatcttccattttaactttatctttgatccttccaattgaagtttctgcttggtaatcatattattttattttcaagaggttattttgtcctctaatcattatcttctcatgcaatcttattcgtattttatgggtgcagtatcttctcaaatctttttaagaatactaagtaggatttttaagatctttgtggttcctgaatcatctctctttactccaggattagttgtttagctattgtgtttcagtctctctcttttatgtacaggtttcttcatgagcaaggtgatggctggcagtctgtgtatatttaggtgtggagggcttggtttgcttttctgtgaagctctgtggctttgctcattgctgtgtctggatctgctgcgtggccgagtctttctcctgggcagtggccagccaagagctctttgacaggcaggcttcattttaaggagatgtggggatcccttgaatgccagaacctgtcatacactaggaactcctggaactcactttcctttctccttgtttttgtaagtttattcattgacagatattttaattgagtctctggaggaagaaaatacaaacacatacattgcctctgacatcttgaacaggagcctgtttcgggggcctttacctttaacccagtctttgaa

SEQ ID NO: 73074 - DNA, 1047 bp, Homo sapiens
agagcagggtgatgtttccacaagtcaaggaaggccaaagatttccagccaacctccagaatctgggagagaggcaggagtcagactcttccttacagcctcagaaggaaccacccctgcttttggaccctagatcttggacttgtagccttcagaactgtgagacaatacatttctgtctcaactacatttttagctatataaagtacatttcctactgacaaggagattctgaaaagttatgagaagctcccttaactgaatccctccatcaggaggatggctcaggtggtgatttggaacactgctcctttgtggaccaggcacgtggctcctcagtgcttctgcaaccctgactgagcagctcaccctcgcctcctctgacttcttttaggtttgaatttgcaataacctaaaagactttatacacttttaaagcaactgggataatcttttctagagggagaaagggagagttgtgtaaagtgtgacatagtggcttttgggctaggtctggcgtcatggtctttggggaaatcgacggcctctcatcttggcgagggtgccaacaaacacccaatgttggggcacatggacaaccccagaagtctcacacagcagctgttacatcgattttcaagtacagagacttgagcaataactgtaatgacattttcctggctggctctgacctctgaatctcactgattagtctaacacacactgtgaacatcaaccagttaggactctaagccaagactcaaaaattgctttaaaatggcagaagatgtttaagatataatttgtacgagttggttattaacttgttcacttcccaatccgtgattcttttttatactctccctctcaattatttttccctgttaggttgatgtatctgtagtagttacctctaatcactaagatacttctgtaggcaatccatgctctggatgttacagagcagtcaatatggatgggggaattaaaaaaaattgactctatatattttaactttccatcattctacttatatttcccttgttt

SEQ ID NO: 73075 - DNA, 1110 bp, Homo sapiens
aaatcagttatgtgccccaattataaaaatgttgatggaatttgctatggtattgattttttttttttttttggtgggggaattacagctgttgtgggtttttttaatatgatgatatcacattcctattccgggaatgcaaacaatattatatactgcttggcaggcactgtagtcacttggcttagccaagaataagaactctcagcagtaccattccataggtttgtaagagatcccctaaaataatggatggtacactttcctatatgtatttatgttcagataatttatttaaataatgctgttggcacatgctttatagctgcttgcattttgctatacagatttcagcatatcttgcagactatgcaattcatttggaaaatgtaatttccatccctgcgtactaatcgatttcttcacaaacacctgctatcagttatgataataaaaatgccactctgaattgaaaaagggccaaatagagcttcctaaggaaatgacttaagtgtctttgaatgctactaaatgtagtaatgtgcctatgcagtgccaacactttcttcatcatttgcattttctgtgattttgccctattacaacatccctctcacaaatgaatcctcataaccatttccttatggcttggtaaacggagctgtcaggaggtggtatctcagggtgtggacaagatctgaagctgggctgcacaatgttaaaaagcactggctcatgctgcgggttatgtgctggataatttctgattttatgagtaggtctctgaaaactgtaaaagtggctgctccttggttttgcacacacatacaccaaatgaaatctcctttattcattctcttcagcctccagttcattccatgcaccattgccaaactaatgttcctaaatcccaatttcatcatgtccttccactactccaagcgctgtcagtggttctcaattggccactccattgaacctaaccttccccatcttctcccatcacctgacgtggattccctttctctcactgcttccaggcaaacacttggcttttggtcgagtttctctccttcttgccccaagtgttctacctttgattttcatatc

SEQ ID NO: 73076 - DNA, 1104 bp, Homo sapiens
ggaggccgaggtaggcggatcatttgaggtcaagagttccagaccagcctggccagcatagtgaaaccctgtctctactaaaaatacaaaaattagccaggtgtggtggcacacacctgtaatcccagctagatgggaggctgaggcaggagaatcgtgtaagcccgggaggcagaggttgcagcgagccaaggtcacaccactgcactccagcctgggtgacagcgagactctggaaaaaaaaaaaaaaaaaaagtaactttgagcagatgaggtcagagggcccttgaagtaccttggttttatttctggcatggcttggcaaataatatcccttcaccaagcctcagctttctcagcaatgacatgaggctcatcctgagagttcctcaataagactgtgagaaataaacaattaagggattctgtggcattttgcaaataccaggcactgtggcaatgtggagagttgatgctggtgtagagcagaaggtgtgaatgtgtggttcacagccccgtctgcacatgagaatcacctgggaaactttatacacataccaatggccgcaggttaatgcccaggcatcggtgttattaaaacagtccccaggtgattcgctgcacaaaggattgaaaaccactggcctgtaatgtgaggatgatggctgtcatatagtgcttaactggcacctcagcacttgcaaaggctttttaaggaggcactggtaagaataaaatattgctacctgaaaaattatactcaccagaaatgcaaaacaaatcattttaatgaacaaagcagaaactttttttgtgaggatgtgagaaaggttacctcttttcccacctattaggtgggaaagaaggacaaaacgggttgaggtgaggtaaagtaatgtgggaatgagaagaaaacaaaaatggagtaaagtataaaaatctgtagtggacaggaagtgactgacataggcaatgataaaggagcaaagaaaggagaagtgagagggaggtagtttaagtggagcgtgtgagacccaggtggagaagtcccctcacaggtctgtgtcgggcacatttggagtatcctctggttcactggaaaaa

SEQ ID NO: 73077 - DNA, 1043 bp, Homo sapiens
tccttcctaatgtcacaccgtgtgggtcagtggtagaacagtccattttaaaattccactgttcatgttcttaaccataatttctaagtccttactgtacatgtgccagccatgtaacaggtatttctatgtaatctttgcagccctattaggtggatgttattatccgctttgtacaaatgaggaaattgagactcaagagagattaaattatttgctaaagagccctagtcatgggtgagcagggattaatctaagcctgacctcagtctcccctgtaccccacacccctcagaacctcctttaggttaggtgaggctatatttgggagataaaagctttggattctgaatgttaatatgccagtcatatatacccaaagaccattggggaaagccatatgtgtctgtgactctgacatttgtgtatcctctacttgcaggagctccggaatgctcaaagtgagcagctcatgggcatccgccgcgaagaagaaatggaaatgtctgatgatgagaactgtgacagccctacaaagaaaatgagagtcgatgaatcaggtaatgccgataactgccacagacccatgaggtatcataatgatcttccaaatctcagatggggaataagtaaatggccctataactcacttttatttgaattatactaaactttcatctttgagtgactctgctttttattaatagaactttaaactccttcttgggaacagagtgatttaaattgctccagttgtttctccgtacgtagatctggggccattaagcttttttcagggatatttgcctgtttccatgaaaatccttttccagagtacggcagccacagctgatgctaaaaatatggataaaatttggttttagtcagtgtacttcttacatgggaattgtttaatccctgaagaagctttctagcttctgagccaagatgctggagaattagacttcttttcccataaatgttctttcacctaatctgtaattaaaaggctggccccatttggtaccaagctaggggtgtca

SEQ ID NO: 73078 - DNA, 1160 bp, Homo sapiens
ggagtctgagtgtttgcctttctagtgagttctcaagtgatgttgatgatgctggtccaggggccacactttgataactactgttttaaatcatcaagcatagtgcctagcccagtaagggctaagtaattagaaattgcctatcacagggctgggcacggtggctcatgcctgtaatcccagcactttgcgaggccgaggcgggtgaatcacttgaggtcaggagttcgagaccagcctggccaacggggtgaaaccccgtctctactaaaaatacaaaaattagccgggtgtggtggtgcgcacctgtaataccagctactcggaaggctgaggctgaagaatcacttgaacccgagaggctgaggttgcagtgagccgagatcatgccgctgcacttcaggctgggtgacagtgagactccgtctcaaaaagaaagaaatctcctattaccattatatgattttcataaccactaagggagttagtagagactcagaggagatcagggttgccgtttcgagggtcacaaagaagaaaagatccccagaaaccaggtctctcctcctgctgctatgtgatgacttagcatcgagccaacaactgaatacagggcaggctcaatgagtctggacttgtttctgttatttgtaatggaaactgcaaacatacatatcactggtgcagacaattggttaccatgtaattcatgccttctgtcatctatcaggaatggcaaaagctaaatttgattatgcactgttggcaaagggtaagagaaacaaactgaaaaacacttcagggacatagagtgcaacttgccagtacctttcaaaattaaaaattcaggtgctcttttatctagcctttctactgctaagaattttttataaagatatttatgtaaggatttcagaagatatgttggaagatgtttatagcagccttattgataacatacatatgaatagatttccaagatatattaagtgaaaaaaccaaggtacagaatagcgtatataatattagcacctttgtgtaagtaaaaaaggtttctcatagaaaaatacacactgtttgtactatatgcataaccttattttctggatggatgtgctaggatctgttaatagtggttactggttacctttaaaaagaga

SEQ ID NO: 73079 - DNA, 1030 bp, Homo sapiens
cctccaagtgccaaaattgaagtccacttctatcacatttcctccatgaaaccttgtttatccattataacccataatcatctccctttcacctaccttctgcagcgcttgttaatactatctacttgaggacttacttattttctaattattttatgtgcatcaagtttattggtttgtttgcttgattttccctctagcaagattttaggctaaatagagacatgagccacttactgttctcttttctacctcactgtgccacttctggacctggcataattcttgtaagcacatagaagacctaagaaaaaaaatattggttgttgaccaatcacaggtggaaaggaacgtggtgctgaaaattgggctagaacctaatattgcagaacacagcctaagtgttttttagtaaaccgtgatctcaatgatcttagctctaatatgccattctctttaaagtggagcatacggcatatactttagttgagaattttacagtaggagtattagagtaccgttatcaatatcatttcaacctggagattggaaaggttagaactgtcatgcaactttatacatttgtgataggtaatggcatcagcctcatcttaggtcttaaaagctgcaaatggtggaaagacttttgacaaggcagagagatctggttctaatccaagtttgaccactaattagccttgtgactttgggaaagtcttttaagcaacttcagtctcctttttctcatctctgtaataaaagggtttaaccagtaatcccttaaagttcctttccacccttaagattccacagttcttatgtcaaccatgtggatcctttatcgtctctggatatctaaatacaggtatcttccaggacccaaccatgaggttcaaagctcctaaagtgatcatagaacaggcaatcagatattactctgtgcaaatgttctgcctataccttgctgtgaaggttactcctcctgggctacactgtgaattttaagccacatttcaaccctgaggttatg

SEQ ID NO: 73080 - DNA, 1049 bp, Homo sapiens
caagtagaagatgtttctctctggacacagtaaaatccagatgtggggtttgttggtactggtccagtggttcaaggctgccaggtctgaggtctctctggtgctattcgctttacctggatagttgtctacgatggttgctgctgcttcgcctgccatcacatcttctttttccagctgaaatcacataagaaaagagaaggaaagacacaggaaggagttgcgtcattatagcaagaaagcaaacttgcccaaaaatccatccccagccaacttccatgtaggtttcattaggcagaattattatacctggccatgcctaactacaaagaatgcgagaaatataatttttgactgggcctgctgctctccagagtaaaattggagttctcataataaggcaggagtggagaatggctactaggaagaattttgcagtttttgccatacagagtgcttccctttctacttctactctagtttgatttattttcacattccatctgatacaaatcaggtcatgtcttccccagtaaaccgtttgagtatctccccattgcatttagagaatattcactgtccctagctgacagagctctctgtgctcacttctttagcttcagttatcctcagactcaccatgcatcatttccactggcccctttccccctgagcccatcaaaaccaccttccaccactcggctttatacgttctgttccttctgcctggggtgccctttcccatactctgtgtgcttgacttcttcttatcctataggtcttggatcaagagccacctcttcagagaggtttttctggtccaccctcttctagtagatttgccatcactgcatctctctcttttttttttttgagatggagtctcactctgtcacccaggctggagtacagtggtgcaatctcggctcactgcaacctctgcctccgggttcaaatgattctcctgcctcagcctcccgagtagctgggactacaggcgcccgccaccacgcccatctgattttttgtatttttagtagagacagggt

SEQ ID NO: 73081 - DNA, 1347 bp, Homo sapiens
gacaataccatacattacaaacacttttaaaaaaatccaatctttcttccacattttaatactaactcagctgattctataaatgagaaaactggtaacactgtataatatttttgataaaggaacaaagaaatgaagtggaggccaagtaggttagtaacagtttttcaagtccatcttaagaaagagaaatcaaggtttggtggaagaatgaggctgtaccttattcctaagaatgcccagaacaaatctcctacagctgagctcatggagttggtagatgagagtgtgaacctcctgagtggttctgtggtgccctgaagttagatgggaaaagagaagttaagtgatgatatggcagtcagtctcaggaaagctaacttgctgagttctgaaaatatatccactaggttggactatgctctgtcttttgagaggaacaagaataaagtgtattttctcatcttggcatgatttgtacttggtggttttccatttccagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatgtaagtaaaattttgggggccatctcttttgttgtgattttgccttttcttttttattaattttactttttcatttgggggtaagtagttcaataatttcccatttttactccatattgaatggcaaacttcataacctatttcatgttctgtggcaacttggaggaacacggaccctgccctgagagtttacttctcaaggtgagcaacgtttctgtagcttttcctcagaacagcaagcctggccaccagggcagggcagctagatgcatctgtgcctgctggacccaccatggttcatatcatagctgcagggccgccaccgttcacctgcaggctgtccgcacagacccctatgtcctcctagtgctgacagtagaaagcaaacttgaacacattttccttgggctctgtgtaggaaaagggtactatcagaaaaactcctcaggatcttttatctgggggagctgtggctgtcaaaatgggcaactcaagagtagagatttttttgtcctttcttcatttggaaagcaaattgccttaactactcaatgccagtgattttttttttatgtccagagtctaaatgatgaaggggtgtaagtggggctttctcttagaacaatagtcag

SEQ ID NO: 73082 - DNA, 1067 bp, Homo sapiens
gaaaaaaaaaaagatttcttctaagcattaggtttatttctgctgtctgttctgaggtccattctcctaacatatattggtgggaagagaggtagagagtgtggagggaggcacaatttattctgccagtaacggttgcagtgggcctctcacaaacatcatgctaaattatgggcctctccatgggctgaacgtaatgttaagttgtgtgatagattttatcttacacaagctgcttcggtccatgaaatgagataagaaaccattgcagctggagttcactgagggttgaacttagactgaaattccagagttaacaaaatggtataagtggctacgatactcagtaagtgtgttctgtgcctatgggttgagattttcaaggaaacttgagtctgtcattcacagggtgttttgtgggcattcccaggccagttatctcctctggttaaagtgtgagggcaggggggcaggtttgctcagaaaaaaaacctttgatccccaaatctagaaggctgctgtgcagcaggagaggacttagaatggtgcctgagcatgggtacatccctaaaagctgctttctttcctggggaaggcagaggtttccagagttcagccgtaggaccttgaattaggttcagccccaccttcattcaggacacacacctcctgggcaagcagcagccatgctaaggaagctgtactcctggtctgggaggaggtctttgggagaaaagatactaaagatgtttgtaaagcaccctataaatttacaaagcactcaacggtgggaaggtttcgtatgatgtgtaaaatactaataagaactcaatgattgattttaaaatctggtgagtgaaacgaaatctttttctcaagcatgcatctccccctgtctattcatgtggagtgtatgtatgtttatatgcaaacaacataaggatgtctccgatgcccctccagtggaggggacagtacctggcacacagtaggcactcagtattttttaaatgaatgggtgagaatctgaatctttcaatctaattttgctcctgatttttagaatt

SEQ ID NO: 73083 - DNA, 1315 bp, Homo sapiens
tgtttctgagcttcctagaagccagggagaagaaggaatgatcatgataagaccctagttcctgagatcatcttctcttggggatactggtttggaagatgggtaagcagccctctgagacagctctccaaggtgtgtttatccccaaacctgtaataggcctaactttacagagcttcaagattgctggggaaaaggataattgtttcccgcttcctatgggaaatgtatccgtagtgacagccaagaaataagtgagcatttgcctaagcgtgccttgaaggtctggaccaaaactgtggccattgttacattatggtgtgaccagagtttccattggtttcaggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaaggtatgggccacccacgctggcttttcttcctccacagggatccccagacacggaaccctgtgcgtttctcctgcgtccaccattgtcccttcagcacaatgtctgctatgccttaagaaggctgtaagagtctggtgtaagcacagactctttacagagctggggtggggttagctggggggtctcctggaagctgcagacacctgggcttcatcttctgcctgggacagacccctgcccctttccagaatgctcacccatgttctccataaaagtgtatgtacagtcactcaacaaaactcactgaatgaggggacagaaaggtccccaaagcaggctattatcttctgacccagtgtttaatgagccagcaactatttgtgccattggtggggcgttcttagtgttcctccagctctatagagtgtgcatgtttaccagactcctaaagccttcttcaggcaaaacagcagacatggtactagggtccatcgaggatagaaaagaaacatagaatgggatccctgtcttcagagatgcagttgaagggacacatgcaacatttacaggatgactagcaagagaagagagtatgttttatttcttctaatgttttctgaggccctccctggtgttttatgctgtgggaaataaagacataggaaggctctggtacctgcccccgtgaactacagtgatgccagattttgaagttaggatgacatgtgaattcag

SEQ ID NO: 73084 - DNA, 1068 bp, Homo sapiens
ccgatgtacggaatgagattaaataaaagcacaagcatgccaatattcccattgccaatatttctttttctaatatattcaccttggaggccaatatgttattttaatgatgatgatgttgaaaaccattctgttctggaacttctttagaattgatcggcaggacccatcttgatttttttaagggtaaagtacattttaagaagtagtggcatgtattagatgagtaatcatgttgggtcattctagatggaaactttgaaatagtcacatttaatacatgtttaaatactgaggcaaagacctgggccctcattctgactctgccatctgtttgatttggaatgttagaagttttacttaagtactttaagccttactttcttttctgtaaaatggaaatcatacttgtgaaactttctgatgattgacagaataaacagagtcatctctgtcacttataaaactttaagtcttttgtgtgtcagtttgtactgagcaacatcagcatggaatcctggagtcttggaattctagcactccaagagataatccagtcaaacagtaccatattacagatgaagaaactgagagccataattgtagaggaagtacctagaatgtcagggtgactactttgaaagaaaatgcttatttgtcatttatatttagggttcttttcttttaaaaaaaaatcctccttttactgaagtcacactgatacactatgaaattaaatggagtttttaataaatgggacagcagtcctcttggggttatagatcagaatcacattgtttattctgttcagcccagaggaggagtggaaatgtccaaagtagctggcggaatctgtaaaccttttcccagaaaggaaacgcttttgctagaccttctgtattctctggagcttcttagtaaacaaagcgtgtggttattcttacatctgcttctgggctcctccagcctttcagcacaggtaagcgaagagtgaggccatgcggaggcctaaggcacaggctgtacaggagaactgtacaaaggggttgtcgggggcaggggtggcgg

SEQ ID NO: 73085 - DNA, 1103 bp, Homo sapiens
acttctctctgtccctcctccctgcccacacctaacctagttagtatgcccagccttgcctggcaagaggcctcaactgcctttctttcaaatgaaatctagttctcatctcaaatatgagactcttaactgaggcattgactagaaagggcagaaaaggagcaaggcatggctagcgggcagcagacaaagagagaagaagtgaggaagggcggcccaggcaccggagccctggcctggcagggtgcatctctgactctgagttccagggagagcaaagttgaaattcactagcttgaacagcagggtctctctgatctgatctaattcctgcagtctctccagacattgtggccacactgccagatgcacaccatgaaagagccatgaaaaattgtttggaattccccaggcctaccaggctctctcccagcaattcccttcctggactctctctgtgtcctctgagcctcagctcatgtgtcccgactcttttgctgagtttggttcccatcctttatcctctcctcaaactcaagtggggaacttactactgttacctctgtaactccagatcctggcagtcatacgtgcccaggaaatgctgaatggatctttaattcaaatgaatgagtgctttaattaattcaactgccatgcctctaaaatcctgaacacaaagccccaacctgccttctgaaaaatgctcatccaattgataaaacactggcctgtgaatcagtaaacaggatttttttttgtttgttttcatctcgtccaactgggaacagacaaccaaaaagaaacctttgccgagccttggctgtggccagtctctgcttggagccggcaacacagagaggagccagacagggccacggtctgtgatgaataacccttccttcctgtcatttcagtacagttgtgataaagttctactgtatacgtaattggattctttcttgctgtgatttaagcagtcctcctctttgcgctgagtagaattacaactcattatctctgaagctcacaggggcagcttttcctaacagggcatggaactgattcttcgggttgcgctgccttctcccctttgtcttcct

SEQ ID NO: 73086 - DNA, 1001 bp, Homo sapiens
gagaacaccaagagccaattcagtccttttctccctccctatcattatataacagtcctgctgtacaaagtcacataacatcgtacagaaagaaaattaatcatcggctaatgagatagggatgtgaaaagaagtctgaaagaagtaatttagaggccccaattagggcctgttctcatggttcccccgtgtgcatcgctggctgatcccagttccaggggtgtgagaagggcatgcagggaggaggcggagggaggaagggcaggagggggtggggacaggggggatatagaagctacagtttgtggggacaaaaagagtcctttgcagtactccagatgagagcgaatgaggacctaaattagcaatgggaacaaaaaagacaatgatatagaaatcctttctaaagtggctccatctgaaagggtttggcaggtcactagatgtggttacctatagaggttttaaaccaggactgagaggagtggtgccattaaaagaaacaaccaagccctaaagttacttaacccaaaagtgtctaacaggagtagagtaggccagatgcccagaatcctgtaagcagtttgctgtggagtacattcagacaagatggagaaatgagtgagagggagcagggaaaataacttagtacacatgagcttccagcctaaggaattgacggtaaccctgtgtacatccctgagacctggcaatggcccgtaaaactggaaatttacaacagaggattcagaagaaatcagtgttggggagggagtctaagaagatttgcttaagaagattttttttttttcttgagatggagtctcgctgtgttgcccaggctggactgcagtggcgcgatctcggctcactacaagctccgcctcccaggttcatgccattctcctgcctcagcctcccgagtagctgggactacaggtgcccgccaccactcccagctaattttttgtacttttagcagagatggggtttcaccgtgt

SEQ ID NO: 73087 - DNA, 1036 bp, Homo sapiens
accataattttccaactataataaaggaataactaacaagaaccctcatggctcttactattcacttaataagacaaatagaaagaataccacatgtcatttgcttagaatcatatatgaatttatgttgtgacattgtggactcaacaaccaaatactactttgtcttgtctctttaggatgaactctgtaaattctgtaaattttataatttctttctttcatttaactgatacttgttgaagaggatactatatgccaagagccatgttggaccctgagataagtgatagttatgttacccgttctccttgcccacacagtctagtagaaaaattaaattaatattagatcagtctatgatttacagaccacacacaatttgcagttctctttaggaatattcatgatgtgtttacctttaaaacaggctctatttttgtctctcccagtctacagctatatactgatattatttaaacagaccagttctgtgttgtttcagtcccttcaagcagtaagtttaaattgaaacctacataaattgtttaatatgatgtgaatgttttctttgaaactaaatattgaatgtttttctttgttctttttaaaatttatgagacgttacctatctctcacatgcctttgtaaacagaaatgaaggttgataaataaaatcaaaaggttaacacttgcatattgcctcagaaagatgcaggtttcaaagggaagtttcctataaagacatttacatgctgtgaattaccatctctgctgttataaatactgactatagtgggctttatatctatatggtgtcaccaggctattacctgacttcaaataaagaggaagttctatagagcaaggaggcattgaatgccagaaagaaattataatttatttagtctttcaacatatatttggagtgtccccactcctcagaaagatagaagtagatgtataaaaattagcgacttcttaggggcttgactgaatgttcaaaaatatttctcaatatttaataattttttgc

SEQ ID NO: 73088 - DNA, 1080 bp, Homo sapiens
taaaacacagtaatacactgaatatattgaattctctttctggacaaggtgggcacttagcaccattgtagagtctcagaagccaccaaaataggaaaaaatgctgactataatttacatttgtgtattgattgcttgtttgtaaattgctggcacataaacgtccatcatacagtttggcactcataataacaacgtgaagtaaataggcaggttgcagcctcacatctgagatgaggaagctgaacttgacattcagctaaaccctgaatactgtgcatcctgcttttccccctctgctctttaccaccctggagactacaaacaagtagattttcatccccagcaggatagtgtaaaccacagcctatttccctgtgattccagtgacactgtgggcagatgtcttcagtctgccaaacctcaacttcctttttcatctgtggaggaggaagaatctggtggagatataatgaggaccagctttttaaatgactaaaaaaggattttgaaaacatagcactgcataaaagcatagtaacaattcaaaactagatgcttctgtgaataagaatgaaatatagacccctgaatgaagtacctaacgttctttgaagttataactgggcagaaaatacttaattgaaaatgaaaaatcctttctgggcacagtggctcatgcctgtaatcccaacatttgggaggctgaggcgggaggatcacttgagcccaggagtttgagaccaacctgggcaacatggtgaaaccccatctctacaaaaaatatacagattagccaggtgtggtggcacacacctgtagtcccagctatttgggaggctgaggcaggaaaatcactccagcccaggaggttgaggctgcaatgagctgtgatggagctgctgcactccagcctgggtgacagaatgagaccctgtttccaaaaaaaaaaaaagaaaagaaaagataaaagaaagattaagaaggaaggaaggaaggaaagaaagggagggagggaggaaggaaggaaagaaaatgaaaaatctgggggatagtctctgcgaaagaaaggaaaggaaa

SEQ ID NO: 73089 - DNA, 1033 bp, Homo sapiens
cccagtatctgaaaaccatgtttcatatactttatctggctttttagttgtttcaggtgggagaccatatccagtcactgttactctctccttgccagagtaaaagtcaaacatttggtatttggcaaacatttcattttgagatgggcaacaatgatgcctaaatatttaacaaatgataggtcttgggcactgaccaagcagaacagatgctggcctaaaacagtgatatggccatactggtgtttaccagctaaagatccatcttgtcctgtgttctggccagaccctataatccatccaatttagggttttatcattgacagctctggtgagacaaaaaaagctttgcaatagaactgacctgagtgtgagttcctactcttctgcttctagctgacacttgactttctccatatcttaacttcccttgctttgttgtactgaagataaaattaaataaggtatgcaaaaatgcctagcaccttgcctggcgcctataatacttggttaaaataattactctaccttttcccataccttcttccacaattcatctggagtcccaaaggctagatttttactcagagggtaattcactcaagaaaaaaaaggatcatatctaggagttttgttcgtgggaaaacgatccaaaacaatcacaaatgtgaggtggggagtatcttagttcatttatgctgctataacagagtaccacagactgggtaatttataaagaaaagagatttatttggctcatggttctagagattgggaagtccaagggcatggtgccagcatctgctcagccatctggtgagggccttcttgttgcatcattccatggtagaaagcagaaaagcaagtaagcatgtgagacagagagagagtggggactgaccttatctttttatcaggagcccgctctcacaataactaacccaatcctacaataactaatccactcccatggtaaaagcattaatcccttcatgagggcataacctccctcatagcctagtcacctttgaaa

SEQ ID NO: 73090 - DNA, 1030 bp, Homo sapiens
cacagttatgaatatttaatatttttgtctacgaattctgtcatctatgtgttatttatttttttgttctactgttttatttttctcattattattggtcacattttcctgcttctttgtatgcctggtatgtaatttctctttttattcattttttactattgctataacaggtagccacaaacttagtggcttaaaaacaacacaaatttattatcttgtagtactgtggttggaaatctcatgcaaatctcactgggctaaaatcaatatgtcatcggggctgcatttctttctggaggctccagaggagaatctgtttttttgccttttccatcctctagatgttgcctatgttttttggctcattgctgtcttccatcttcaaaactggtaatggagggttgaattcttcatacatcaaattactccaaccttctcttctgcctccctcttcccctttttaggactcttgtgattatattgtgcccccatcaataatccagaataatctgtcataaagttagctgattagcaatcttaatgtcatctgtatccttaattcctttgacatgtaaaataatatattcagaggttttggaattatcctgtcatacctggtaatttttaattggttaccagacattgtgaattttaccttgctaggtgctgggtatttttgtattctcatatccgtgaagtttattttaggacccatttaagttactgggaagcagttgaaccttttgaggcttgcttttaagttttgttatgagagatcacagcagctttttgtctagggctagttttgtcctactacaaaggtgataccattctgagtattctacccaataacatcatgaattatgaggcttttctactctaactgatgagaatagtcttttgtaatctttatggattattccttctaaaccttttgggtgtttctttctttagcttagtgtagttttatcacacacatacactgattagttctcaactcaagacttgctttatatctccagggaga

SEQ ID NO: 73091 - DNA, 1093 bp, Homo sapiens
tgaaatttctgactgttaattgtggattcatctacttcagctttccattttattagtttttatttcatatatgttgaagttctgttattcagtgaataaatatttgggattgttatattttcttgttaaattgacctctttatcattatgaaatgactcatttatccataattatattttttatctgaaattcacttttcctaatattagcatgccccctttccagctttcttttcattaatgttagcatggtgtatttttttcagtccttttatttttaacttatttatgacttcgtattaaaagtgagtttcttataagtagcatatagtttttatatccaatctgatatattggattgatctctgcctttggatatttatttagactgtttatatttaatatgattatcagtgtgattgggttaaaatcaatcttaataattgattttatttattctgttttttattccaattttctatttgtctgccaccttttggacttagtatctttatgatttcaattttatctcctttgttggcttatctcttcatatatattgtaagaactatatacttttgtattatgtttgctgtcttatattttacttctatatatatcataaacccagaatacattgtgagtatttttgctcttttcaggcaattattttttaaagagttcaaaaataagtaaaaattttttttttctattcaaccatatatttgccatttccgatattctttattccattgtgtagatcaagatttacagctcatcatttttctctgcctagaggaattcctttttaatatttcttatagtatagatctgctggtgatggattgtttcagcttattatgtcagaaaaagtttttctgtcactttcattttgaaaggtatttttactgggtaaagaaaaagttaaagaaaagatttttttttaatttcagttctttaaaggtgctattctagtgtcttctggcttacattgtttccaacaagaaatatactcttatttttatcttagttcctctgtatgtaatatgtctttttttcctggatgctcttaagagtttgtctttatcattga

SEQ ID NO: 73092 - DNA, 2783 bp, Homo sapiens
ctgagggaaattatttaatttctctgagtcccagttttgttatctggaaaatggaagttatatcatctaattcatggggttatgggaatgaataagataatatatagatgcattttacacactgcagtgtgtagaaggtactcagtaatgggtggtattaatataattattgttatttaataggctggtcttgtatggttctctctcccagaagattttgctgcattgttagaggaagtatttctatttcttgttcctactgtgcttgccataaggaggcagcttagagtagctgctgtcattcattctctacaaatgttattgtgtcaacaaagctgtgttaataataataattgcttgcatttattgtgtatgtgccaggcatttttctaagcatctcagtccttatctaatcctcacccagtgaaatcagtgctgttattacttcatttttaggaataagcacaccagggcacagagaagctaagtaatctgtttgaagtcacactgttagtgagtggtgcagccgggatgtgaacacaggcagtccggcttcactgccgatcagtctcatgcattgtgtcctgctgcctccctgtagtggcagcctttacattctgggacacttaacttagaaaggtgtgaaaacacctgctggaaggagagaagaaggatgctcagaattgagagtcattaacctgcagggtggtgtccagaaggagaaagccattgcccaacaaattcatgcattctactagcaacatactggctttgtatttctttcaataaagaatctccacagtgccaggagaattcctgttgatggtaatggtgtcattgctcgttctgctgagaatcctttctgtaattgcagccctataaacaacagcagcaggaggccatgagggaagtctttgtggagagtaccatggggtctgtcgcctttgagtaaatagaccctatttattgagcatgcagaatttatttaaaataccagttgtaagggaagcaaacagaagcatacatggatttcctatggattgcaaacccaaaataataatagtgcaatattaataatacttacactagctttatcttaatattcattttagcacccagaatgatgtttctctcctcaattctattttaatctgaaatataaacagctgaaggtttgcttgccttgaatcattattaccgtgaagttgagccatctgtgtttttcttattctgctcatggctccaaggagaagtcttgaaatttaacaagttgggagaagaatttctgtggagtaaattcagatatacaatgacacctaaaaccctgcaagtttttatcttattttggagaaatttcctcgcttggattgtgttgagagtgagaattagcatcactctaccaaatcatcgacagtcttcaaaaccctttgaggtctggtaccatgttttatgctagattttgttcagttcatccataatccccaatatgctgcttgctgacttctaaaactatagaattggcatataactggctgtgtttgtttaatttgagatctattaagtatctcttgttaggaaactaaaaagctttatatatgcatatctgatgcttttaagttgctgccagggaggacaaccatgccctcctatcatgcattccctagttgaaaccaagaccttggctggatatagcttggttcactgtggcagtgttttcgtttttacctatgacctaaagtatctgttatattttatagctttaatgaattgacatacaataaattgtacatatttaaattctacaatttcataagttttgacatatgtatatacttgtgaaatcatcacaatcaaaataatggacatatcagccacaccaaaacatttcctgttccctttgttatctcttcctcctacctactcagaccccctttcttactcatccccatcctgagacaaccactgatcttctgtctctacaaattattttgcattttccagaattttatgtaaatgaaacctatagaatgtactcagtttctggtttctttcactcaatatagttattctgaaagtcacgcatgttgtcatatatcctgatggctgaatagaaatagagtggatatccttgccttgtttctgaccttatgaagaaataccattttaagtatgatcatatgtgtagttttaaagtacataacctttactgaggaaatttcctttgatttttagtttactgagagaatggatgtcagattttcatcagacgctttttctgcatctattgagatgatcgtgtgtgtgtgtttctcttttttagtctactactttggtaaattacgtgaattactttttaatgttaaaccaaccttgtatctctgggataaactactcagtcatgatgtattattcattatactatattcaatttgctaaaattttgtttagaatttgcatcaaagttcatgctgaatattgtctatagtttttctttcttctaatgtttttatctgatttaagtaacaaaagtaatgctggaatcataaagcaaattggaaggtataccctttaattttctggaagagtttgtgtagaattagtattattttttccttaagatttaacctctactagagtaggattctctagcaaagtcatctaggcatgaagtttccttgtgggaataattgtaactacaaagtctacttctttaatagatacagagctatatagattatttgtttttctttcaatgagctttggtaatttgtgtttttcaagaa

SEQ ID NO: 73093 - DNA, 1249 bp, Homo sapiens
ccacccacctatggttaacttttcctgagcagtctgaagtacttccaaacattaatatccaattttacctcctatactgcaatttctatgccactgattctctagtatgaatccttgtcaaatgttcgaaaacaccagttatgtatatgtctgtctatgtttttgcatatgtatctataaatgtttatatatgtatatatatgtatttacatatgtatatatgtgtgcatttacatatttatatgtttatgcatatatgtgtatatatgtttatatatgtgtgtgtgtgcatgtgtatgtttatatatctcctctagcaatcagaataaaattaaaactacagagatttttaaacctttctttttcacctttcaacacttttaaatgactgttcaagcagaaagtcaataggcataaaagacagtagttatccagttgagtagtggggatgaggaggcccttgggaatcccctgttgaatctcatatctgtcactgtaccccttacccaccaggctctgtccacactggcctccttttacttctgaaacatgctaggtttgctcttgccttcaggcctttgctccctctcttccctctgcctataatctcgtcctccatatcttcccaccacaggccagctccttgtttttaggaactgaactcaaaagttcttttccagacagaccatcttaaccaatcaaacggcttcctccctcctctctcaccccaggtaactctcctacatccctgtaaatggcacttagcacaatctgaaagtaacttctttctttaccttttgattatgtctatcaatcctcactgggaggtaagcttccagaaagtaagaagcaagtctgtcctgttcaaagttgcgtctccagttcctaaaacaatgcctggcatatggaaggtacttattaatacttgctgggggaaaaaatatttcaataaatcatttgctttagaggactctaaatcttctcatataattttcctctgccatttctaaattcattggagttgtttttcaacattccatttttttaaaggtgttccactagcttttttctataatgttaccacgtcaagttttgatatttaaactccagaatttgaaagcttgttgtcaaaagttggctgcaatgaataaactaaagtgtgttagcatcaattctaaacatgttaagaaaacaaccaaggagaaatttctatttataaagtgagtgaagtgtcaaaattaatttctca

SEQ ID NO: 73094 - DNA, 1051 bp, Homo sapiens
aggcattctccttgataaataattaaacaagtatcatatgtgtccattgaagttattattagacacagccatctggtgcaataccacttctccctcttgagtaatttctcctcctaaagagtcagtttacatgtctaaagctcatttatatgccatgatttcatatctttgtgccgtaactcattctaaatatttactttagctaattaattgattattgtgaaactgactgaaggctgcttggcttttagaaatgatgagaatgattatttctcctgctgtgaaataatgccgcacctcccccattcaaacgtgttctccaagtatatacaacacatgtagataatagacctctcataatccttacctcgttttcagcactcacactgtatcttatatttgcacataagttatttgttctttcatacaggctaggtcagaagaccaaaaaattttttttgttctccccttctccccctctgtcaagtgtagtagaagcagtgttatcatctccagggaagaataggacagccattgtttccgtagaccctactgtcttggctccatgaaatggggttctatatctaaatcaagagatattttcacttaaacaagatgactgtatttagccttgtgaaattccaaccagttgcatcatgatttttcaggcatatgaacttagggctagagaaagttaaattcctttacctctttgaccttcagtttcctcattagaaaatgggactatcaataatatctatctttctttcttccttttctttcaaagatcatatgtattgtggataatgtcatttttaaaaaaggaaataaggagatgttttggagtcagtaaagccctctacgtggattaagtattttaactgttgatcccttctcagcgtttctggagctgattcagaggaatgcatattttaaattttgatatttccaaaattgccctgtataaaatttaaacccattttacactcacaccaacaggggctatttaaaataattttaacttttactaactccatgggtgaatgatatc

SEQ ID NO: 73095 - DNA, 1081 bp, Homo sapiens
ggctggtcttgaactcctgacctcaggggatccacccgcctcgccctcccaaagtgctgggattacaggcgtgagccagtgcacccggcctcatactagttttaatgtcatagtttagtagtatccctccttcactcccatatttattaaccatgttttattgtgaatacctaaagttattcctgctgtcatggagctcatattctgattgtggagacaggtagtaaacaagtaaactgattgatgaacgtatcattagaaatggtaatgattactataaaggaaataatacaatgctgcaataatagaccataagggggaacttaccatgaatcttcaggtaaccacgaacagtgtctttgtggagactaaatttaaactgagattctgaggtatgagaaggagccagctctggaaagtggagaaggaagagcatagaagaggaccccagaggcagaaggagcttgactcgcttggagaagtcctggacaaccagcttggtggttgaggtggaactggttatgtgaagagctcaaagtggttgttagaggccctgcaggtcctgggaaagggtttgatcttaattctaaaattaattgattgaaggtgatttatttattcattccctgaaacagagggattctatgattgaatttaatgttaaaagagaatggatttgggaagtggggtaggaatagaagcaagagaatcagttaagaggccacacatgtccaggtcccaggtgagtagggctttgacttggggcatgatagtgaagttggagagataaggacaaattggaataagcttttgtggtagaagccttaggattttgtgatggattagatgacaggggagtgagagagagagaatcaagatgaatgccaagtttctagcttaagcaactgggtaaatgggtttatgaagtgagaaacacaggaggaacaaatagagggagaaatcatgcactcagattggtacttcccgggttggagctcctgtgggatatcttaagtggtgatattgagtagacacagggatatatgggtctggagtaagagatgggtgggccagtgataat

SEQ ID NO: 73096 - DNA, 1140 bp, Homo sapiens
taaaacctacctctgaaaaaaaaaattagtgggggcatggtggcatgcacctgtagtcccagctactcaggaggctgaggcaggtgaatcacttgagcctgggagattgaggctacagtgaaccatgatcgtgctagtgtactccagcctgggtgacagagaccctgtctcaaaaaaaaaaaaaagaagaagaaatgataagggaaaatacatttactattcatcaagcagaagtggatcatcataaaggtctccatgctcctcgtcttcacgttgggtaggctgggaggaggaggaaaaggcaaagttgatcttgctgtctcaggggtgtcagaggtggaagaaatgaaggagatggaaggggaggcaggagaggcaggcatacttagtataacttttattgaagaaaattggtgataagtggaccttcaaaattcaaacacatgttcttcaagagtcaattacattagagtatttgctgcaggtcatctgtttcagcatcctctggaaagtagatttctgggcctattttagaccttctaaaccatgaggcctggaaactgcaactaaagtttgagtccctgaagcaccccaggttcttggctggtggagaaacaaacaaaaaaatcctcatttggccttggaatgggtagggaagcttgtctgatgctacatttctgtggtcttacttacgatgcagttttaaaactgaaaaatttttaaataaaagtagctgagctgtaaagtacctaaaacatagttgcatatacaaattaaaactcgtgtattgagtatctgctatgctccagcactgtgctgtggtctgaatgtttgcatacccccaaattcatatgttgaaatcctaacccccaaggtgatgatattaggacatggggactttgggtggtaattaagtcataaaggcagagccttcatgagtgagatcagtgcccttttaaatgagacccaagagagccccctcactgcttccaccatgtaaagacgaaatgagaagaggctgtctttgaaccagaaagtgggtcctcaccagatggcacatcttccaagtgccttggtcttggacttcttagcctccaaaacataagcttctgttgtttataagctacctagtctgtagta

SEQ ID NO: 73097 - DNA, 1050 bp, Homo sapiens
tcagcacgatttcttttttataaataataaaacctaaatacatacgatgactctaagctaacatgaaattgcattcggtaccatgagccagatatttttctctctcatctgtattctttaaggtcaatttttgctcatgcctccttcttcttttccacaattatttatgtaatccatgaataaataacggaatggcattcgatcctgaactgagtttggcaaatttgagaggaagtatagctttatcttacacacagtaggcaggaaggagacagtgcctcagaacacaaccatttaaaacctttctaggcagcagcagatttacttactccatatcagatcaaacataacaagtgtgttcacatctgatgtttagtataagtttgtttataggaactttggagatgattttttaaatcattttgcttttgaaattatttgcctgcaagttatttctttcatttaaaaccagctctaatttctccataatggtgcacactcagtaatttctgcaaagtgagatagcccagttacaaatggttttcaactataatgactttcatgtgaatactaaatttgataattagaattgtcataatatggaatttataaacatttagttaaatatttgttttagatagtgtgcttttcattgcatgttgacacaaaatattttcaggtcttcatcattattgtagaccttatgcctctagtgcctagttgagaacacagccctagttaaaaaaatagactagttgctcagaggcagatgggtcctttggtctgtaagactgtagtagaaaaagagactatttgaggaacatagtcctccaaatgccatctccttgtaaggaaggatttttatgtggcattcttaagaggcaaatatctcctcctattgaaaaggagaatgtgttaatgggggacggtaggggtggaggacattttaatgcaaatctgtgaccaagacagacagagggtaaaggccttgggtctgtagcaacagtgttttgtagtgcccttcaactttgccttcagagctggagcctt

SEQ ID NO: 73098 - DNA, 1042 bp, Homo sapiens
tcctttgaggtggaaacctgggattcatttttgaatgttaccttcttgggccctcacacatgtcactcactccctctcacttccacattccaattgctatctcttctgtctccagaagtacctcttaaatctgttccctctcttcatctccgctgccactgcctcatcttgtctggtctcccataattacctccaaatagatttaccctcctcaggcttgtcttcctgtagagcttactctgtacttctctaagaattattgctctaaattacaaatttgaccctgtcactccccatttaaaatattccatttggtctccattgcctgtaggaattaaactccttagcatgacccctgcctacattgttagcatcgttctccactttttcaccatgttccctttaaactacagccaaacaaaaatactcattttctgtatcatgccacatacttttcacacagaagtatttttgatcatagtgttgtcatgcctgaaacacattttaaggtgttttattatccctccccaccaattttttcctctatttaaccttggagaaaatctaaaattaccttcaaagttaattgttttttcttctgtgttgtttctgttaacctgcgttttaatgcatttacccatttatctgctttatactgacctatttttccaggtctcccttctttggagtgagtttcttgttcacctagaatttaaaatggtgctgcacacagtggaagttactaaatattcactgaatgaatgggaaaaagaatggatgaccctgaaatcggtccgccataaaccctaaccattggcactaagtccattctttggcgtattgcttaactaatctagttcaccttctatatccgctttacttctaatatgtgaaaatcagtctcatcctgtatcttttgccccaggtcacaaacctagtaagttgtcattctaaaactggcaccaactctttggaattccggtagtcattatgggtcatttccatagttgcactaagttctcaaggtcaaatgattgaatcc

SEQ ID NO: 73099 - DNA, 1028 bp, Homo sapiens
tggacatgtggaatcagcagggaaatgcttttcacttttagctcacatatgtttttaagtagaatttttctgtagtggtactgatatccccagtatgagattagtagtactattttcttaatggtcaaattttgatatttatcaatagccatcataatgatagatctgctgatggcatctggcacattaatttgtaaatgtggtagaattccaacaccgtgtaaactctttctggtggattttactttagaaaatcaactcactgctcttccaatctgtctgccttcaagttgttgcatgaggattcatctcaaatcaccagcaaacctgcaacttctttacctccttctccctttctctgtgggtaggcccattctctcaggaataccagacaagagggtcaagctaccgagaaacatgagaaaacatgtctagtaatagacctgctgaaatcactctatatttgtttttcttttctttttacatcagggtccatattaatttttcttaaaaagtaatagttagaccaccaatggcttagcaggaggaagattggtcatggtattggattctaaatttttcaaatacagtttgagaaaatattcatcaaactttgaaatagaataaagaagagtgagaaaagtaagtgtaggtcttaattccagtgagaggaatcagcaacttcgtttcaaatacattgaaacctgaatttggaatctttcatacagaaactgcaaagcaaaatttaaggataagcaatgcattattcccaaaagtgttgagaagacaaaattagattaacaggtctaagcaaaaaacaaagctagtaagtgttagaaacttagaaaaatcttaaatttcaagtgtgctcttaatacttgagacatagacataaataattaagcacaaagagtctcaaggatgcttgtataagagacaaaattaatatagggaagcctccttaattagggtgaactagggagagagcacacttgttggaagtaggtgatgtttcatttcaagggcag

SEQ ID NO: 73100 - DNA, 1096 bp, Homo sapiens
cccacctctggcaagtgcatatggttaagagacaccaagacttgataattgaaaacaatcatatctaaatcgcttccattggttttaaaattttgttccatgcaacttttgctggggccatagaatgaagggttaggatgcgaagtgccccacatctgccacattggcatcaccagagcagccctgttttcatcatttgtttattgaggatctgagcagaatttcacctccaagaacaaaaacttgaaactagtgtagtctatctgacacagtaatgaggaaaccacggctcagaggccatatgtctaggaggtatgggaatgaggctccagtaggactttcaacttcaaattccaacctcaacttccctatattgaagtgtcagattgtattttagagatcatactggtccacattacagggttgtattttaatcttattcattatttttttaagggttatatggatttctcagccacactcacatcagagggaaaaagtagattgttgtaagcgttatgacgattactgattgtcattatcatgtaaaagaaatggagatcttaaagagtaatgtgacttttttgatcttatagtgattgaatgcactaagactatgatccagatgttttcactccaaagcacttatctatacattttgctttaataagataatgttcaatctgtcatgaaagtatgtcaaaaaattttagatgtatttgtatgctttaattttactaggtcaatatgagaaaatgaaattaactatatatgttaattaacagaaatatacttaatctggactgaaattttttaaggagttaattagagatgaaattttttgctaagcttatcccgtttcacttcagaagcataatttgggtctccctttccattgctttgttagaaaggcagataacttaaaatgcagtctctgccttcaactgtctttcctgttatagatttttttttttggaaaatgcaaagagaattccataaatggaattggaggatacctcctaaaactatttccacatggtttatctaaatcattgtttctgatatttatggcttctaaagtgaagttgtatcaact

SEQ ID NO: 73101 - DNA, 1041 bp, Homo sapiens
atacttggagacttggaaggtatctcagtgtagttgagccatggtacaagcactaaagaccaggcctatctaccctagggtgttttgaaaagccccctgctgtgttgaaagcctgctgtgtgctctgttgttagggcagctattaatccctcagctggaatgttatgcttttgacactattaagggatgctggaaataataatactggcacaaagcatggagccttctaatgatcacatctgcactgattctactgtagatgtttccacttcctgataatctttggtcactaaaacccagagtatgccaaattttattttcctactctggggagaagcttcctgttttttcttcctcctgggagtggaccttcagccttatgagttggaaaactaaatctccaagggagacctctgtgtgcatcttgtgaaaacctaaaggtttattgctgctgactttttaacactggtgatttaataaccttttaattgttataatttaaaaaaatgagatccagccagcatttgcatttttggtagtcctggagatggtgatgtgtattaattttagagtatagtcgaattattggggtatgtatcataatttgactctaatattcattgtcttatatgttgggaggactaataaattcaacaaaggatcctgaattcttaaagctcataagtaaaaaactgaaataagatgatggtgagaatacttttacatgcttcatagttttgctgtgatgactaattgttgagttactaattactcaactaccttaaaagatggagaggagtgaagtgcttgttattgtcattattgttgttttactgttactctcagtacagaaaataacatcagtcatattctcagagatcagtggttgtgtaggctttaaattaagtcaaaccttgctaattgcccgtgaggagcaaagctggttccctgctgggaaacaggtgcatctttgctacttgatgctgatgttgtccttgctgttgtcaccaagcccagcatttccatggctctcttctccaa

SEQ ID NO: 73102 - DNA, 1027 bp, Homo sapiens
tcccaaagtgctgggattacaggcgtgacccaccgcacccggccaatctgttgagagacttctgtgttgtttccagtttccagtttttgactactgtgaataaagttgtgatggacattcctgtacaggtttttgtttgaacataggtttttatttggctggatgaaaaaaaaagtcatacatttttgggataaatgaccaagagtgtactagtaggtaattgcgtgtttagtgttataagaaacttttaaaatgctttccgcagttgtaccattttacattctcacttgtagtgtaaaatggctttgtttctctgcatcctgaccaacatttggtgttgtcattttttattttagccactctgataggtgtgtattgatacctctctatggctttaatttgcatttccctaattctttgctgaaatgccatgcatctgtgctaacatgacagagtggctcagagccggctggttgagggtgtcctcactcacatgtctggtggttggctgactgaaagctggagtgatgagatggccaagccacacaaccacatgtgtctcatcatccagctggccagcttggtggtaggcagaattctgagagaggagaagctcacaagacctttggagacctagtctcagaactggcacactttcactccccctgtatcctgttttcaaagcaagtcacaaagccaatccaggttcaagggatggggaaattgaccctacctcttgatgggaggagttgcaaagtcagatatcagagggaatggatacaaagaggagcagagaattgagggccattttgcaattaatccaccatatcaggtctctcgtataattatctcccatacatttttatctttcataacacacattaaccttggaaacagtatgttttaggggaaaaatattcagctgggagtttgaaaatcaatattatatgtctatgttaagaaattggattaacgatgcttacaaccctaaaattatccagcttttttttttttttttttttttgtt

SEQ ID NO: 73103 - DNA, 1034 bp, Homo sapiens
gttggccaggatggtctcgatctcctgacttcgtgatctgcccgccttggcctcccaaaatgctgggattacaggtgtgagccaccacgcccggcctcatgcagattcctaaggcacagttgctgctcatggaagagaacatgctgcttgcagggaagtgcacagattcaatgtgttctggcaagtggactgtgcatggaggttggtatggagagcagggcagaagacacagaccatggaggacctggtagagtccaccaaagattttggacttaataatgttgtcagtgtttttcaaatctgtctgttcataggaatcccatgatgtgtttgtcacaatactgatttccagatcccacccaagacccactgaatggacatcttcagggatgtggcctggtgcagcagacatagtcagtttgctactcatgccctgacactccctgcttcaggatgcaattctgcaagtacctcctattccccacctggggtttctctcccgtgtgtggggaagcttagtagtgcagcacagttaatggcctcaggaatagacctcagccagtgacatgagagagttgggtaacatgctagcatcctcagttacccacagtcatagccagctagacaacctgtgctttaaaagtggctgtctcccttctccattcctctaccagtacttcctaggatcccctccccaaataaataacttgtacttaaattctgtcacaaggttggcttcttcaacgtaagatatggaagaatctgctttttttttttttttttttttaaataacgaggcaagtttgggagacctggcctcaggtgatagagacctactgatgagggcattgctccttagatttgcagcttagaaagatgattctggcagatgtgtgggaaatggattgatggaggaggagttggggacatggagaccagctaggaagtggcactgctcagacaatcatgagtacctaagctaaggtataactgtggggatggaggtacggaaaggatttgagatggattctcta

SEQ ID NO: 73104 - DNA, 1089 bp, Homo sapiens
attgccttccagtgtatcctcgtctggctcagcataaatgatggtttatttaatagcggggaaatggactacatgatctcctggatcttttagaccaaatgatctgtgtttcagtgaatcactgtatacaggaaatgggaaatggaaccatttttcttaactgatgttaaaagaaaaactttagacaaattaaatttgataaatataaaactttagacaaatttaaatttaataaaattaaatttaacagagcttaatagaagaatgattagagaagcagcagccctcagaaccagcagaggttcagagagctccacttcacaaagtgggcaggcaacatttatggacagaaaatggaaatgaggagcagaaagggcttgattgctctcaatggctcaatgtctgttttatttgaatatggtatagtcagcggaccacctgtgattgaccaaagctggctgctgtggtcgactgagtctcagctattgttacaaaaatatactcctagttaggcttttagttagtttaaatactgttagattgtagttccttacatagggactcaaagtagagtcccccagggcaaatttagtttaacaccggtaactctcttaacaagaaggtattccattatggatatttcacttctgctaacctcccaaactccatcacttgctagctatgaaactttggtcaaattacttgaactcttttatctttggtttcttcacacaaaaatgaggataataatacccatatcataaggtgttataagaatttaattatatgcagaaagctctcagcacagtatctaacatgtaataagtgttgaataaacagttttacaattactgtttatttttatcataattatttatagtggatagtttctaattaagtgcttccctctttagagtagtcaaaatattatttatggctgtttactatttatacttcacaagccctgttgatgtgtgctcttcttttgataggtacaacataagaggtatgatgcaattcttaagcgtttgcattgtcaggtgaacaagcttcagtcaaatagacgacagtggcaatggaacattcaac

SEQ ID NO: 73105 - DNA, 1073 bp, Homo sapiens
tagtttgaatggggtaattaagtttgttatgcatgatcatacgaagtagtaaatagcaataagtgtgctggacctagatcttttgattcttaactcagggctttatcattttttatcatattgtcttccctgagtgtatacttctgatgcctataaataaattagtaaaattattataaagtatcttacatatataaaatgtcaagataaaacaatgagattttaatatttagaattagatgaacattaaaaaatatataactgaggtccttctgaaattataaaataattgtgtttattgcatgtttccttgtattcattaatttttaaatatctgataaatatattcttataagtgatttttcctatattcattatggattaaaacattgattttcctctcatgtttaatattttgaattaataatgataatgttaaaatgtattacagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggtgtgcaaaattacttagtaaaactattttttctattactccttttttgcaagtacatacattaaatgataaatttattgtgaagttaataaaatgcccatagctgtcctattaccttcagaaactattttcataattgaaaaaaacttggaataagtacatgtgttatataacaacgaccctagatgctcaaatgcataaaggaaacatccacaaatcccct

SEQ ID NO: 73106 - DNA, 1043 bp, Homo sapiens
gagattattaaaaatacttattattgggagtcacttttaaagttattctctgtcaattattctgttctccctaagtaaggtttacatggctattccagttttatggaaaattttacactcccaacatataaagattcaacaatgtcattgcaactgtaggataagcatataaaacctaacatgttagatagaattattttacattcccttatttgatagtgtttcctaaaatgctgaattgaaggaaggttaagttttaagccagtgtttgtaaagctatggattgtgagttacttgctgtcagtgaacatttcaagtagcctccctctatgttcctttcctttttaaatatattgataatcctactgcagggaatttgggagccatacttggtcttcgcatgcaacgtaattagatataactatactatgtgaatatgactaaagaaatgaaaatgaaaacagtatcttgtgctctgtaacgattgttattaaatatatcatagaaatgagaagagtaggctcaggagctgaactgcctagttcaaaaggccaaatttactactttttgttccgtgaatttgttgtgctcctgtttccttagttgtaaaacagagataacaataggacgtgcccataagcttttcatgaggattaaatgagttaatgtgtttggtggggaccaggtggacatggtactggtagggccctatttgacattggctttaagtatcactggttttaagtgcatcagtagatatatgatgacaataattgtattatcatggtgatatggatttcttataaatacttgtattatgttagtcacttctagaaaagaatacatctatacagtagaatataattcaaaaaataatgtcatatttttgtaaagaaattttttgtaaaacttttcagtcttcaaagagtttcatagactttattccatttatattgagagcctactttgtgttaagcattttgctgaacattgtcctcactcttatgttacttaccatctattgggaagagaaagaagtaaac

SEQ ID NO: 73107 - DNA, 1039 bp, Homo sapiens
tggtgttcacatctaaatttctgaaaaggtgatctggttactaaaatcatcccaaatacattcataaaccagatccacgtgtgaccagccctttacaaaaattaattacagttgccacagcctttacattcattcttatcacacgttacaacatgcagataacacaaagaaaggtcaacaagctgaagtaaacattacagcatcaggaaaatgaaaacccatctgtataaaataaatacaattttgtaataactgtaaagaaaatgaaagcacttaataaaaataatggcagttgaatgtataactgtctcatctcccaatcataaaataagttactgtaaaatgcatagactccttacacttaaagaatttgtgcatcacagtcatgtgaagttgaactaatcttaaactctgtattttcttgtggaataaaaagggaggggaggacgcatttaaagttagtgaatgtattgctcttactttaggtataacgtggtagttcaagtagataaaagcatttaggaaccctcacccacttctatctcactcctacagaatctctagtaattgcttttctgtaagtagatttttgggagaaactcagagaagcttattctatgtaacatgacaaaacagaaataatatctatatattcagcagctggaaggaaagataacagtgacatacgagttatatgcttttatatctcaaagtgggatttgatatttatttttacttgattgtcctagagttatacttccaatgtatccatcttactttttgtgtgaactcttagagaatgctaccaatctatgaaagttcagcactttaaagaaagcattactcagttattgtgtgttatcgtgtttgtatgcatgagtctttgtgtatgtgctaaatggcaaataagaaatatgtgtgttaaatatgacacatagcctttttgccctagctaatataaattaacacacacataacacattggatgcagtagaataatagatttctctctatagattttttaataaattatgcagta

SEQ ID NO: 73108 - DNA, 1053 bp, Homo sapiens
gacacaggaaagtcacctctcaccaaaggagatactgtgttctccaggacaaacagtaggcgggtctagctcatcaatgaagcctcgcatcccacataagaaaagtgttgtaaatttttcctaagaggttccacatttcaccagttaatgggctcctagtgagcccattccaggttctctagagttaaacactaccaaagccttagacgaacgcgtgtaggtctgaattaaacatccctttcccctcctgggccccagctctctgcatctcaccctcaccaggtgtttatgttatgtgtgcaagtgcatgctacaacagaatgaactaatgacccatcatcaaacaaattccacactcgaacacttcccagtgtctcatacaaaaggtgcattcagattttcatttccctcttcttagtttttgtttctcaagtttctcctttagctctctgtgtgcccttgcatgttctctcctattcttggagcatgttcttgaagtgggtttattcctcctttgactgccctcaaggttttctctttctctctcctccttgagcctttgatttctggcttattcactgtctcaagttccaatttctccctcctccagcagatcccctttctgcagatctttctataattgtgcttgttgttttcctctggccgtcttaacttccaagaatggcctcctccttggcttgccctttcctcccttgtggccctgggatggggctgttttctccggggcaggcccagattgtcgcctttcctcagcagggaggtgtcttctccctgctgttttcttcctgtgctttttgtttagccctagctgttctctcagtttcccacttccccttcctctcttatcttcatctaaatccatcacccttgactcatgtgatttgtagctttcaattttgcaaaaattgcctgtcttaaaataggttgtacttgaacacgctgtgtacctcccttacagaacagcgcattattacatgaatctggatacactgcaagtcacatcctgacctctaaattgcaactcctcacagg

SEQ ID NO: 73109 - DNA, 1034 bp, Homo sapiens
tgagccccggagttcaagttcagcctgggcaacataacaagacctcatctcttaaagacaaacaaaaaaagtgaacatttacttagaatgagaagtgaaagcataacaaatcacttgttcaatgatttgaaaggcaaaaggtcatgaaaggcaaatgaaatggagattccaggggctggcctgtgcatacgtccatggtgtaggtggttaagagcagcagcttcagagtggtcttgatgaggtggaggacctgattcacacgtctctcccagaccaaagtcaataaagttaaatccattcatcaataaaggagatttgttacatgtaaactgcagcaatttcgtttgttttcctttttttaagacttcatagatataaatatttacagatatgtctgatcctacattctaatttgggatcaggaaaatacagttgtgtgtttcctgttaatcataaccttcatctagaaaaggattcttcttcagatcctgggtcttacctggttggggaagggagcctggaaatgtgggcctgggatatcaggtcaagattacagtgcctttactgtacagcacactttgttttgatcttcttctccttctctcccatctctctcatgtgtgtgagttttcagatgttgtatggctgacagagaaagtatgtgtgtaagaagacatgtggagagtcctgaccctgtgggcttctcatggtcttctgggcagtttggaagagctaaagctattcttttgagaaagcattgtcctgctcaaggacagggaagggtgcaaagcctatctgtatcttcctcccatttctttttctcactgtcttcctcacttgtccttctctccctatactggaagcctacacaaatactcactaattgagatctctgaaagatccaaaagcatgaatagctaagggtggtagagttttggctactgtaacaggaaatgggaagttcaatgtcgggggccgtgggatggtcagcttccgggcacttatcaaatgactcaggctatgcctgcccactc

SEQ ID NO: 73110 - DNA, 1055 bp, Homo sapiens
ggattctatttagctgtaattgtggaaaaggcatcatcaaggttgctaagcagcagaaattggtttattggaaacaactttctgtgaggaaagcaccccttgttccccaaggatgtgtgtcttcttgttgattgacttgctgagtgaattctgcaaaagattttccccttatacctatgggagtactgggaaggcaaagcggtagagaaagaatcaatgttagaaagtggatgaggcactcttaagcaattaagggaccatgtttcttctgtccagaaacctctaattaggaaatctgaggccctgtttggctgtgtgtcctttgccctgctgtcaggcctcattatgggctccaccaagatgaggaaggaactcagagacagagaagggacatgtgtcatgctgggatggcgatcagtcaacccaggaaaggatgtggacttaagctattcctagtgacttgaagtatcacagttgccacactcatttagtttaattatctagactagcagttatgctcatgggaccatgaaggtaagaaaaacagtaaagctacctgtgtaagtgtatgtgttgggggaaaaccattggcatttattgaatgattaatatgtgatagttttaagcattttttgtgtacaaaaattaatactattagtttaacattctttgaagagagtgtggagaatgtgggtcaagatttcagatttgtgatggagtagagtctagacctgcctgtttaggccacagtgctataatcctatagttcaaagattcccaaccagccacatagtggtatgtagtcagtgggtcacatgtgagctgaaatactgaccctctcagtcctcaggagtctaggtagtttcagtggtcatgaggccactcaggtggtcacgtgtggccataagaagattctcctttcaacttaacctatgtagcagatgttataatttttaacaaatgtatgacaggaagttagaaagttgtgaagcaatactatggtctgtttcctatgtaatatggattgccctgacttaaccatcaagtgaatggga

SEQ ID NO: 73111 - DNA, 1050 bp, Homo sapiens
ttcagaaacccagcctgttctatctcccgttagacaaccacctcacctgtggagagaccatgccttcccaactgctgcaaaatagaacctctcccacccctttcaataaagggcctacactccttaataaggttagcccactctggacattagaaccctgaatgaaaaaatcaactgcatttctctgcttgaagcatcttcttcttagcagaatgtgcatgatagggtttctttgaactttatataggcaattaaaaacaaacaaacttgagatgaattgaaaccacacttagagacaaactctgcccagtttgctaaaagtccatcctgtttactcaatatgatgaactatgaataacacataaacaacataatgctatagccacagtgtgggaccattataacggatatcaaaagagaatgggcttgggcatcatggaaaacttggtggttgggttctaactccaccacgtagtgcatcttatagagcgtcactatccttatctgcaaacgagggatcctacaagtcaaatggcagtgctgtgctcagcttaagcccatgatatgtagagcacctagtgcaggccttacagagtaagaaacactcaacagaaagtagccagtgctgcaattattcgtccagtcccttcttgatgatgttatggtgtaacctgaaatgtttctgccttccttcttgtctagctcccgtttgcttgttatcatcctgactttgtgtccttcactgatcctcatccatgcctcacacccaaccttgatgggctcatcacttcctagtcttagtattaattgcaaagggttttctgtatactgtttgctcaaaacttgaacctaaaagtagtctacatcaactgcttttgtgcatacagattgagctctttatattactatttgctgctctatgagaccaggcaaatactggaagaaaaacatgcttccaattctcccagagctgcctggaagtatcttgtggtggatgaagcagagccagagaaatgtgttcagcttgaaataaatgattatactactcat

SEQ ID NO: 73112 - DNA, 1015 bp, Homo sapiens
acaaaaaggaaagaaaacaaatcctgcaagacaggcaactgcctttgatttagaaatgcatgacctagagttagagaaaagcttgaggacagtttgtacattctggtcctggctttatacaactgaaactgaggatggcaaataatttcattacatctaacagctccagttgattgtgaaggctctctggaccatgaggaattatgaggtgagctccaaggcttgggttgggaccctgtggttattgatggttgtctgccatactgcagaagaggagagtggtggaacatgggtccttgttgaacaaccgtacatccttaaacaattaggaaatctcctaatttgtttaatcgtgagtgtttagagaaacagttctccatattcctgagagtctgagggcagaagctgaaatgggcaaagaacatatagaaaaggtgacacttttccatctaaaggagagacgaagaaataatgagcaattttgttatgatctaccaaactaaggtttcattatgtttgcccctcattgtggaaggcactgtttgattggcaatttgcaccactaccatatataatttagtcctggagtatgtgccaagaactttgtaatgaaaccctggttattcctaactataggatttatttttcaagtgaaggtctagacaatttcagtaactggcccagagtgtgaggttgagaacggaaggagctttagttctcaggctcctcaaccactacctaccatggtgggctgacgctgcatttcttgcttttccctagcagtcacctagtcagtgctcctggctaaaagagagatccttttctcttttgacccttaacatccactggtgaccaggaaacagtgccagctatgtctacagatctcggggacatgcagtgtggagggtcaggtagttgtgtggttaactggtctaggtctgcccaacggagtccatgtgtcagggtaagaacctggatccccatctgctatacttttgttttctcaagtaactcc

SEQ ID NO: 73113 - DNA, 1051 bp, Homo sapiens
tcttaatcccttaacatgctgagttcattctaatctcaaaattttactcattccagtttcccctcttggaatgcttccctccattccactgtctaacttctattcctccctcaagctcatctcaaatcttcaagatcctctgtgaggcatccctgtcaacaatttcagctcatttcaattgcttgcttctttcttttctcattgcctactatcacacaatgatggcttcattaatattcaggcttctatttttctgcaactgagttctactattggaccaaagcatcttgaagtcagggcacgtatttcaaaatttctttttatatctcttgcaattttgaaagataggtatttgctcgaagtttcatgtacatccaacaaaagatgtgcaaaatctttatactaaaatctagagaacgttactgagataaattgaagaaggcctgagcagatcttaagcattttcatcacacccacaaaaaaggtaactgtgtgaggcagtggatatgttaattagcttgattgtggcaattattttacaatgtatacacatgtcaaaacatcacattgtacaccttgaatatgtacaacttttatttgtcaattatacctcctaaagaaaaaaaaaagcttaagttaataaaagtataaattgggctcttggatgggactcagtgttacgatgcagaagaacatcttcgcaatagtgggaaagacaaagctttcgtaagtagcacataaaatgtactaaacataaagttgattagacataaaataaattagactgcattaaaaataagaatctttgtttatcagaagacaccattaagagagtgaaaacaaggccatggattgggagaagatatttgtgaatcacatatctgaaaaaaaacaaaaccttgtatccaaatatataaagctctcctacaaattaataagaaaaagaaagatatcccaacagaaaaaatgtacaaaagacttgtagagtttacaaaagatgaactctaaatggtcaataaatgcataaaaagctgcctctgacttcattact

SEQ ID NO: 73114 - DNA, 1034 bp, Homo sapiens
attactcaggaaggctgttatggaaggaatgagaatgaatgggcccacgctgacttagaaattaagttaaaacatatggcaaatgtttttctgatatgcacttaaagcctggaacagtccaagaggccctgggtttccctgagagggaggcttttaggaagagtgtaggctgcctgtggctgctgcacctaactggattacaggcctctgtgacgctgcccatcacatctgcttttcagtaatgccgtaggggaggcaagctgtccccttagacccttagcatgatctgtctatgggtttcacattttttcctggcagagttagtttttcgtgtttgttttgtgaagaaaaactttgtatacttctttccttttttttcctttgcaataaagtgttgaacaaaatgtatactattttgtccaaactttttaagcttccagatttggatatggtgtttatgtctgtggcttttagaaagtctgaatggatctgaaaggtcagaaaatacctaaacatttgactctacccttcagctcacacgtgattggctgtgcattgttttatttttaaaaatggtaaatgagaaactattctttagtcatatcttgttctcagagcctttccccctcttgcagactgtgccgccacccaaaagcttgaaaacaccccaggaagccatcccctcattgtgaaatgactaatcaccacacaccacttggttttccttcctggacgtcataggccatagccctgtagttcccacattgtctctgtcatcatcccaaggagtgtgactcttgattctgagcctgggcaggacagcctgtctcagcacaggctgttatataagcggctgtggggagagctggcaataaacaaacatttttccagcccttgttttctctgcagccttgaaaaatatttttctggggctgctgctgtgctcctgcaacaggatggcaaattcccagcttagaaatgtcttgctctgcatttccagattctaaaatcagaacaaagtgaaccagcatgtt

SEQ ID NO: 73115 - DNA, 1161 bp, Homo sapiens
agtttcaagaaggccgaagaagagacctagagccagcagacgagacatagggtttgattaagggctcacatacaggggagggaatccagtggcagcaggctggaggggagaaccaccttccgtattggaagagtccagtggcagtggactggacagcataactgcacagcccagtggtggcagtctgggcaggaaaactgcaaccacttgcaaacagcatatggttcacatggcattttcagttaacaccctcccaccaatgacctccacctggtaaccttcacttagcccaaaatgcaggacctcaatcacctgcatggcccatgttccacgggacaggccgagggctcagaagtttatcatagacaaggaatgaatctctgggttggccactcccagattccctagcacaaaacacacattcagatgcatctgccaaatggggtcattccaagaatgtgcttaaattattgctgttaggtgactacaccttgcttagctgcaagggaaaatgcaccattaaactcaggcctctgtagtaggcagcaatggagtagaaggagttggaacccatcgtataggggtcagccaagtgtctgcctcagatcacgctctgaacttcaggaagtaggaggatgggctgtagtccatagcttagccctatatgttggaaaaggtaatccagagaggcgggatggtagtgagaggcgcaggattgagttcctaaaagcctgacgggattcttccttccacctgaccattctgtcttcatttcccaggaccacctgtggaataacagtaatagtctttctctgggagcaagttaaggctttggggaagagaaaatgaggtcatggttattgaaatataaaaactttcctgaaatacaaaattttctactaccacccaaatatcaccccgggggtttcctactccttaagaaccagataaaatgagctcaagtctttatttcttggtgctcttaaagctgtctccagaatgtcttcatagaagaaggaggtttgtgttctcatagccactccagcatgcagttccatttgggctgcctgtgagttcagtccctgttttcccccagttggcccagacatggatctcagggttgttttttttaaatttccaccaacctctctccaagttctg

SEQ ID NO: 73116 - DNA, 1042 bp, Homo sapiens
ttccctgtatcaggtcgataaacatatatggttctgtgtgtgtaaaagtgtgtgcatgtggttgtgttttgtcctctctgcctgtaatgggaatgacaattcaagatagaaatggtataatgagtcatctatagcaggcaggggtgggggaaagtggtgggtacaaaaatgattcagacaaactctctgccttcttatcattggtgacatgggggcgggggcagtggttatgaaaaggggaagaagaaagttatgtaaacagctgtcttggaaacatcaggcagaatgaggtacagtcgccatgagactgcagagagaggggttttaatgttgactacaagatctggatctagcgtcattaagctcctttccttcaaggccgctttctgtttcacttaggaacagaacacttgactaaggactataagtaaataaactcgtaaatgcactttttatttccttaaaaagtctggatgtaagtggccccggagtttgttggctgacttggttatctttccaggctttcccagcctctccattgccatgctccatgctgctggcttttgtcctcatgcttcttggttttagggtgcttattggtggtttccgtccttgcatgagcatcataagggcaaatcttctctttattaggctctagatttttattttttaagaaacaaaagtcttttctaaagccctcaatactttttttttatatttccttctcagtccatttggtctactataacaaaatactgtagagtgggtaatttataaacaacagaaatgtattggtaagaagggaggctgggaaatctaagatcaaggaaccagcagatttggtgtgtggtgagggtgcgtttccaggttcatagatggcgccatcttgctgtgccgttacatggtggaaggggcaaggtggctctctggggcctcttttgtaaggacactaatctcattcatgagggttccacgcttatgacctaatcacctcccaaaggcctcaccttctaataccaccaccttggtgataagatttcaa

SEQ ID NO: 73117 - DNA, 1038 bp, Homo sapiens
catttaacacacttgtcccaggggacagagctggttaacaggaaatgtgcccttgaagagttaaaaaattatcttactcttcttccctgcagattttagttttcccaccaactgtttagtagcaaggagcaactgatgcgttatgctgtgtctttcctatgggaacacgcagtttggtggcaaagaaacagagtaaaaaaaaaaaaaaagttacccaagtggaattgacaagggtgaagggattctgattggccaatgtagaatgttagaaagttattcatggagacaaagcacacagatttaatttaatattgatttcagcttcaggaggaaaaaactgctcttgcagctgagcgtggtgtcatgcagaaatctgttttttcattaggagcaggactctcttctcctccccatagcctccccacatgcatatctcttacactggtggcattttgaggggctgttttttcaccccaagggcaatggagggcagcacatatagtgcattccgtccaagtcacccctggagagtgaccaggaaatcccacacagagcaattccctgaatcagatgttttgctatcttatagcctaggtttgttaggattttctctaacaagcctagagcctgttcttaaaatgacttttaataaccatcactctggttttgcctccttgacacaagggggtttaaaaataaccagtgttaggatcagacaccaggttcactatcactctggtacccatttctggtgcatgttttccttttaagccatgaagaaaatgacatcattcagggccctggctgctgtgtgtggtgtcttcctgtatctccgagcacaaacactcacccattcatcccctggctgcctgaccacctgaaaacgtgactgatacagaaatagtgccaggcaaggaacaggtgggtgagctgagcttggggtcctgccagccctcccatcgtggaataagaaatcttgcgaataaacaccgtatgatttaattgaatctgagcgagaagatagggtttttacagaaa

SEQ ID NO: 73118 - DNA, 1400 bp, Homo sapiens
gtcagtgccgttctaagttcacatataatatttcatttgcccctcacaatgattctagggaaacgtattctctcttttctactttacagagcgagtacagaggcatcatgcaaggtcacacagctataagtggcacagctggggactcacccgggctgtctggctcccgagtttatgctcttaatcagtaccaccttagggatgggatggtcaacaacacaatcaggaggtgggtgagggtcagccctcccctgagctgggtgcactggaatacacctaccatcccctggtcagggctcaggccagcacatggggctgattttgtgaaaagttgtaagcataagcaaataatgggtgtttgccaagttgaagacaggcatagaattgaatcttctgtctctcctaatgtcaaataatgaagtagacagtcgtattcttggcatattatgaatttcttgttttctagttggacagagatcaagggtctcttggtttagaatcacaggaccaagggataatgcaaggcctgttaagaccttttggtgccattggccaggaccacatggagcagggggtcattttggtattaaacagtgactgctggtctatcctctagggggtgataatctccccttcctcttcttgatggacatttattcaatagtcaccaaggagattcagcaatctgggtgtcctacagcctagatatgctgtcctgtgttgttgaggtttatgcctggactttgattgatgccagcccctccaaaggctctttccacagctgttgcttctggttggatggtgcactcactgtgctcagcacctcaggaagggattgagggttgtgaatagtggagatgtgtagggagagtagggaatatgtttcactgccaatatacaagcagtatatcagatttgggaattctactggcaagggttgagtctttgcttgtcaccgggctaaaagttgcttcacctttccaaacatcagcttcctcacttaccaagtataaccactgcattgcaagttgttgtctcgattaattgaagatgcttgccatacagtagggactcaaccatgttagcttctccccccagatgctaggggctgtgtgctttcatggaaagaaatgcttctgctagacttaattgacatcatctttggtgggtcttttctttgcttctgaccacacgtcttttaaacttgagatgcttttatgcttccgggtaacaagcaaaagtcaggccaaggaggaagcaaaactaggatttattggtggggggtcatggaatagggatgttagagattagcagaaaagaactgcaatgatttaaaaaggcaaaaaaaaaaaaaaaaaaagaatatcctggaaagaaataattacatttaagttgatttc

SEQ ID NO: 73119 - DNA, 1790 bp, Homo sapiens
tgaatggaagttcttgatctgggaatccctgcccacagccctagacctgagtgcatgggaagctctgtgctgggcttggccatcacactgcatcatctctctcccactgcccctaggaaatttggcctcaggtctgtcctgaagcagcagccctggggtatgaccatctgtgaggctggcagactagggaatcctctgggagggggaccctccctaaatttagactcttttgtcaagtgcaggcactctcttaaacttagacagcttgatgcttgtttcctaagggtgtagacaacaaggctacctgaagagcttcaacatttggccctggattgtggctacaaccatctgtctgacatagtggcactcctcccagccatactgagggagcacttcctaagtttctcatctttatggcctcagaattcagccattccgtactgtcttgcctctgtctttgtatatatttattccctcttagaacactttctacttgtagtctttgattcaacacacattcacccaactagcttggcacttctctgggcaccaaacctggtttaggtcccatttgtcctttgggccttgcccatcatttaattccatctactttgattacttttctctcccttttccatccttttcctttttctcccaaccctgaattagaggctcctcctctgatggcttagaacctgttgcaaattcttctcacagcagttaccccaggtattgcagttgcttcctggaccagtttcctttccgaccttatgatttattattatttatttatttatttatttatttatctatttattttttgagacagagtctcgctgtactgcccaggctggagtgcagtggtgtgatctcggctcactgcaacctccgcctcctgagttcaagcaattctcctgcctcagcctcctgagtagctgagattataggcacgtgccaccatgcctggctaatttttgtatttttagtagaggtgaggttttgccacgttggccaggctggtctcgaattcctgacctcaagtgatccactcgcatcggcctcccaaagtgtgaccttacaattcttgagagggcaaagatagcctctggttcatctttgcattcagcacctacaatactatccacacatactaactgttcaataaaatgcactaaatgaatgaataaatgcatgatcatttttatgtattttacaaatacaaaatacaaaatcctggtgaagaattggctaagaagatatttttgggactgggaaaacaagcaagagctggtttagtatgattttcattgtaacctgaccttgaggctctaggctgagtaaacaaaagatgagagacaaaatattggatttaagaaatgtaattgtctccatgtttaaaattttaaaaatctgatgctatttgactcacagagggaaaacaaaagtgttgctatgagagagctgtgaattttatctcatctccggggcaacagagtgaataattttatggagagaaggggagaaattaagacaagagtctcacaacgcaaattcagtgttccaaccaaaagtcatttaaagaacaaaacagaacaaaacaaatgttccaaaaccacaagggtaggtatcaaaacccaaataaaaggaaatgaggcagattcccgatacaaaatcttctgtggtggaggctaagatggcgaaacaatggaaattttatgagcatcagctttgtcgaggcacagcaatgcagatcttgtgatgctgacagcaaggaagaaattgcaagtcag

SEQ ID NO: 73120 - DNA, 1070 bp, Homo sapiens
atcttcagagttcatgcccttagaaactgcattcttctgcccgtccatcttgactcatctaagctgggttgttaggtgtcatttgcatattcttttgtggtaattaagaggtagagtacttattttttttaggacaaatctgtagaagtcctaaaacaaaaggggatctctggataactcttggttgtttcatgtcagcagtacaaagcaattctcctcctagcacattttgcttaatctagattttgcgtcaacaaataactttcagtaactgaggcaatcttgaagcggattagagcaaattcctcctgtgctactccataactaaaccaaatctggtctggtctgtggggcttgtctttggaaatgctgagatatagggagtggcagggtgaaatcacaacattctctttgctttctggcaagaatgttgaattcttactgagcggatgtggcaaacacagagtggttggttttatctgaaccgttccattaaaatgaaatttgactagggatttgaagagtattatgactaccttggggaattcctgtgtggatgtaaatagagcttagtatttgtttataggtaaatacccaaaagatcatcacaggtgagggtttaaaagatacagcaagagtagcttttaaatcagggctttattttatatgtgggtacttcgcacatagcactaatttctggatatgaagatgacatttcttatggtactttcaactcatagttatatagcagaggattcatataaagacaggtatatttgtgctctatgtaggttttaattttatccttaatactaagagagagtaacatccaagtgactagaagcttcccttgttagaagccttgaaactgctccattcctcccctctttctccctgcccagggaatctaccacagggctttttgctgcaatcaaaataaggctcagcaaagagcaaatcattgaatgcaagtcatctgggaggcccctcccagccattttgtccttagtgcccttatactacttttcatttctgatccagctttccccttggactgagatttctgactc

SEQ ID NO: 73121 - DNA, 1038 bp, Homo sapiens
atatctggacaagttagggatgtaacaaactgcagccagctttttaatgtttcttcctgagctcagaacaattcagtcattctccttaggttgctgtaaccaggcatgtggtatcccattaggaaaatgcacccaaccttagacaagggctagtctgtaactctcttgtgtctgtctgtcccctggatttacgtggaagaccacctgcttaagataacccagggccaggtgctatgtatacctgtaccatctatgccactttggttttcttctgtcattactgtgttgttttgggaacttggttcagggaaatgatgatgccagcagggcagattccctgagctgcccagaatcccagagggtacccctggggcaggcgggtatggtttactcatcttcaagctgcaggaagtagtggctccaggataagcacctcagccttcggagaaggacgggcttggggaagggagattttaatgtagtgtaaacaagacagaggatttcataagcttctcggaaactcctggacctgacactcatcatctgctactaaatttggccctttcatgttccttgcacaggatataatggcaaccatgacacagactctgggctgaatttagataaacaacatggctgctgaggatttgtacctgttaaaagtctaagaaatgtcaaaggttgtagtaagtatgactcaggacaatttcatttaagttgtcaaaagtaggaaaaagtcagcagtatagctgatcactctcttttgtgcttttttgcacttgtaatttccatgactctcactaaactgcgggaggtaaaactatttttgttctctgggcttttgcgtcgtgtgtaagctgattcccaagtttgggtaatattgtggaaagcgtcagtaccaccactgaagcctcctggagccccatcacctccaccctcttcccgggcaggtggagtgaatctccctgactttgaatttccagagtactcgtgcatgcctcgattacagcactagttgcttacagcaaattatctgtt

SEQ ID NO: 73122 - DNA, 2329 bp, Homo sapiens
catcttaggcttcaatgttaaaatagagtggaatatgcagtagttgactcatactattgtagctagacaacttgtcacttaatacttcatgactttagggattggttaaattaataattttataaggcacatagacgccagagagcttcctccattttgttcttttctctagcaatgtgcgtcatcattacacccctaccaaatagtgtattttagaacctgttatgcataactctgcctctgctttcactttctgtttccctctctctctgcctctccctcggcctctatgtctctttcattcactcttacttatatatactaaaatattgcaaattcgctccctaataattaggaagttttttgcatgtggcttgaggttgtccttcaaaggttttaaatatgtgttgatgagaataggcatagggaggcaggtgtgggacagcagatggaagggatgctctgtgttcaaagatcccaccctagtgaagtgaagcttctacctggggttaaagaccaacttcctgattgtaacagctgtgacccagaatctactctggggttgacttcttctgagagctgatttggctgtgtgagcctggaatactgaagtcaggagtgggagcagcagcagcgacagcaggagtatgtttgccatcaggcatcagtgagctcctaacccctggccagcccggtgtggtgggaaagcacaggttttgcagtcaggggagctgggttggagttcagggttcagccatttactagctttatggtgctgggcaatttattcaatatctctagtcatcaatttacttttttattgttgtaaaagaaatacctcatgttggttattgtgaaggttaactgagcaatgaatgtgcaggtatggggagtttcagatgcaagctttgtctctgtcccttgagaggacagtgtgtcatgtgacccatttgagaataccagtgatttagcgcaaaaagttgctttatctcttcattccttcaattttttgttaatacatttgctcattcattcaatgctggccacgaagcatgtgacaccagtcaggtgttggggatactgctgtgaagagtccgaccctctcctcctcctaccagtctgggggagatgctgaccacaaatgacagtcacaatccagtgtggagaagcaccacactggggaaagtacaacatgctctggtggctttggagtgtcagacaacagagcggggaagaggttaggaaaagaagtggcccacaggataaaaacaagcagctgggtgaaggtgaggcagaggatgtagcatggcacacagcagtggtgaagaaatgaggatggcgggccctctgtagataggtggacatgcctggagtatcgagtgtgagggtcgtgttgagatatatacagagatatggagccatcacaagctatctgcacccaggagctttctcctggcctccccagtgacgttctgtacctcagatgttgattccatggatgctgtcatcaccaaagatgggatggatgctgggacactcctagcacttagagttagaacttgcaatacatgtttcccgtagaaacagcatgttaaatggtagttcaatgtagttaggatattgctacaaataacacctttgagtgtacttaatttaaacctgtgaaatgtagaaaaatcaaagaggacaggtcctgttccaggctagaggtactttttgcaatgcagagcactatccttctagatctggccagcagagcatgaatcgggacctcaggctggctttgcctgcatttggatttgaatttgaatgttttggtctaggaggctctctgcacagggtttccatgattccatcactccctgctgtttcatatctggctgacttcctcacagtgaggttgcctacttgcccctggaggtactggacttggaaaccctttctctaggcagtaggggttggagatagcatcatcgtttccgactgattcatcatcagcttggtgttagtccacttacaaagtcaagcatgacagttgaggcagtgtttggaggtgccctctgactttccaccaaatgcttttttttttcttttcacttcttccaatcctcctttttttttttttttttttttaatcatttcctctaggcacttttcttttctagggcaattgaattcaattcagcaaaagtatatgggacgtcttctatgtgtctggtacttaggatgcgagggataacagagcacagtgtcactttcagggagatcacagtctagcatgaaggggtgggagacagacaagtaaaagggctggttctagatggtgagg

SEQ ID NO: 73123 - DNA, 1081 bp, Homo sapiens
cagagaaggaaaccagagcttttcagaactcagctcctctgcacagcgacacagtgagatggacaagggctgctctactgaatttgcaaatgtgaatttaacccacttatgaaaacagtaccgggcatggctatatcacttatcagctcatcaagtttgttctggaggggaagcagttttgtgtggccccactatcaggcaccagcctcataaagaagcaagcagcacaaatcctaaattctgtggtgtttaatggaggccatgtcaacacaacagcgggaaagagagggactctctaccaaccggtatactaagacataatctagaggccaaaggactccagataaattacccattgcccaaaacaaaaggaagtcttttgataagagaaatatttacacctggggagtaagccatggtcccaggaagaaaatgtcttaaaatgaactttgcatctatttagttttgcattttcagtccccaaataccccatcactgttttcctgttttctttttctctcccatgagctcactatccctttgcaaatttaggggaaataggactgctgttgactctgcagctgcaaaaaaaaaaaaaaaaaaacttgctaagtggaagaaaccatttaaaaagggccacatactgtatgattccatctacatgttacatatttatagctgtccctcagttcttggattttctggtctaattttttccatctttttctttccagtttggaagtttctgttgagatatcctcaagcaattctttcctcagccttatctagtctaccaatgagcccatcaaagacatttgttatttctgttgaagtgtttttgaagcattttctcttgtttcttggaattcccatctcctgggttacattgccttatctgttcttgctctctgtctacttatccagtagagtcaaatattaatcatatttgttttaaattcctgatctaataattccaacatctctgccacatgtgagtctggttctgaggcttgctctggctcttcaaactgtgtttttttcagttttagtatgcctggtaatattttttttttaacttaat

SEQ ID NO: 73124 - DNA, 1031 bp, Homo sapiens
tgtagccatcttgtcccgcctaaagggggctgggctgagaacacctgtgaagttcacagttcgcaggcagaggctcactaaattaagacctaattataggactacagattacttcccctccccacacctcgccaccacattattaaaggcctgtttacagcagttccttttacccagtatatcatacccagctatcaagaaaattaagttaaaaaaaaaatattaccaggcatactaaaactgaaaaaaacacagtttgaagagccagagcaagcctcagaaccagactcacatgtggcagagatgttggaattattagatcaggaatttaaaacaaatatgattaatatttgactctactggataagtagacagagagcaagaacagataaggcaatgtaacccaggagatgggaattccaagaaacaagagaaaatgcttcaaaaacacttcaacagaaataacaaatgtctttgatgggctcattggtagactagataaggctgaggaaagaattgcttgaggatatctcaacagaaacttccaaactggaaagaaaaagatggaaaaaattagaccagaaaatccaagaactgagggacagctataaatatgtaacatgtagatggaatcatacagtatgtggccctttttaaatggtttcttccacttagcaagtttttttttttttttttttgcagctgcagagtcaacagcagtcctatttcccctaaatttgcaaagggatagtgagctcatgggagagaaaaagaaaacaggaaaacagtgatggggtatttggggactgaaaatgcaaaactaaatagatgcaaagttcattttaagacattttcttcctgggaccatggcttactccccaggtgtaaatatttctcttatcaaaagacttccttttgttttgggcaatgggtaatttatctggagtcctttggcctctagattatgtcttagtataccggttggtagagagtccctctctttcccgctgttgtgttgacatggcctccat

SEQ ID NO: 73125 - DNA, 1447 bp, Homo sapiens
ctcaggggtgatggctggtctaacagcatgtttctcaaactgggatccacagaatctcgatgcaaattttataatcttattttagcttaaccttataaatatgacttaaaattatatatttaatgcaataattgaagcaacggggtgaccaagttatcgctagtatgcaggtacaatttcagtgctcacatgtatggttgtattccctccaatgaagggcaagtgacatcttgaagcttggcatgaatggagggaggtgtagcaccaaattaaactgaggaaagtggtgggagaattgagtcatcccacagcacggggtagcataggcatgccacactcaaaaatgccaacatcttaacaatgtcagcatggtatgtgtgttgcaaattagtttcaacaaaataacattactggtgttattagcttaatgtggttgatttgaattttattgacctttgaaggtttgtttttcatttaatttgtgagtttgtgttacttttcaagttatatcagagctgtcagcatgaagagtttatacccagatttatgttggtatatttttaagtagcagtatagtaaggttaattcacattaacactgaaggtcagggatgccttttttctctttatagctcccacagctttcagtgtgagaagccctaaccatcacaggggggtcaacaggctctatctatatttgatctgacctggaggagatctttacttttggactttacaaggcccaaaaaaatgacttattgcaaatgacaggaactacattcaggaattctacccattgtcttcaacataaattcataaaaatatgcaaaaataaataatagctcctgttcctgttcatggagaaactggcactcctcaacttcttagcctcttctcccaggcttggtggatcatcttctgtgcttcatactctccttgtcccttctggtcagagctagggttgacagactctttcatgcaggatgcttgttttgtgtacagaaacttctagacttgacatcaggaaatgctcatatttaacttcaaacacaattctgatcagtagtttctacggagtttggcatccctagaaaacatgctgcaaactgctgtcttcctattttgctcatgaccccaaggcttgctctgcacatctgctgtttgtctctctgtaacatatatactctgcctttcgtgttgcattctctgttgagatttggatcctgcccaagcagcacgaggggcctttggagctctctgggcaggaagtcacatcctgtgcaggagccaagttgaaatggcttccgatttggggcagaaacttgggtacacagacattttgtgaaaccattgatgtttctacttgcaaatatttctgcaaacaggaacaatttctgttaactttccatgacctgtgtcacagaggcatgatgcctgtctgctatttg

SEQ ID NO: 73126 - DNA, 1054 bp, Homo sapiens
ctgggatccaggatccccatcagggctctcagtccagtgtcccttcctctgctccccggcttctccttgcagcacatgggcactccctaagatgcttgctatgagagctgactttcgcccgtctgcctcctttgagttcttcatctgcccaggaccagctctgcatgcagggaagagctgttggctcttgggaaaacctgggtctcccggggccgctagggacccagagagaagacccccctgcggtttccccttcttgtgaaaacacaagttcttgtgtggtttgggagagattcaccctctcttttcatgaaaccacctgggaggaagaaatatgccccaggagagtttattttctttgactgatagaaaatagagtcgtgttaagggagcttttgcatggccctgagtctcggaggatgggtttcaggtcagcaggctgctagatttctgtggggcatgtgtgtgtgtgtgtgtgcatgttggggtgtgtgtgtgtgcatgttggtgtgtgtgcacctgctattaggtggcagtactctgcatgagcctccataaaaggtatagcacacgtcagtgcgtcactcacagtaaaggtaccacaagggaatgacagctaattttggggtgccttcctcacttgtaagagaggcagcttccacggcagcatttttgagatccctggaaggggagctggtaagggaaggtgcttccagtagcttcatggcagtctcctcctgagagcacaacaggatggttcacactgaggtgaaaccctgacttggtggctaagaatgatcctatagaacccgccccacttagttttcctctgctgggaagtagaatcaaacattgttgtctaagtcatgttacacattcctgcgggatgtgctggagtccagcccgttacagttcatcacccatgcagctttgcgcccatgtctgtagtcagagggcatataaagttatacactggagaaaaaagcaccagatcctaaaggcacatctttccaggcttaaatggagatgggaaatctggaaaatgcaggtgtta

SEQ ID NO: 73127 - DNA, 1074 bp, Homo sapiens
gaacagaaaaccaaacaccgcatgttctcactcataagtgggagatgaacaatgagaacacatggacgcagggaggggaacattacacactggggcctgttggggagtggggagttttggggagtcccctttagtctagagaacaatcctcagatttgttgtggtctttctataacattaagatttttgaagagtctgggacagttatttcacaaatcctcagtttggatttttctggttgtttccttggggttagattcagattagacattgggtgagactagattttgagccttcagagtgagggttcaaggcagaactggaagagctgcggaatggggaccctgccctggacaggggagcctctgtggacagcacatctcagcctggctccggcatgtgaaggactatgtggggtcagtgtgctgtgccaattccagggcattgcagtggagagatgatcaggtcagcggcacagagaagacttggagacagaggcctggagcagctgtcagggactcataggaacccggcaagaggcacagaagagtggtgggggcttggccagagcagcaatatcctcaaaggggatgtgcctgtggatgtgtagggctcgtctatgggttccagaaatacttgggagggacttgctgggtaggaatggaaaggttccttcagttatccctgtaggtgccacagagccaaggaaatctcacctgtcaccacccatgtgtatgtgtgtgttttggggcagacatgagggtgctggtattctctaagatgaaggttcctgtattgttgataatctttgcctgattaaaccctgacagtggggtagaattccaatagttagatgaatatcagggcttacgatctggagaggaggagaaggtactgcttagcaggtgggaaatgaatgaataattgaaagaaaatactgatttttctttccttgattgaagtagaagccattggggtggaaggaggggaagatgaaaatgggcagtttggaattctctcaaactggaagagaggaattgaaaagctactatagtcagggatcttatgtaaact

SEQ ID NO: 73128 - DNA, 1056 bp, Homo sapiens
aggtgtgaggagcaaaggagtcagcatgtggaaagaatggaacacagtgaataggtgcacagtaacggtggctgatgtcattatacagacaattgtctcccctactttaatccatgtgccctggtgggcacacatcacccccgtgtgctgtctgggaaggggttctgtctcagttccagatccacctttctatattctgctctgctgggctgggactctgctgactacacatctcctttgccaatcagggaccctagggggaagccggttggcacaggatgggaggagagacttggcccttctgtttgcctgcctgtgctgtcagcagcatcccagcattgacctttcaccctggaagcagcattggttccagtgcgttgtggtttccagtttcttgcagtactcctggaaccagccccatcacagctgctttgaggtaccagcacgaaccaggcagtgccccctccacaggagtctgagttccagcttctgaggggctcctccttcaagctgctaggagctgacgaccccaggctgcttcctaagtttccctgccccttagagagggtagctacttcttatatccagcactagaggtgtttgctacttcctaataagctttttttactcagggttccccatttgcctctcatatacccctacccccgtttaaccaatttcctataataaatcatctttgttaaaatcgctagtgacgttttgctttctgactgtaccttggcagatactacactctatgtaggttgcttgctttcctgtgtgtacgagaaatggttggtacagccgaataagcgctgaattaaaaccagaaagatgtaagtttgttccttggctcccactttctagctgagaaatcttggccaaaatacttggcttgtttgagagtccaattttcttatttgtgaagtgggattaatcatgtttatcttgtaggaatacatatagttggatgagataatgtctaaaaagcatctggcacctaacaaatatttgaaagatgttggctgtcattatgtatcagaaacaaatctttgc

SEQ ID NO: 73129 - DNA, 1032 bp, Homo sapiens
acccacttccattgcctgttactcagattagtaaatcccagactctgtttagtaaatcaccatggtagcaggaagctgacataataatattcaaagcacataaaagtgcattcactttgaccagaaaagctcccctgtcacatgcaatgcttagcaaaaagaaaaggactacaggctggccctcccagaagcctgatcattctcagtgacttcctcagagaactcctgctgactcctcactcagcgttggccttcttcactgtatactctctgagaacctgttcctttccttcagagcactcatctccattggaattagtgatccactatcatggttattggtttatggctttcatttgactaaaagcagcaagagaatacagactaatccttaataggtcttcagtaaatatgtgtcaaaattttttattaaatccattaggggtcataaaaaatccacatcccttgggactcattaaaccagacacttcttcaccctctaggcaaaaatctgtatgagtttgctagggctactgtaacagatttctacaaacttagtggcttaaaacaacagaaactgactctgtcatagtttcagaagccagaagcctgaaattggggtgtggaggttgattgcttccgaaggctctgagggacgctctgttccaggcctccctcggcttctggaggctcctgggaatccttggtgttccttggcatgtagacatatcacttcagtctctgccttggtcttcttctcctctctgtgtgtctcctcagagatgcccatagaaaaactccgaatctctcacgtgtaacaaatgtttacatgaaaccttctgccgcaacaccatgtcctttcccaccagcaattatccacccacatccttctatctttttttgtggacatccaaggttctctaaaaactggaggcttactcctctcactctcattaagtctctcaacagacatttgttggtcttccctgaagggtaataagatttccccagatggagaagacaaaggcattt

SEQ ID NO: 73130 - DNA, 2026 bp, Homo sapiens
ggcatgtggtagaagctgaagaaatacttgttaaatgaatgaatgaaccatgcagagggtaaagactaatgggcaatgggcaacttctgatgaccttggctgctctgctgacttctccatcaatataaagtcttgagttaatggggcaagggagtggagcaggattaacctgcaaataggatgcagaaaatacaaaggatgtatttcttgggcatctgctatgttctaagtattctgcatgtttctgtgtatttcttacaaatatcctgcaaggtaactgtctttatctccattacgtaagtgtgaattgcccaaagtcacatattcttgtgcaaccatcagttgcagatccaatatttaaaccttaaatccataccttcctgcctatgccaaatgacccctaaacaggtagcatgttctctctgaggacatgttgcccaagctttaatgcaataagttgcagtaatctctgaattttagggggactcttgacttgactaatgcttcttttggtttagtttttgttttaaactggcttgtttctgcacagcaccatttatacaaggaattcacagcactttgtgattaggttccttgaacatgcaacagcattaaagttgttttttatcccatctgtaaatgcagaaaatacagtgcaaggaagtcatgtgacttgtcagagtgtaaaagtgagtcattggtgaagtgtgtacagaaatgaggactgttaagactattttgagaactgacatgaatctaggatgtataatattatgtatctattgttgtagttatggaattgtttaatattttttgcttctttaacttcagtgcttgcaattgtatattccagaatgcaacaaagcaatgccaagaggctttcaatgacagaacacaggcatcagttacaggccgttctgcctggagattagtttctcttatgcgaacagcatgttgagtcacatcagatcttacttactacttttgtttctattaatggctttgcaaactctcaacttgcaagtgtgtctgcatggctaaggatgtttgaaggaatgaacatcagagaattgtaggggagccctctgccctggtccttcctggacctttcctttcacatttaccccctagatgaggtctttcaattgcagatgtaaccacgtcccctcatgttccaatgaggaccaacctgggagcctagatgttctgagacagggtctcccaggcttggaatgcccaactctgttctcgaagttgctggaaggcagcctggacgtaagagaagaaaaaaaaattaagtcaatcatgtgtacaactccacagtggctctgataccgagttcctcaaaatgtgtttcacaagatgtcagttccatgaaccgctctgtgataaacagattccaggtccaaagatctggggaaagttgtgggtgatgtcacccatgcagagacccacagtgtaaatcagcatattggaaatgacaggaggccctgtagaaaagaaacccatctcttttcgtttaagatactgatatcttttggatgtttgtctcctcctaatctcatgctgaaatttggtctgcggcgttggaggtggggccttttgggtcatggggatggatccttcatgaacggcttggtacccatcttgtgggactgagtatgtccttgctcttagttctcatgagctttatttgttaaacagtctggcacctccttcctctgcctctctttccactatgtgatctctgcatggcagctccgcttgccttctgtcacgagtggaaacttcctgcagccctcaccaaaagcagatgctgacactatgcttcttgtacagcctgaagcactgtgagccaaatacacctcttttctctataaatcacccaggctgagatattcctttagagcaatgcaaaaggactaagatagatagtttttctaaaattttcttgaatgtggaactctactccccctcccccatcacatctctgaatatcccaggaaaatactgaccactgagggaa

SEQ ID NO: 73131 - DNA, 1014 bp, Homo sapiens
ggctggtcttgaagttttgtcctcaaacaaagctcccaccttaacctcctaaaatgctaggattacaggcatgagccaccatgctctgcctactaaatttttaaccatagaataactttgataagggtagcaacaggaacagatttggttcttaaaggaacactctggcagcactgaagatgatagattctgtgtttagtcttcagaagcattcattttgattgttgaaacatagcccatcgtgtttaaatattatttgtgactaattatttccttattgtggatagttaggtaatgttaggtattttgctattgaatagtattctgaataaacgtcttcatgcacagaatgggtttgtttctgctgaattgcttccttaaaatgagtttctaggattgagatcactgagtcattgttcttaaaatttttatgcttttttggagccaagtgttgtctgactgcctaaagattgtaccaatcaataacagcatttatattattaattatttttcatagatcagaaaagagaagctcagattagtgaattagctaacacaggtaggaaaatacacagctgtgctttggaactgtgtcctggacccatccttagtctagtggtcctttctctcctgcttgcctctgttaatcaaattgtttcttctagtcacacttggatctacatgagaacccgtcctctgtgccacggaccctgctagatccgaggactacaaaagaagaaaatgcagttctttttttcgaggaccttatggtctagggaccttccccatttccctcctctctgcctcactggcatggagaaaatctcaagtgaacagactgaatgacaaaaggaaggaaagaaaaagtgttaaagccatatgccaggctatggcttggataataattttgactcagcttccaggaccatgctgagaatagcgagcaaattgcatcccatgttgtgccagcatttggctgggtcagccagccacttgggtgaaggcctggaatta

SEQ ID NO: 73132 - DNA, 1144 bp, Homo sapiens
aaataagtcacttaccacaggcaaccagggtgcccatttgggactgggtgatgttcgtcgtgatgggactaattaactctggaaatgctgaacaggtcatggttaagacccttttgaaatgattggtgccaggcttttcctgggcattagtccctgtcctccccagatccctcactccagctactgcaggatgcaattgaccaatggccagagagacacagctgacgccacgctgaagtgctgaaagcagacagcgctgtcattcatctctcttctgctcccggggcaaggggtggtgacagcttcttgttcttctcaggtgccaccaacccccttttgatcttcagtctggttaaactaaaaaaatgttttaaatgactccatctactgagaatttcaatgttggctctattacattccttaatttacgcttgttaattttgtctgacttggcttgcttagattcctttggacatatgatccttatgaataaaacattcaagggccaaatgtttgagtgggacatcttgacgtgaatattcctggagagtggcagaaagcgtggatcagggcaggtgcctctgtcccagagtgagacctagaaacagctgtggtgtgctggaaggaatcctcaaacctggagtctgacgatgtttaaaggctgattctgccactaatgagctacttgatcaggcggattgcttcccctcagtttctttaggagacggtgtgctgtgtagtactagcactctcattttgctgtctctgggggaagattatgcatccttgtcgcattgtactaggtgtggccatgtgatttctggcacccctccctcctgctggcgaaggactatatatccctgccctattgacgtcaggcttggctgtgagatttactttggctggcaaaagtgagtatgaggaattgtgccactattgtatagatgctttaagagacattgtggttctgctatctccatttctctctgttactgagtcctggagcaaagaaggcatggacaagggctgtagctgacccatcatacatgtgtgacatgagtgagaaacaaacctttgttgaggcaaatgcttagatttttggggttgtacattgttgtagcatcgcttagtttaaacacattaa

SEQ ID NO: 73133 - DNA, 1050 bp, Homo sapiens
caaggtaaataatgaatccagcctgcccaggatatatcaggttgcatagtgtgatgaaacacataccatcctgaatgttcttccaaaagaacatgtacagaaaatgctgtccttctgccagaatacaggctccttgccaacccccaccactctccaccttgagaccaaacactcagcaagctgaagcttgcaggccacggtgactggctccatgctgccttgggaagccctacatgacctctacatggtccttcttcagtatgtgaagtacagaggcaacaccaggacattttgaagggcaaaagaaggttcaatggggcaatttccaaggcatcttgctccactgctggtaagcaattagcaggctttctacagggacttctcaaaagaggatccagaaggcaggctcagcattgcagcctggctgcaggccacagtgtggcagacgcatgtattcatgggcatgtcaaatacatcacttcaatacgaaattcataggcccaacattcatctgcgagattgaacactgggtagctcaaaagctagtcttctgaaagcatcctacaaaacacccgaagttgccgttccagaattgctataatttcacgactgtgcaagctgtactagtagtacacaggcaaagggatagaaaaaagattatattaatgctcaagggggaaaagcaagattataaaggacttagcagagctatgttctgataataaaccaagagcatttaggacccaacctagaaaaaaatggatttacagccgaagtctttcctgtttggggctacagcatcattctgtcattctaaccacatttatcctgaacctccccccaccacccgctgcccatgtgctggccaccgtgctgggatcaacaaaactgaatgagacacaggacctgatactggggagctgaccatctagcaggtgacgtatggatggatgaagcatcttaggacatctaaagaaagagatcactcctccatactggtaagtccacagacagctttacggagacatttgagtaaagtcctaaaaaggg

SEQ ID NO: 73134 - DNA, 1066 bp, Homo sapiens
ggatctgttaccccgtacagttaagtggaaatccagctgaagcctggagtttggctgggaaagcttgcagatttgatgaatcaattccttttagccaaagaaactatattggtttgattaactaagcaaaaagctagatctgtaatcatcacaccagaattcttgcaaaaccaagcagtattacggcagagaaactctaggaccaaactcaactctactcagagctttatacacaagtctaagcataactcaactctactcagagctttatacacaagacctaagtaatccttaaaattctctcatttaggaattatatcactcagttgtgattaggcagcaaaatgccaagatgccatcaaattggaaccattttgtcacattgatttatgttttccctatttttactgaggaaaaaaaaatggctgcccgggttgacattgagaagcaacttataattgatgttaaggcatgcagggttttatatccctaagagatcaattcttccttctcaagggatcagacctgctaactgacacagtgaaaaataactagtcatgtggctctttttcatgaactaaaaaaccggagttcagttgtcagatctcagttgacagcttatctgattacaaaagtaagaagaaaacaagaactaatttctaaggctgttgtatctattaggttctgtagactcagtgtctgccacctcaagttcttcaagaaaactagaaaatgtttgggacccaaaacaaaaattattagctccaaaataaaagaagaaaatggaaaaattgggaaaacattgtttaaatacctagaaaaggtaccagtcacctgccattcaactcaatgttcagagctacatttaaattatatttaatgtacagtatgagttcattttaatatgctctgatatgtcatggggtggcccccaagaaactctcatagtgccttgcacctataagagtttttaaatggcccagctaaatttgtaatgaaaggtttccagaccaagccacaatcaatgtttgctttgcattggttggggggattttggttaatgtta

SEQ ID NO: 73135 - DNA, 1052 bp, Homo sapiens
ctcaggaggctgaggcaggagaatcgcttgaacctgggaggtggaggttgccgtgggccgagattgcgccactgcactccagcctgtcaatagaacgagactctgtctcaaaaaaaaaaaaacaaaaaaaacgcaaacctccagagaggtggagctaacatactcaatccctaggaaactgctggagaccaggagagttctaaaagatgcttgttagcaaatgtcccaatttacccaagagggaaagatacaggtcctgctgcatgggctggtaagccaggcaaaagtttaggccatataatagttttttaaaccctccaaaaaggaagagatgggttttgagagttggcatgggtttgagaaaaataagccacgccaaatgactctactggctttttcccttataggctgcctaagggggcagactggagaaggccacagttactgtgtatcttgaagcctatatatatctttatctacttagacccttgacaatacaggtggcatggtcacggggctcagggatgcctgagagtaggctttggccattctgagcaccttatattcttgagcccagcacattctctgaagccaccatgccaccgccacatagtgttcccatgcagaatcaccttcctcacaccctttgtctggctgtttgttcttcaagactccgctcaaacagcacctccccttggaaactttctcttctgctgagtatgatttagaagttccttatccatgccagccaagcaccctgtaaactctgctgtcactatcgcagtgcgctttccctgggctgcaactgacagcttccttatctgcctctcccaatgcctgcaagtacccaaacaggattgtatttccaaagcccggcacagtgccaggcacagaggggaccctcaagacatgatgattgcttgaatgagttttgcttagaggctcaaagtcaacctgaaagaggttgtctctgattgtgttctgtgggtttctccaagtctagacttttatcagtgacttggaagaataatatattttcagggaccataaca

SEQ ID NO: 73136 - DNA, 1033 bp, Homo sapiens
aaaagtctacaggacccctttcttatagacagttgtgggtcactgccatcacttgcctcctgcttctcagcttctctcctgtggcttcctcctcctctgcatgtgcctttcatgcctgccatcctagtaagagcaagataatgaaaaggaaggaatgaggactgggagagtagtgaggggacacagtccaggcacccagagacccctggcataaacacgcactcagggaatgccacccctcactgcaaagccagatgggagcaacagacctcccggggctgccccacgccccccagatctgagcgcacccaagccctgttctgtcttaggcacttggtggaaacctctaatacattgtcctggtgagagggagtttggggaggttatctaaatacatccttttcagaataagcaaatttctactttccatgattgcaaaagttgtcttaggcaagggactgctttgaaaactgaccaactggcactcagaataggaggcctctgaagggaggatagtttcaggatctgccagatgtcagttttgagcctagattcacttttgtcagctgaatgaccttggacaaggtatttactcttggtattgattcccttatcaagaaaatggggataatgagcagccctcccaaggtgtcctggcattgagcagctctggggatctaagtacaggcccatagcaagcccaaagcctgcagctacagtcaccaccacctctgtccttgtagccctcatgggaaacaggggcaccacgggaccatcggttgtgctgtggggtgcttcaactcccacatgcctttcatccttcccggctgcatgttcagttgcagactcgacctctcacactggtctcaatctatcagcaagccatgagccctgcctcttcactccacggatgagtgggagcagtgtaagtgataacactttggatgcatgaggctgttttcccatgtgataaagcgtcaagtcttccccacagagggagaaggaacaccaatatgcagaccacaatcaatga

SEQ ID NO: 73137 - DNA, 1017 bp, Homo sapiens
gaggccgaggcgggtggatcgtgagatcaagagattgacaccatcctggccaacatagtgaaaccccgtctctattaaaaatacaaaaaaaattagctgggcatggtggtgcgctcctgtagtcccagctactcaggaggctaaggctggagaatcgcttgaacccggaagacagaggttgcagtaagccgagatcgtgccactgctctctaggctggtgacagagtgagactctgtctcaaaaaaaaaaaaaaaaagccctgtggtgagagcaggagagcagggagcttttgaaaacatgagggagtaccccaagcaaggagaagagtgatacaaggtgagtctgacaggtctggacagggaccatgatgtgcaggtcatgaaggcctcatcagggattgggcaacgggaagcttttgatgtgcagtaaacacgggagtgacaatatattatttgcttttattgaaaggataattctagctacagtatggagaaaggatggaagaagagcaagagtcgagcactgggagggcctcactggggtcttggggaggatgatggtaacttggactagggtggcttctgaggaatggaaagaagggtgcataatcacaagattcccaggtaaaatccacaggtcttggttatcaattggaggtgtcaggaaggactgtggtgttttgagtctacatccaagatggaagataatgatgccagttttagcagtgggacgagatcatgagaaggtcctgttgagtccgaggtacctctgagccacccagctgtagatatcaactagatagtggaaggtgtgctggagctcagagaagtcagggctggagatacacatttgtgcatcatcaacagctaggtggcaattcaaactgtgggctgggaggcattgcctaagaagaaagaacgtaaggagaagaaagccagtgacgttcattgcagaatgtcagcgcttatgtttaatggtcaagtggattgtttcctctaaaacaagtttagaggaaa

SEQ ID NO: 73138 - DNA, 1841 bp, Homo sapiens
ccctaggaaaccagccattcaagtttcatcatctggcatcaatgagcacatcctatgtgtcagacactgcgcttcaaggatagaaagagaaatgatggacagggccttggggaatcgttcttggacagctgggttttaagagtagacaaacatgaatgcattttttggctttttttccccgtaaaaacactgtacccatcatcactacctttctaaattggagataccaacatatttcaatgctaacttttcatgagtgttcagtgtcaccataatgaaaaccagtaactgatgagacgtgctgtgatctcattacagaggaggctgcgtgtgatctgacactgaaatgcttctggtcagctgcacttctgggctcccatttctgcttctgatcattttttgggtctctttcttctcatctctggtcacatctcttgtattactacaccaatctgcagtgggtcctgtactattattttgttgccgtagactaagctgaaaacagaaactgttagaattacgagtcaaatcagagtcaatcagctccatgtgagtgtcagggactcatctgtagatatggtgaaggtgttggtccaacaacttgtgatatttaattctggatgtgctcagatattttcttagctaagtttgggttcttgggtgggtctttttttttttttttttttttgagacggagtcttcctctgtcgcccaggttggagtgcagtggtgcgatctcggctcactgcaagctccgcctccccggttcacgccattctcctgcctcaggctcccgagtagctgggactacaggtgcccgctaccatgcccggctaattttttgtatttttagtagagacgggatttcaccgtgttagccagaatggtctcgatctcctgacctcgtgatccacccacctcagcctcccaaagtcctgggattataggcgtgagccaccgtgcccggccttgggtgggtcttaacaggagcagttggaagagaaagtaccctacaacaatttataagcttgcagaaatatctgatgtttctttcctccccaccaaggctcacaaggagtaaaaattaaataaacattctgtattctggctcaataggaatgtcaggaggcagctgtatattcaacattaggaaaaaaaagattacttctaccatgcctcagactttgttcttgtgatcagggaactatcgctaatcctgacgaacaagttgactttagagcagaaagttaggatcagatggaattgggttgaatatcagctctttgctgaaaagctgtgtgactggacaaataattaatctcttagaggctgcttcctgttctgtaaaatgaggatcatggcctttgcagggctgtcacagggattaaaccatatgacatataggaagggtcctcacacatggaggactcactgcctggtagctactgctatcatcactgttactatgactacaacaactgctgcttctccctgtcccagcatgcagaccagtgcttagcactatctgccagcctacaaagctgtgaactttgggaaattactacacagttctgagccctgctttctctacctataaaactgtggataataggtacctcaaaggatggcaaggaataaatacgatgacataagtagatgctcaaaaatattacttctcgcttactcttgcccttagacaaaaacttatcagcaggatgtaagtcaacaaataggaaaccatctgtgtcttagtccatgtagcccccatattaagttaattcataacttcaaaagttcgaggtaataataagaaaccatgcaattctttttgaaggaactgt

SEQ ID NO: 73139 - DNA, 1024 bp, Homo sapiens
cttcctcccccatggtattttaaacttaaataacacagtctccattgtgtaaagcaaaataattttccagattccctgtgtacctcagtgcaccatgcttagggaatctgcccggcaacacagacagactgtgggagtatgccgcggaggctgcgtcccccgcttgctggttagggtgctcctgtgtgcccagccttccaggtctggcctccccccagccccccagccagcccccaacacaaatcatttgggctttatcttatctttagcaggagaatgcttcccagatgtgtaggattaatggtgaatattacacagcaccccctggacagagatgggtcctgggtgactccaggccctaaaaacctttctccagcgtggactagcggggagctccagtccccacctgagagttgaaggagcatcccctccctgctttgcgatggctccagagacaagacgtgtgccctgcccccaccccacattgtctactttgatttacagcacagccatcacagggggacctttttggttaacatttacaaaagtgctttctgtctggtttctagatggagactgacaggatcctggcttgggggccttccggcagggctggctgctgggctggcaggctctggcgctccccttccccagaactgactttgttcctggcagccatggtggctgcactaaccacattctgcctccacctttgcactaagaaaagcaaataagcagaccacagaactgtttgcatttgccccagatgctccctggctgcgggaagaggtcagtagggagcatgcagggagaggggaagggagaccagcttctgcagggagggcacgctggaatctaggcttggggagggacgaagggaaggcttgtccagcccagcacaagcctgcggaggggcactgtgggcacagtgcatgaagtctgaagaggtgatgtgctagataccccaatccctggcatattctgcatttcaaaacagagaataagtagtcttgccactataaag

SEQ ID NO: 73140 - DNA, 1053 bp, Homo sapiens
tagtgtctaggaaccacagaccctgagagccagccgcgcccataagggttcaggatgagcctgaagtggaggctaatcaggtgagcttgcctcaggcctcctggagcacttccctgtgtccttgctggcaccagcagcttctctttagcaaacacatttcttagtgccctggttatgtgcagggttagactgaatgcacaacacaggcccatccgcatcgccaggtctctgtgacccacttgcggttggatattctctcaatgcttcaaactcagccgaagtctgtgatcttgtccacctcaaaaatcgtatgattctattttaaaaactgagttacgtatgttcgctaaaatggaatctcccctcttaattcattccctgtcattcttctgatatctaaaccgtaaggtcaagttaaaagggtagaagatgatcatagatatatagctgtgattctgagtcaaattcccaaaccctgtcatcacctccctgcaaggttcttgagagagaaaaatgcaaaaaaggtaaggctcagtaggtgggcttgtggccaggtgggggcactgggctcaaatttccaaggggagccctggcaagctgggcagacactcccatttccttgtttcctcatcatccttcaaattcatatgagcacctacaatctttcaagcataggggagagaacagtgaacaaaacagagcccctgtgctcctgaagcttatattctagttggggaaacagaaaataaataaataaagatatatataccagcataggagatggtggttagtgctgtgcagaaatctgctacggcacgtggtgggcagaatgtgtgtgtgtgtgagcgtgcgcacgtgcatgtacatgctttactatagttagtggtgtcagtgagggctttttgaggagtgacatttgaagaaagagctgagtgaatttgagtcatggaaatattgaggggaaaagcatcgggtgaaaggaagagcatgtgcaaaggccctttggtctcacgccggggggtggaggcaggcttcgggccttatcatagaggt

SEQ ID NO: 73141 - DNA, 1440 bp, Homo sapiens
ctgatttgctaccctgtaccagagaaggacggcactgttctgagatcctactaggaccacgtggagggagggaagcagggaaggcagctcttcaaaggaaaggatgcttggagacagaacactggacttctttcttgcgagccttccccaacctccccaggagtcaagcgcttcctcctgggtgcttccggaagtcgtcattaatacctctcttccagcatgagttatggcaccactgtggtttttctgatgatgtgccttctcatccatccaattcaagttcccagcaggcagtgattttgtctgtctgccctccatatccaccctccaccctttccccactgctctcccatgtggatggcaccctggtgtcctgtgccctctggcttctgggggcatttggccaatgcggctcaccatcagcaggagatgagagctgagctcttggtctctctggcagcttccctacagggttcctgtgagctggtggcctcctgactaaaggcgacagcctctctgtcaggaagtcccccacatagcttcaggttctggaagcagctcccttccctcagccttgcccaccttgttctgctgttcgtggccctggagtctgcactatctccttagggttccctatactctgcccacactgaatcaatatgtcctttattaaactcttctcctacgacccaatcggggtgtgccctccaccaccctggttcctgcctggactgtggcacacagtgtcctgttcatcttcattgccccaggatccagctcagtgccttccacaccacaggtactgaataagctcatggattatggaatgattaaacatcagctcgatatggcagtattgagacctatatagaaaatggatcagagtagccgccttcaaaatttttttgaccaggtctcatagtaagaaatatttcataatgcaatgcagtaaacacatcataatcatatataactgaacaagaaatttcatgaaggaagactgagttttctatgtgcaatgccctgtggtcttttctatttcattctgctctatttcaattttcaaatgaaattcttattatggtccgctgcattgttttcacagcatgtgaaatgatagcaacccacaggttaggaagcacgagcctagtgatgtttagctttccctctaggttggagaatctgtgattgctgaagtagaattcgcaggcacaatgaatgaggatgcagtaatgtcgcagtgacgatgcatttagtgggagttgactttattgccttgaaaaagcaaaggagggcaggcgagggggctcatgcctgtagtctcagcactttgagaggctgaggcaggcagatcacttgaggtcaggagttcaagaccagtctggccaacatggcaaaaccccatcactgccaaaaatacaaaaaaattagccaagtgtg

SEQ ID NO: 73142 - DNA, 1079 bp, Homo sapiens
taaggactactgggctcattgggcccctccacactccagagctctcacttcctccttctcacgtggaggaagcagaggtggcagcaggaggacccaggtgactcctgcagggaacacaggctcatctcgctaaaactgtagccttctggaattcgctaactgtacatgtttgaaattcctgatgctcttcttcggccttacaaacctttcctttcagaggctgatcacatctcagttgtaaataatatttagcgtacctttgtgccttcactacacaaatctccagtgattgttttcatcagacagagcaaaccatgtgtagctccctcctggaccgttgggcccctctgccccaccatcaacaggcagattccaatcattcttcccactgtggctgagggacgcccttcgggtgaggatgaggggagggactgatgtcctgggctctgtggaggccccattcgggtgatgctggaggcagaagggggctttgatgagggaggagttggtcaggaatgcttgtcacgggcacagcaatgagtagcccatgcaggctgagagccctgcagaaatgggccggcccagtgtgtgcagagctgatcggtagggctttatgcctgtgctagtcagggttctccagagaaacagaaccaatgggatacatatacatatactgtacatatacatatacatatgcacgtatacacatatacacatatatacatatactatacaaatacatatacaaatacatatacatatactatatacaaatacttacacatatacatatactatactatacatatacaaatacatatacatatgcatatgtaagaggggaatataagaggggatctattatgggagttggctcatgtgattatagaggctgagaagtcccacgatctgctgtctgcaagctggaggaccacagaagctggtggggtaattcagcacgagtctgaaggcctgaaaacccagcgctctgacatccaaagtcaggagaagatggataaatcatctcaagcagagagagcgaactcttccttcctctgtctttgttctactctttgttc

SEQ ID NO: 73143 - DNA, 2272 bp, Homo sapiens
ggtttctgtgatgtcagcttaatcacgaaaagaggggggcggggtggagggaagaaaatgcggcaacatgttcggtaggaactggctgcagccggtgctgaaggaggcggctccgggcgagcgcggggcggggcctgggggcggggacgcggtgggcgcgctgtggcttggacgtccccgctgctggtctcagtcggggacccagcgcccggctctggcccagtctcaggaagccttacttgggcgtttctggccaacgtctgcagagaagcacagacttttacaaagcttgatcatttatacgttaaactcaagtattgtacagtcatgtttgtattcagatttccccaagtgtcattgaaccaactttaaaggtggaatatgtaaatagttagggagatccatgtaaaataatgtcttggaaactcaaaagagtccagaaaataccaaataatgagttaaaccttttctgtcttctttccaggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctg

SEQ ID NO: 73144 - DNA, 1116 bp, Homo sapiens
cgaagcaatggcccagtgttttgaggccgccgtggaaacctccgaacccagcaccccactccctctgagcacggcccgcgccaggccagcccaccccacgagcgggatctggagaatgggggcggaggtgggggtggggggaggcggggaagcagggaagcgggaggacctggaagggagtagggggcggtcccagtggcgtgccggccaatcggcgcagctctttcctgcatatattttgcactaagactgggagtcctggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataataggtaaatgtcggctaagatagtttctttaaatttattcgtgggatacttataataatacaggtgaaagatagccaggcgaattcctttgtccattgctgagagattatggtgacatggatgttgtttttcgaaatgttaaaaaaccttatttttgcaagtctggccagagaacaggctttccccacattatgtaatttagtcctttgtggcttactaaaatagggagatgcctggatattcgttagtaagagaggggctggcattttctggagggtgatacattacatagtgttaaataacattcaaaatatgatgctagcaatatcacaaaattgggagatcctttttatcttggaagcttaagataaattccatttatcgatgacctttttccctcctctttttcagctcctctggtgcaagtgtggtagctattgacaacaaaatcgagcaagctatggtatgtactgatgaaaaatcatttatactaaatgtgggca

SEQ ID NO: 73145 - DNA, 1098 bp, Homo sapiens
gggggtaaaaggaaggaaataatgagggccaaaaccaaggagcaaaggggagacagagagaaaagtgggatggattcaaagacattgcaacatagaactgaccgaactggcttgtgtgaggtaagggaggcaggatgactcacaggtttctggattatgtgaacaggtggaaggtgatgccattagccagaataaggctgtaggctaaggggagtaaactggttctggggtataacattgataggccttactaggcagtgggaaatacggttttggaactcaggtggggttgggcataagaaaatactggcataagaaaagttgttaggttagcagtaagtctccttgggagtggatgagattacctcagaaatccatataggcaagagatggtggagctgggcggccacacacactggggcagccgtttggcatagcaaagacacctgagttttctgtggatctagtggacactacagaaggtggctaggcttgaggcacttgcaagaaccttgaatgggagagtagcctctacccaacaaggagaccaagacagagaaagtgatttaactgtggagggagcggggaaatgaagagatcaggtcagctctccaatgccaggcaccctaaggtgccagcaaagagccagcaactgcgtcctttgagaaagctcatgtggatggcagcctcacgaaatgagccaatggacagtccgttagacagaaacagacagacggcagctgcaaccgtgacagaagcgggacactgcaacagtcagcacagagactctgcccctcggttcttccttcccacctccatgctagcgcactgctactgccaagagggagggacgcgtgtgagagccaaaaacagcctccactccaaggcgccagtaacagactgggttctttttttccttttcagggaaagagtgggcagagaagagagagctttgattctgacatgagagtcaaatttcaaaatgcaaagaacgaagtgtttaaaaaatggtaagtgactgtttaaatgaccaaaattaactggaaagcgatggaaatgggtcgacatgctagtaaggaagcctgctaccagagtgaa

SEQ ID NO: 73146 - DNA, 1170 bp, Homo sapiens
tcagcgagaccaacaacccacgggaaggaaccaattccagatacaattgctcagttattcagttgagtaagattgggtctgtcttatacagacttatgttgtctgcaccttgtactttttgagtattgagttctttactgcatatcaatggtctttggactttctttacggcttgctcaggtttcaacttgatgaattaccgtcttttttccagctttgaaaaactattgaaattgacgtctcttttatatttactctatccttatgcatttaaaactgggttctcatctctttagtggtgtgaggtagaaataaagataaatgagtgtgttcggtgcaccatgcttagtcagaagtagctttaaaaggctctgtaatagattccctatgcgattaattctcatggcttcttgaaactatccaaagcaagactcaaaaaagagctatcattgcatatctagtgcttaaattttgtagacagatgattctacaggaggacctgacttatttgtacttccagacagggaaagtttttattggaaagtgaaaagcatcccaaaataattcttgaagaaactagtttagaatataaagtggcatgtaatacctattgctattaagtgcagaacagtgtttcttaaatgcaccgtgtaccataatgatggtctcagtaagcatgtttctttaaaaaagagtctttcagaaaaccaagatagcaaaagtgagagagatctcttgtatcatacattggttactgcgcagtcctatgatgcatcatgctgtcttgactttgttgggtctcttgaatacagcatttccccttgctgttctccctgctggaagagttcttccatgactaatcccatcatctctcttaggtctttactcaaaactcattttctcagggagtccttctttgaaagctagctaaaatttcatcctctctgatctttcatatccctgcttctgttctttaatttgtctcctgggtacttgtccttatctcacatactgtatatgtacttatttgtcttgtttactttttcagccccagttgaatgtaagtttcaggaagacagagacttttgtccattttgttcatactgaatcccctgtgcctagaacagttcctgacacaaaatgggtgctcaatatatatttgttgaattt

SEQ ID NO: 73147 - DNA, 1049 bp, Homo sapiens
ggagtggggagagaccagagagcaggatcgggcccttccaagcctgtgggggaagtggggcttcctgggtccccgagagcacagggatgcccaggtctggaggtacggctgggcagctgcagctgtgcctgggagtgcaggcttctgtcctgctaacttggtagggggtggggctcccgcctgttcctggcccttgctgtctctctggagcctgcaatgcccgccgcgcctccccagctgcagccagcgtctttgcagtggctgctctagatgggctgctgttgccatcattatgaaatatgtattatcacttccattttactatgaataagtgatttttggaaatttgaattaggctctaactccagtgctcaaaatctgactctttaaaaagctgcactaaagtcagtactgatgaagatgttttataattgcatttatggacttaaatggctaaaacaacatcatagatgctttcaaaggttgtttggaaatgatgctttagttggaattaaaaaggaaaaggatcatactattaagagaacattaagaatttttgctgatagaatcacagtgagaaattaggaggatcagatttgatagaatatagtgactggaaaggcttcaaagatttcacctatctgtttcaaaagtgaaagtagatcctagaacttgttctacttttatatgagcagactttgaaatccttggaaacttagttttctaattctgtccaagaatatgaaacagtgtcagttgacagatctgatgtatgtgtaatagataactatttcatcagaattgaaagtttgacccaatatatagccaccttcttcagttagcttctgtatcactgctggaaattctttttgcagttttcttaggtgagctctctgcttcaccctacaaccgaaggctttggaaatcatagagatttttgaaactactaaaccagccactgctagcacaaaaggagcaaattctgcaggatttagcgatttcctttttatataaatagtgctttctctttgattctgagaaaaagtatt

SEQ ID NO: 73148 - DNA, 1010 bp, Homo sapiens
taatggagaacttttataagagctccagagaagccacaggaaataactgataaattagctccacctgaaatggatattagggcatcgtcaattgactcttctcagttctgcttggtagtagaacttttttttaaacttcatagtagacgagtaagtggaactttcatgacttaaatagatagataaatttcactagcttgtacttctaggattgggtacattttcctcttggcatggtactatgtgttttcaagtaaaaataatacaattcaagtctgacaaactggctcagtgaattatacaagattcgtgctttaaaacacagtctacaccctccctgttgctttggggcagagtttttgagtaattggacatctaaaactaactctgaacttcaagattaccagaaagatcagatgcaagagcttaatttgtgttaagaacatcctcctacatattctgccaaaagtttaagagctattagtaaaagcagctcatttgaagtagtatgagatttgaacatttaactccaagatagctagaattttattaaaacggatttaaagaattagcccacaatttaaatacttttctcattttaaatgtggcttaagatgtatttgtctttatgaaggaattttggattaaaaactgtactgtagttgaatttaggaaagggaagccggagatgggtaggcggtgggtacttatagatcttgaatgcctggttataaagattgggggcttaccctgtaggtaccctgtaatcattaacagacttgtaattgcatgggtgacaggcaggaaatgttttaagaaaattagcctgaaagcgcagggtgcatttgcttggatccagctggagagagattggagccagatggaccagttgagatgatatggcaatcaataatctggaagttttatgatataaatctgaattagtgtgatgtcagtaggaatacagaaagaatttaaaagcctttaagatattattagggcagaattga

SEQ ID NO: 73149 - DNA, 1047 bp, Homo sapiens
cctccctttcttcatctcctctccctccttcttccctccattcttatttttaacccttccttcatcctttctcttcctcttctccttccttccattcttgcatccttattgttttttcacctctgacataagtgtgtcaaaagtggggaaaaccctcactagattttcctgattttgggatcaagacgaaatgatctgtagaggtcttatgttattaacttgttgcactctaagaaaacctaaagaaaatcacccatgccttttaaaatgcttgaaacataacaaatcactatattcatagtatttttgttctctttgaagtaatgagtcatcataaataaattggaccactgcccctttaagtagaaactgccttaggggacagatggaattttgggactacttcctgaagcacttgtttgtccaccaggagtgtcagttgggcctgggtgggaagagaggcccaagaaagccaccatagtctgtagcgtgaagcttttcctatagtctagtgataatcctgctgtgagtacctcactgtaattcaaataattgtggaaggaattgtctctcagttgtcctaagtcctgcctagtaccttgaaaagcagttggtttctaaatactcagcttggagggtgaaataaggttcagttcagccattttagttctttgctttgtttttcccagctggaaaaattttaaagctattttaaaaatcacttggaggattatttggagatcatgatagaaattttttactggttaactgagatgaattgtatagtccttttttagcttaagatctttaaacatttagttgcataacagctttttaatttgttggactcctcagttgaagccattacaaattggcttaaaattgtaaaagattgagtattatattgagcctttctatcagaaaacattagcttaattagtctataattaaagatgatgttagctgtactttagtttgtcttaggaatagaggtcctcaaattatatgtaaaccatcagttgcatggttcttttgaaatgtggattt

SEQ ID NO: 73150 - DNA, 1038 bp, Homo sapiens
aattactaactatagaaaacagccatcataaaatttccctttgactcataattgtctatgatttttaaattaaaggttgacttcaagtataagatttatttttcataattcaagtgtcagatcatgcagtttatgggcactcttgataactttctttttttaaaatagagcacatcatccctgtttttgtatattgatattttttattagataataatcaacaaaaagaaaaaaatcacttcattattctgtttatttcaagttacaaataatttatataattgttgactgatacagtattaatgattctgttttataataaacataatgtatttttatatttaaattcctggacacaacacaagtttccctacagtttgtatatagcttatataactattaaagtagaaagttggatagactgggagtaatacttaatttatgtatatgtcaataatcacatctcagctaatatttgaaaactccatatcccttaagatgtaaacagttttcattagaatattagtttttattaattataatccatgtagcccccacctaatgtgggataccagtgcctcttccaaatattttttggagtccccagagtatattatatggttcatgcagagctctgggtgtcaaccacatggcattaattttaatttttttcttctggccatgtactaaggttttgtcattttcactggagactgccacttttgttgggctttgttgttgatctttcctttggccattgcagggactggctgagctgggtcacttagtgctttgtaggactttttggtggagctatctagtctgggagttttatttgaggaaatatttttcactattatattgatttaattttatatgatggcaatataggactattcagactttatatctctttgtttcagtaagttatattttttctatttgaccatttaatctatatctcttaaattatggttacatatttttttcgttcctgatactgcttatttctgccttctctttttttcttgattaaat

SEQ ID NO: 73151 - DNA, 1064 bp, Homo sapiens
gattaaaatttgctgttgatgttgatatgtgaaactttaatgcattgtagattgtggtaatccgatgtttcaactttaagtatttgacatcatttggggtgttagttttatgattttcaagaaatgaaaaacattatcattggggcagacatttcattcaaattacttctatcagtttgcttgaaaattttttttttttttttttttttgagacagtctccctctgtcacccaggctggagtgcagtggtacgatcactgctcactgcaacctccacctcccaggctcaggtgatcctcccacctcagcctctcaaatagctgggaacacaggcgcaagccaccacgtccacctaatttttctatttcttgtagagacagggtttcatcatgtttcccaggctgttcttgaactcctgtgattctcttgccttggcctctcaaagtgctgggattacaggcatgagctactgggcccacccagtgacttttaagagagtcacttgagacttttaagagagacttaagaatgctctaaaactagactacaggtgaaatgtagagtgatatttggtttccggggaggggcgggtggggaaggaagaaatattcattaaatacaggcttgctttttctggcttcaagtcaagtcaagtagttttttttttttttttcatttgtacattttacaggggctttgatgggtctgacaaagaagcacttgcaatgttttggggtttctgttatgaaattaacacatagctcaaattcccattaagtaatcatgacttaaaatagagtccagctatatagtcttgcatatttcagagttaagaatgtaatctttatcttttattgttaatattctctaaggtttatttactgtattattttgtcatgagtttatttaaaatattttttaatattaaagtattttaagtatttctagttgtaataaaaatgtagatatattcaagaaattataaaattaggttttgtaattgatcggtattcaagtaaaaggaggaaagctatcaagtagtcatgatgaaatattcatcaaat

SEQ ID NO: 73152 - DNA, 1090 bp, Homo sapiens
gaggacagagccaaagattcgggagaatgaatgcaaacatggggagttggggaagcaaaactgaagggattgaggcaagagtgaaaattctttgaagtcttgggaatcttctacttcatttcttaatgcggttttgttttcatatgaaatactttacctaatgaataaaattgacattacagcaagctgtaaattttgtttatattgcagcttcatctattttcagtatcttcttcagtctgaggggttgcaattctatagtattttgtgtactttaaatccatctcctgtgttagctatagggggctagcatcaatacatacatattagtctttgcacattaaaaaaaaaaagtaaagtaagatatttgctttgcaaaactttgaaaacatctccttagtttgaaaacatcttccttagtccttcagtataatgtattactctgacgccttctcagacctccctaatcttggcctttcgctcctttttgagccttcctcattttgaaccttgcgctactgtagcaacgttattcttacctctgctgcttttatctcctttcttggctgttaacccttcctcccataaggtacctgtaggtataaaaggttatctccttagttctgttcctttctgtctacttactcctgaagcatttgctgtagttcttaaagtctaaactctgcaattgactccaaatctttatcttcaacctgggcctctttcccattgccctgtgctgagatagctgccttatatttatatgtgctccctctcctcagtttatagcttctattgatgattgtcccaattttccagtactccaggctaaaagcctaggacctttgactccattttctcatgcctctgacatgcttgttcctgagtccccagatacacagcaggcactgtgtacacattcatcccattgtgaaatctcagattctgtagtgtcttgcctttttgttcttctcctctctatccccattatcaccactgtagtccaggctgtatgacctctttaaattatctgtggagacaccttactggtcacccagtgtccaagcccacttccatcttttccatactc

SEQ ID NO: 73153 - DNA, 1007 bp, Homo sapiens
gatgttgatggtgggagctgtcatcttaagtgataattaaagctgtgagaataaatgcgattgccctgaaaatgtgtgtagaatgagaatgagaaaagcagaaggttgaaggtacaacttttgggagcattggcatttaaaggggatggaagatcctaattctgccctttgcttgggtagctcctgtttatctaaattgctctccaagctcttcacttaaccaaatataatcaggccctccttcagtgtctgaattaaaacttaccttcatgaatccatttctactacttcctctaaagattgttttaaaaagcattcattggtggcagcatttaaaaaaaatcataaattctacttcagagattcccaggttttttggcttggttgtctgattcctgattgtttaacaacaacaaaaaagtgtgtgtgtgtgtgtgtgtgtgtgtgtgtgtatttctttttattcagaaagctgtcatttagatggataggtgtttttggattgtcatattgaacaattactatatgtcaattagttatatgccagatgttagcgataaataaaacttggctcctgatcttagagtaccaacaacttaattgagatgatagacagctgggtggatgttttatgacgttcatagctttcttttcccaaatataagttagaagtaaacttcttcctttcccactattactgtgacatgagctcagctatagaaaagcagaagaattacaggcaaaggtttttgtttatgttgtttgaaaattttttttggtttttttttgaaacaggttctcactctgttgcccagtctgaagtgtagtggtgtgatcatggtcactgcagctgcaacctcccgggctcaagcaatcctccagcctctcagcctcctgagtagctgggattacaggtgcgcaccaccatgcccggctaatattttgtatttttttgtagagatagggttttgccgtgttgcccaggatggtctccctgggcttaagtg

SEQ ID NO: 73154 - DNA, 1010 bp, Homo sapiens
aattggcactaaatccactgtttcaggcctttcaaaactgaaaaattacattgtgtttctaacattgaaaataaagtttcaagatagttttaattaatttggatataagtatagaaggtttgaccactttcagaactctcaggtgattttgacttgtgatcatctctgggaagggatatttagtgatagcctgaattttaaaaacctcaacttgaacactgggagttgatgggagaccatctgattaagggatggactaagtaagtgtaccagtgtcagtttgcctattaaatacaatcaaagcgcaatgtctttccttttaagataaaaaaccagtaatttggataatattttaattcagcaccaagtagattgtttctcacacctgtgttggaagttactggtttagagtatggtttaaaatttttttctctcataggcctttaaaattaaaataatttgcatgttaattaaattccagccttaatagggttttccatcaccttaattcccacatttgtttttcatttccaacatctttgaacttttattgaataaaataattgtacaatcttagataaatattaaaccaaaatttgatgaaagtaatactgcattcatgatactttgctagctagatactataattagaactgaatgaaataaacaacctgtttttaatttttcccttttttgagggatgacacagtttgcctaattagaaataccttttgtgactgtcgtttgtttacctctattttgcagcagcatagcacttctgagatgtttaacttcttttttcatcaaaattattttgaacatgctgacatatctttgagatttaattcctagtcatttaaagaaaataaggggctaggggtggtggctcacttctgtaatcccaacacttggaggccaacgctggaggatcacttgagtccaggagtttgagaccagcctggacaacatagagacctgtctctacaaaaaaaaaaaaagttagctgggcg

SEQ ID NO: 73155 - DNA, 1029 bp, Homo sapiens
caggattttgactgggattgcactgaatctaaagatcaagttgggaagaattgacatcttagcattattgagtattcctatctataaacatggaatatctctccattttttcagatctttgatttttgattagcattttttagctttttccttatatagaccttatatgagatcctattttgttagatttataccaaagtgtttaatttcttggtgttaatgtaaatggtgttttaatttccaattccaattgttcattgctggtgtatgggaaagcaattgacttgtgtactaaccttatattcttcaaccttgctataggtgttagttgcaggaatcttttccttgattccttgcggttttcaacatacacaatcatatcatctgcaaacaagttttatttgttccttttcaatctgcatacctttcattctgtttgcttattgcactagctaggacttcccagtataatgttgaattggggtggtgagaggagacatccttgtcttgttcccaatattaggggaaagcatccttcttcaccaacaagaaagacatttctcaacagtaagtgagatgttcactgtaggtttttttttgttgatactctttatcaggttgagggagtttccctctcttcctagtttgcccagagtttttatgaatggatgttggatttttgtcatgtgctttttctgcatttattgataggatcacatgatttttctttagcctattgatgtagtagattttatagattgacttttgaatgtcaaaccagcctcgtatatatggaaaaatctcacttggtcatggtgtagaattttttttatacattgttggatttgatttgtattttgtcaaggatttttgcatcaatattaatgagagattagtctgtaatttgcctttctagtattatctttttctagttctgttacaaaggcctcacagaatgagctaggaattgtttactgtttctgctttctaaagagattatagagaattggtatcatatcatgagatacc

SEQ ID NO: 73156 - DNA, 1099 bp, Homo sapiens
ctttgctaagaagttgattcagaatttgcttccatgcctttttttttttttttaattttatttgatacagagtcttactcttacctaagctggagtgcagtggcaagatctcagctcactgcaacatctgcctcctgggttcaagtggttctcgcctcagcctcgtgagtagctgggattacaggcacggaccaccatgcccagctaattttttgtacttctagtagagatgaggtttcaccatgttggccaggctggtctcgaactcctgacctcaagtgatccatccacctcagcctcccaaagtattgggattacaggcagcggccatcatgcctggctaatcatgccctcaagtgaaccaccatgcctggcccccgctcccatgccatttttacttgaaaattactttagaattctctagtttagcacccttattttacatgcaagataattggtatccaaaaataccacatacgtttctaataccacactcttttaaacaaattgtctgtagtactcaagtctcttcactaccagatgtaccactttactacttactgctgcttgttgatcctagtttgagacgacagagcaagtctgatccctttcaaatgtgacagccttcaagatagctattaatttcccatcaattccaagcccaagtcttctacatattaagtatccccatattcttacctcttattcatgtagcatgcttttgagatccttaaagattttgtagatcgactgggtgtggtggctcacgcctgtaatcccagcacttcgggaggctgaggcaggcggatcacaggtcaggagatcgagaccatcctggctaacacggtgaaaccccgtctgtactaaaaatattaaaaaaatagccgggcatggtggcgtgcgcctatagtcccagctactcgggaggctgaggcaggagaatggcgaggacctgggaggcggagcttgcagtgagccgaggtggtgccactgcactccagcctgggcgacagagcaagactccgtctcaaaaaaaaagattttgtagatcttctgtgagcgcactgcagcttctgttagtgtgtgacaccaaaccagc

SEQ ID NO: 73157 - DNA, 5597 bp, Homo sapiens
tatatttagaataagatctgaaatttaatagggatgtattactctgtaccacaaagcataattgatctgttttccaaaggcaacactgttaaaatttatcctgcagtccctgtaactttaaatatgtatctgcctatcttattctcctttcagcttttccttgatcagatgctatgtgctttgaacttccttctcttatttattcctataataaagctaactattttctagtatctttgccatcatctataatttgggtatatcttactgctttaatttctatgttatagccattaatgattattcctggttcttcttgacccaaaagaaaatgattatgcattttaaaaaggattttgagtctgtattgcctatatccactattctgccttcccagttttaaagctgagtgcttgaagaataaatcttttcagtgacagtagtcataagctttcataaaatataggcttagctttgtattgctataatatgggcctatagtgtgattaattctttaagttaatgaagacttgaactcagagaagaaattcagcttcttagactttcccaaagtttagtagtattcctgttaatatacttggttttttctgtttctacttttcagtccatcttcttttctttgacagaagaattaactgggactcctcctttgatatatctgaggttgtgtgccttttccctgtcccttaaagacaactatgatcttgtttccagtcataatttatcatttttgatttggtcttccactcagagttgagtggtttatcacagagtgtgttatggcttagaccaatacaggtcccttcttaatagttactgaggaattaatcatttgtggtgacagacttctaaaattcaaattaagaaggcactaaagaaagtatgcccaaaggtagctcctttttatcctgaggattaagccattacaaactcaaatgaccagagaatgtaatttcttaataagaatttttccttaaatctatattcagctctctatttcagtgcttctctcctaccagaggtgcaaggagtgatcctagaaccacagatacagccaagaccacggagagcttttgacgtcaggggtccactttctccactgaacccttggagacagaatatccagcttctggagagagtgggaaaggataataaacaagtgggtgctttccattatttacttgggttaatttatagattggagtgtccttccattgcccatttaattctgtggtaaactccttgggttcatttaagaaccaggtgggactgcaatctgttttgtttttctgagaatgctaactagtactcattcaaaaatgagacctaaaatttaattttctctccagataattaaagcagtggatgatttggggcacatgatttgacgaatgcctatgtagtccacaggaattttaaaacgggaatatctacccattttggcctttgtggtattagtggacttctaagtgctcttttatattcaagtaatttaaaaggttctgtatttcatctttgggcaaactggacatttgaagtctaatttatacagtcacatgtccaagtgttatcctacactgttagtgagaaccttttggtcttcttcctacctcaaatgttaggacttcatattagatcttttaaaagatgcaatgatagtactattatggttttactgtcaattctaggctccattctttaataaaacataagtatgaatgaatgtaagtttcaggatacagtatccctgaaagctatgtttaatatactcaaaagtcattttctagtccctaggaataaatatttatggtaaaagaaccctttcctagatttcccccatggcattaagatggttttctcttagtttctttgatgccaagggtaggatttgattccaggaagttcttatcacctacaatgggtagaatgtgaacttgttacctttggcaagttttcatttttccttggtggattccttctgtgactccaggtatcttgataatgggagactggtttatttgttctttaattgcccagatttctttcaactggtaaaacatcatacttcttcagcaaaaggaattcttctagcagagccttcatggatgatatctgtcacacatgccagcacctgcagtttggaaggcagtggtgaatggatccatgcaatatgtctagaagacacaaggatgagccagccacctgatcttgtcatttataaacttttaagaattactctggtttacttttggtctgaaaatggaaaggcccaaataatgaaataatcttttcagattggaattttacatggccatgaaaatatttctttctattcagaagactgaaatagaggaagcttgagagactcctttcttttaaaagcggctctctgtatctgtttcatttaaaacatttgtgggattgaaaatcaccttaatgaagtaggcaaacatttttttaagtagtagaggaagtccagaaaacttaatgaaatggttttttttgttgcctgacactgaaagtaactagtaaataaagggtgaacttcttaattattcgaaaactgcttttaatattaggatatactcttttagctcatcttcgctggtcttgaggcttattataattgtcaaatcaacaaagtttctaatagagaagtagaagaaatatcttttgagatgtaagtagcttggtctgtcttctaaagtaatacatacctgttaaacttgaggtatttttttcatactgaaggcattctaaagtttggtactgtcacaaaacagtagtttacagagcagaagcacttagtattagaataagcctgtaggtgtgaaggaataagtgttgcaaaatagttatttatccaagctgtcaattaattgattgaagtagttatcaaaatgtttctgtttctttctttggtatctattaactggtcagtcaaaagctattaaagaatgtttttaaagtcacctaatgctgccagtttgttaaatttggtatacattttaagaatagacattctagagttattaatatggaagcagctaaaatgttttaggaaatctcaaaagttttagaagccacatttgctaaagcataacctgcacttagtctttcttggctatctgtatttttttctcattaattataaataaatttttgttaagtatagtatttaaaagtaagtttaaaggttcaatttgaactgaaatttccccagagagctttgaattcccataagtgattacagcttttactcccgacttgtttttagtaaatgttaataagacaattggtttacaaacacatataaattaaaaaaaacaactgtccatcgttttaggaagaactgaaggaactaaaaatgatatttgcttggaaattaagttagttgaactctttgaaccacagtagaaaccgctttgtgtggcctgtgagattataagctttttgtttcagctttgaagatgaaaagtgatttaatctcttaatctcatgctttgattgaattttagctctgttccttaaaatatgcaaaaggaaatgtaagtgcatttctagtcacctcatgccactacaagctatttatttaaaagtgaaactttttgtatattattgtgaactgatttgtttatttaaacttttattttggtgaatttacctttgagtttttttatattttatgtcacaaaatgaagtcctatatttttcagtgtttatgaatattaatataaactatttttttctagaatgactaattgtgtaatatctgtattatgtgataatttgaaatctaataaatattttctccatgaaaaaaatgcacttactgataatggcttatttctgtttcaggagtagaaagtgaaaactgcaacagtatttttaaatgtattttaattttctgtgtctttctctaaatatttctgaatatgtattctttctgtgtgttagttttttttgtttttttttttttttttttttttttttttttttcagaaaaatacttttttgaactgttaaggtgattcttcgtgggggtcaccagtgaatgtatgaaataggtgatctgttttgtatgtttttgcattttcctgattagcatcatctttcctgattagtttccagaattggacttttttagatgcaatttttgtacctcaattttgcaaaccattaaaactctcttgagttaatactgtaaatatcaagagtaatttgaccaagtcttttaatgctagattgatcaaaatataactcttacagaatagcatccaaaaacagttcctttacccagaagaacatttgaaaataatggctgattagagaactatgcaattcataagaactgttgaaatgaaaaatgttttgtattttagtgttctacttgcgcaaataattgtagtgggagaaatcttggcctcatagtctcttgtttttaaatcttatcaagacagcatggagaagggtaatatttagttttattgattcttgtttttatagctacataattttacttaattgaagccacaggaacaatttaccttttctatgcaggatttgcttagaagcaagaggatttcctttcagatttgaagaaaagttattgaagaaatggacccccaaaattaaaaataacattaagatggggtcctaggcaagaagtaaaaattgaattaatgacaattggtggattaaaatgtaataatttggctccccaaagaaattaatactctgaaagaaatcaaatttctaaaaggcagttatgatttagaatagctgttgtattgggggtgggggaaaggaagctaacattcttggctttattaacctggtaagtttggaaaaaaagtaaagattctgtgcacaaaattttgtttttagaattaaagctattaaaaggtttacagacacagtatatttcaatgaaaggctgtattttatttgaatataaaaaaaatctataagcttttcctatatgtgtatgaaagggtaggttgggcatggaagttaaaatacaccctgcattggaaacctgaaaaatattgcaaagataatggtgacatgagtttttaaaaagtaatttttaaaacatagactctcctctacatcatcagtaaccttcaaaataaaaatactacagaatgttgaatttggcttaccattgtatttttgaggtataggaacataggcttatggtttcaccatcactgacgaggttaactatagtataaaaatctgttttgattgttctttagtaaggaaacaaatggttttttttgtttgtttgtttgtttgttttttgtagcttctgtttaaaaaaacatgacaagcagtgtgactgcaaagtcctgactttataggttattgtaaatatgtacacagatcttattttctttgccatattgaaatactctgacaaatgtcagtgcttagatgtcctaagcaatttttttactttatttttatccaggtatttttgtttccctttaaaaatatttcatagtaatttagtcctaaaatgtgaaagacttgtttcaaaattcagcacttaggtactctggagtgttttt

SEQ ID NO: 73158 - DNA, 2181 bp, Homo sapiens
tctagagataaaagacacactgcttctgttaagcatgttctttccttttcttcttactgccagctaggactgttttggatacttagaggaatttgtgaagaatttgttttctttgtagaagtgccttagaaccagtatgaatgggtgataataggtaaagaataaaaagatacttccaatgtatgtagaatgtccaggttaatgaataatcggtaaatttataaaccattaagttcaactttagatcagtcagttgtagcacatttgagtagaaatcagtctttgtagaaacatagtgccttctatttcatagcttaaataggtgtagccttcccttatgcttagatattagaaatgcttaaaactaataagctgtgtatgctcatttcataatttaatattgagaacaaatattgcaaacagcctaatttgatgtacttctcataaaattttctcagtggtatttatatataaaatactgcttctgatttgaatatacatggattttcagtaagaatctttaaaaatttcattatttacagaaaatgttaaaatgatttcattgatgtactggtaggttaatagatctataacagccatttgaggtagcagcttagcattgctgattttgttagctttggtttgaaattttttctctagtggttgaaatgtaagtcttgcagtgtaataaatatttctccctcttaaaatatcacatagaagaatgttgtccactaaaatagaattaggtaagggcttcctgtatcatttttaggagcttccatcaataatattctcacaaaggctgcactttctttttcaaataatgaccccattttgaaagcatctttacattttttatataaatgatacattatcaaattcagagtcttcataaattattaactcttaaagcaagctctctttaccagctctcctcagtgatttcaaaataatttctacttagagaaatctgcttattcatttctgagtatgagtgttgaattattatgttttggtacttcaggcaaaataaagaagttatattctgaaagcgttctgacttaggggaagtttgtaaagattcattttctccagtgagctctcatatttaacttgttgtgtaacttaaccttcggacatttggttttttaaatctaagtttgttgtactttttatctatattatactgtggtgtgtgataaataaagatttggatgcatttaacgtaaagttcctgttgtaggagaaattctaaatttagaccaatattaatctgagcaagatctggttttttgtgagttgtttttcattttcaaagtgaagtaggcctgtaaacttaaaaatgaaaattacgaggtgtatttcctatatcaaaatgtacctctttctttttgcctgtattttcactcacctatatattattatggattagtattcaagaactgaaggaaaactattggaaagttaactattgaaaacgactggaaaggaaactaaaggaaatttggaaaatcgtatcttaattataatttctgaataggttttaaactattttaaagtagttaagttttacttagatttcattaatttagaaatcttagataattttcatggttgatattgagctattactatatgaaaaagaataatttgtcaaggaaattgattagaaaaggctagaggatgattgtttaataaataatttttaaagcacttttatagcacctatttgcaccatataggtactgtgaaaatgtatgtagatagctccaacgtactgattttaagcctttttcctctgttaaagagccactccttaacaactccagctgtggaatgctttgttaatctactagggtgttttagactcttgaaactacttaattagattgcatttgttaagattcagcattcagatcctttttctaatctgtgctcctttcttcttatcatccatcatatacctcctcattgtgattatactgtaaaatactttttaaagcctactgatctaaagatacagtcttttaaatactaaaaggcttttggacttaaaatctgttggaagcttaaattgaaaaaatagctgccactttaggtgcataaagtactttcataattatttgatacctcttgttagatggcagtttcaccttcttctttccagtttcttttttc

SEQ ID NO: 73159 - DNA, 1026 bp, Homo sapiens
ggcatctcatcttatttctgctacctcttcattgtatgacctttgtaaatgagttaacttttttaagcctgatttccatagctgttatgtgcaggtaatagctacccgtgctgttgttgtgaggataaaaggagaaaggcatataatgcacctggctcagttcttgatagttctgtaaatcgatggctgtttttattactgtgctaagtaagagtgattcctttcttaagcactgtaagttaaaatggaaagcttgtttacttgttcagaggcgttatacataattttctaaagcagcggttctgtacctttgtgacatttttggtgcagtctttctcacctggggtccataagacaatccctacaggaaaagagtgcctactctcttagttctaagaatggcatatatctagcaccatcattctaaatgcataagaaaatagcgaattcattacatacagtggagcgatcagggattaattctttcgctgactctcatgctgccaggacagtattatatgtgattattgagcagttctttgaaattcctaaattcacaaaaacataagttgttgtaaaagcaacctttccctttttttaaatgggggtggggaatacttggaagaaatacagcgtcatgtagcagtttgttaatactctaaaatagaaccattaccccaattaagtgattctcaactttttcattctgaaagattgttttagatgggcattatgccctgaagaccatctcttccatgctcagtcccatatgggcccgaaaactatctccttagaatgaatgggattaagctgtttgttttaagtaagattataagtcaatatctggttttttaagtttcaaacattcattgaactggattttgaaatctataaagtttcaaaactagtttttttctaatactgattctaaaagtgaaaaaaaaaaatagtattagagcccagaaatttgggggaatgctttttgtctgtatattttggaagttgacattacattttagtttattg

SEQ ID NO: 73160 - DNA, 1020 bp, Homo sapiens
acgacacccagcttatttttgtatttttagtagagacagagttcactgttggccagtctggtctcaaattcctgaggtcaggtgatccatcctccttggcctcccaaagtgctgagattacaggcatgacgcaccacgcccgacctacgtatttcttattagtcttttgttgttgttgtttgcttacgttttctggaaaaaaaaaaattcacaagggcctaagaataacattctggcatttttgcaagacacttgtgattattgaatcttcttaagagataatattttaaaactggattaccttttataaaatggacaggctaagatcaactttggattttttttttttttttaatttagaggtctagttatctttccagttgtattcagactcttagcccttagggatctacaagtggcttattaggaaattgatccaatatgtagaaacaaaagcttctaacaagtggacacattggcctaacaaaaaccaagttatactatatttgagttcatgaatgtctgacttaaatgccattagtaccattcattcagtaatctgaattaggcttaacacatgagaaggggagaggagacaagagaaatagggagttgaagaccattagaaggagtggaagagaaggaggggatttggtgataataatttggtaaacatttggtgcagtttgcggtcagggtcactgtgtcctcattgcctgcatcagcgaatttatctatataaaaattattttagaaaaattacctaaggtagtttaagcaattgtcttttagcctagaaggtttttaacagtacctcttttttttttttttttttttttttgttcctggtattgggatgatttatttacttcaaaaatactcattcaatatttattgaatgcttgttacatacctagcactgaacaaagatactaagggtatgaagaaaaaaaaagacatggttttggtctgcaacagtttcgtctagtacactcaagcatcataagatcttgatttatc

SEQ ID NO: 73161 - DNA, 1048 bp, Homo sapiens
agtcagaatcatattcttaaaatggaaatctgttcaggtaacttacttggccagaaccccttttaagcctttccatttattttaaggtaatttctttctgtctttgcttactgatggcttcatcatgcttctttctcccaactttcttcattccagttgtacttgacctttcagaaagtttttcagttttcatccattcttcttctaggcctttgcacatgctgttattttagcctgaatatcccctatgccatctcactttcattccactttaaagctaaactcactttttgagaggctgcctctgacgtaccaatctaaacttaggttgtttgttaataactgtttaatagcaccttgttcttttcttttataatgcttattacagttcgtaattagattttgttttcatgattatctgatgattttaagcttcttgaataggaatggggatgtttgatgtgctgcatatattcaaagcctatttcaatgcctattagataaaatctgcttaatcaagaaaatatactgttaatattgtcataagaaatctgcttaatcaagaaaatatactattaatattgtcataagaaaaaccaaggagaacttctatttttaaaaacagaaagataaagttctttatgatcatgtgataacactattttctcctttaagagagaattaactgatttactttttgctgtgtttgtgagccaaaaaaaccaatgcttaggtataatcaaatatggttcttgtccccaaggagtgtataatattataagaagatatgtatgcatgtggcagttatttggcaatataagggctaagtaatagttttaagcaacatgaaatattaaataaaataatcagaaacttaagagttggaaatcttgatctcattcaacctatgaaggaacaagttttggttaagtgaattcgccgagacagttttacaaattgtttcttagactgtacctggaacttgggttttcaaaatgacataagcaaagttcacagatggtgtagatttgacctttggtaggtcaga

SEQ ID NO: 73162 - DNA, 1273 bp, Homo sapiens
tcattaaaaaaatgatgacaatagtagttacctcattgggttgatataagaattaaatgaatttggaaattccctagaactttgtctaactcacatgccctatgtaggtatttgttaaataaaatacacctttcatttctttttgtctgtattaacttcctggatagaaaatgaagatttaattttgttgttaccatatacctacctggtctccttttttcccagtacccttcctcccagtagttatcaatattgattattcagtattcttgtcaaatattacttttcctatcctgtacagtgttttgtggctgcttccctgctccatccccacctgtctattatagaaatgggttttcctccactcccaggttttcatctgtcagcgctgtctgttttctccaagttgcccctcctttccccaccctcttcccatttttgtatgttttgggctctacctttcctgtagaacctttccttagatgtctggtaagtcttgattgtctgcttgcaaataagtgttaaaggattaaagagctgattagagatttgcagtgtggggctggccatggtggctcacgcctataattccagcactttgggaggccaaggtgagaggattgcttgaggccaggagtttgagattaatttgggcaatatagcaagatcctgtctctactatatatatataattatttttaaaaattctttttccgtgtggcttgttgactgttaactttaccgcagagtaatctggctggagttcattgtctttttttacctctttgcctagttttctctatatttatcactaaatccacttttcatcagatgcctcttaggatgttccaatatcagatattgttaacaattttatctttctcaggaagtgttatatcccactgacctccattcttgactggttgccttcttggcttggtacacaactattattctgggattcctttcactttgtcttgtgttggatctttattttccagagactagtgtctttattcttagtttgcttgttttaaaatggctttagtttactctgacactttcttaggtaaagaataccaggtggggaagttatgttctcttatattttgtgccattgccttctaacatccatattgcttttgagaaatctgaagccattctgatatcttatatattgtatgtgacctgtgtattttgtttttccttcccttccttttccttcttccttttcttcctctcatttttaaaacctctaaaacctttataagat

SEQ ID NO: 73163 - DNA, 2826 bp, Homo sapiens
acttggttccaccacaaaatatagcacaaacccctgctacccaaaatggtaatttggttcaaagtgttagtcaacctcccttgatagcaactaatacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagtttcagatgggagtagcagcagcctagcagcctctgcttctcttttcccgttgaaggtgctaccgctgacgacacccctggtggatggcgaggatgagaggtaagatcatgtcatatttctggagacattcaacagatttgaagttaatctatttagtagctatatgtatgcacaaaatgactctaaaacattgtatattgtgttttgtatgtgaaaaatgcatttttatgggaagttttatagagcaagagttatggaatggtttcagagggagtaggaaataatagtaatatgtaaacaatattttcagaatagttgttgagcatgtgttcacattaaaaacaggtttgggggcgccaagtggttttattatctctaaaatgctttttagaaatattatggaaagcttaatttttgctaacccacataatagttaatctattttgagctgctaaaataatctcttggggggttgtggttcccacgtttgttctcctttactagacatccctttttcatttctactgtgtttgatcttagtctgtgaaagatattgttgcctacttttcctagtcagatatggtaggaaagatgacttaatctgggttatataggttgccctcatactccaactgaccaacttttgcgtacttatttaatggtcattttatctgaacagtaaaggaatgggaatcttattttgtgggaaaggaggacataaactatcaaaataaccagacttatcttgatagtatgctgaacattttttcttttgcatggtagatcaaggtggtagccattttaaagaacagagaaagtaagtcttggaggattgaatttatagaggcgtgaaaataagaccttggtctctggctaatctactccacctgttcctttctttccttaccaaaaagatacagaaagcctaaagtacattattaaaccaagcgttttttcacgtagattggaaataatatgccagtaacgcttattgaatcaaattgtgtctttgaagctgactggctaaaaaagttgtgaaatctttcatgttgatttttaaagtaatgttcttttcacaaattttccagtctgttactaaccttgattaaaatgctattataggagttatgaaaagacatcattttcacggtggaatttggagtaagcgtgcaagatatttaattattttagtattagttggagggttttgtgattgaactttcatcaagcgaatttaagcatttatattctatatgtatgtttgtgggttttgctttggaaaaattgagcatattgcaaaatagttgtaattttagaaaaagaaaacaggtcaaatgtttcagtgaggtttgtgttatttagttgtttaaaaggtaagataaagacatggttaaattgataaaatcttatctttcaagatttttattatttttctaatagtcaggtaattaaaaccttgttacctaaccaaatgtattctgtattatttgtacaaaactgtactctaaaagataaacttttaggaggtagtttccttaattgttccattattattgttaaacctttaattttatcatgctaatactcaactaattttaaaagaattaccacaaatattaatgttttttaagtcaaaaggttatgatttgagtgaagcctctataaaaacagctatattatgtggatgctaagtttagagaaacaaaagacgggtaaaatacacaaacaaaaacactcattttgaattcaaacttgccatgattttgtaattgccatttgtggtctcctggcttgactttcacctctttttcctcctattggtaggacatgataggattttccacagcttgcccttccaggcaattaaagtcagatgatgctactttcaactagagttttaactataggaatagggtcccagtttaagatattaatataaaattaatttttccagataataattgagaaaaggaataataaggtggaaattatggaattctagaaagggacaaaaagacatactgagaaataaggaaatatagctctaatacaagttgtcttcagacactgtacacattcaattataattatgtttagcagtctctcccacaagaccaggagttcctcaagagcagggactgttttgaatttactacctatttgggccttggttagttaacatcaaagtttcgtgattaaaaaccagaaaatttttgttttagcggtatcttaaattctgtgaaatcggaatgtagccctaaaacaccttgtaagatcagaaaagatatatattatattctttattgtgttttactgaagattatttatcactacagtttggaaaaaagttaattttcatttaaatttgcccttggaagataatttaagaataactacaagagaaaacagtgatatgattaaaaaacaaacttttaaaacctttcttcccatggtagcttctgttgtcacttgcatcttctgggcttggtcaccattagtctcaggagagagggaatacatatataatttcaatattatgaatcaggaaatgtgttaacaat

SEQ ID NO: 73164 - DNA, 2507 bp, Homo sapiens
cctcgttcatcctcctttccgaagctcgctctcgaaggcaggagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgccccctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctctaacaacagtatagcagaggacactgagagctatgatgatctggatgaatctcacacggaagatctctcttcttcggagatccttgatgtgtcactttccagggctactgacttaggggagcccgaacgcagctcctcagaagagaccctaaataacttccaggaagccgagacacctggggcagtctctcccaaccagccccaccttcctcagcctcatttgcctcaccttccacaacagaatgttgtgatcaatgggaatgctcatccacaccacctccatcaccaccatcagattcatcatgggcaccacctccaacatggtcaccaccatccatctcatgttgctgtggccagtgcatccattactggtgggccaccctcaagcccagtatctagaaaactctctacaactggaagctctgacagtatcacaccagttgcaccaacttctgctgtatcatccagtggttcacctgcatctgtaatgactaatatgcgtgctccaagtactacaggtggaataggtataaattctgttactggcactagtacagtaaataatgttaacattactgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcagcaaaagcaaggtcttcagccagtacctctgcaagccactatgagtgctgcaactggtatccagccatcgcctgtaaatgtggttggtgtaacttcagctttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgactcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcaggggcatctgtccagcctgttggccaggctccggcagcagtgtctgctgtacctactggcagtcagattgcaaatattggtcagcaagcaaacatacctactgcagtgcagcagccctctacccaggttccaccttcagttattcagcagggtgctcctccatcttcgcaagtggttccacctgctcaaactg

SEQ ID NO: 73165 - DNA, 1025 bp, Homo sapiens
ggaataagtgaaaatccagcctccactctgaactaatgcagtatccgagtcatgagtagggttcataaatagcttgagctttcttgaggggtccttatgccattcaatgaatctgcccatcagcatgtgttttatatattttccttgataatggaaacccaatgattatcattaaataattagagaatcctatataacccaacacatgacccctggaaaaaagccacacgagctggtgtcctcccaaccctgctgtgtttttctctctgagcatagcataagtgggcataaaacaagagcaaaaacacaagcaacggctatgtttggctttcgattaggcattaaacctcagacagttgctaaacttcttgaactccatggcttcagtccaggttggaaagcaggtcaaacaagtcaagctgagtagaggatgcaatcttttgttctcagcaggctttgaagtttgttttaggattaatatttaactttagatcttaactattttatgcctcaatttctccacatacagacaatacataaatcttgcaatgaaagaagatcacactttcttgtaaatgtaaatagtataaactctttcctttggagggtaaaaaatggtagagttggggctgtagaacggtgtggtccaataggggtataatgtgaggcccaagcacaggagtgttaactttcctaatagccacatttaaaaagtcaaaacaagtaggtgaaattaattgtaatagcatacatattttatttattaattttaacagcccatttttatttttgtatgttaacatggaatcaatattttaaaaattattagtgagatattttacattcttttctttatacaagtaatcaaaatatatacttaccacacatctcaattcagactaggcacatttcaagagcttcatagctgtatgtggctagtggctactgtattgggcaggtggttctagagccaaaatgaattgactgagaaactgcctgatcttaagcaagttacttaagcatcc

SEQ ID NO: 73166 - DNA, 1128 bp, Homo sapiens
tattgttgtcagagattttatttctatagatgttataaattgcacatacacttaatatttttgctttagttttaaaattttgccaatgaggaaaaaaagtcttttatatttattcacatatttactttttccagcacttatccttcctttgtatagatccaagtttccatctggcattatttctttcatagagatcactttctgtagctcttcatggtagtcttctcaatttttggtagttacagcttccaatttgaaaaatactagaatacattataaatgccttgcaaaaatctttcatagttttaagttattaagtgaacaatattatggctaggaggattattatggatttgttggttgcttttgaaaggtctacctgttttgttttgttttgtttatttttgtgtttgtttttcatcacacttagaaactcccatcaagactgaagcagacgttttggcagaaaaccaggttcttgatagcagtgctcctaagagtccaagtcaagatgttaaagcaactgttagaaatttttcagaagccaagagtgagaaccgaaagaaaagctttgaaaaaacaaaccctaagaggaaaaaagattatcacaactatcaaacgttattcgaaccaagaacacaccatccatatctcttggaaatggtaaattatttttctttaggttctaatctttgtgttctcacatcataaagatagagccactggggtgtgtgtgtgtgtgtgtgtgtgtgtttgttttaaggttaccagagacacattgaccttggagactttgtatcttaattctgtagctacatttggcatatagctggtatattcagtgaatgtggaataatgtaatttttacaaccacttaaaataaatttaggtttcactagttggtaaggaagtatctactgaggtttattgactttcttttaagtttccagtgaaagcacagctaaaagtacaatggcaagctgaagggaaaaaaagatttttagtacaaatgtctattgagaaccatacagtaacaaaaaggaaaggcctaaggttttctgacaattctcatttgttatcttctgggattgtcttccttccctccctcctccacctattttttttttt

SEQ ID NO: 73167 - DNA, 1034 bp, Homo sapiens
acccaagaggcagaggttgcagtgaggtgagattgtgccactgtactccagcccgggtgacagtgagactctggctcaaaaaaaaaaaaaaaaaaaaaggaaatgtagtttgatggagatggcagcacttttaatgttgactaggctagagataatcaatgtttatgtatttggaagatgttgaataaggagccgttaggctttaatatgaaaaatggtgtttacatgtatctgtaacatgggaagttttttcttttttaagtgggccatggcttactatggtagcttcttaatagctacttgaattttgaaatataagctactttggctttatcacagtattccttaacagatggttgcctattttaattttaagaaaaatagcatttttttgtgctcttgtttctcatacattggtgtgaagatggagttattctttaaacacatattacatttcctgcttatcagttgtattcataacaggtgatagcaaagaaaactattaccagaattacagaatcccataaaaacaggctggactaatgcttgcttctctgtttcttaagatggaacagtatttttatactcatgtcttcattttgagactgccatcattttaaattggaagaaaggaaactggaagggatctttgagatcacctctttattttatagaaccttaagcatagaaaggataagcttggtcgggcacggtggctcatgtctgcaatcccagcactgtgggaggccgaggcaggtggatcaccggaggtcaggagttcaagaccagtctggtcaacatgatgaaaccccatctctactaaaaatacaaaaattagcctggtgtggtggtgtgcgcctgtaatcccagctacacaggaggctgagacaggagaattgcttgaacccagaaggtggaggttgcagtgagccaagatcgcaccactgcactccagcctgggtgacagagtaaaactccatctcaaaaaaaaaaaaaaaaaaaaaaggaataagcttggcaagctggtatgtagc

SEQ ID NO: 73168 - DNA, 1916 bp, Homo sapiens
atactaacactgtggtggatttctgcttaatctactagtaattcacataaacttcatactttcctttccctttattaatcaaggagtaaaggtaacttagcttaaaattgacaaggagtacttttataggtgtgatggtgtgtagtgaggagagaggatttagctccatccagcagaaggtggcagttgaacattcacatagaaagatattcccatttcctactggcatgctttggtttcccctagactgacttggtgaacattaaatgcttagtcttgaaacattttatattggttttaggttgagttggttaattaaatagacaaattacttattgtcttcagtgaggccttatttttattggttgtctagaatagagttactagattgttagagctgccaaaaagaaatgtaataggtggtgtcctggggctacaactaggcttgctgggcctggatcaaacactttatatttggcaggcactttagtattatgcttggtaaattctcatggttgccttgtttatttaagttcttagaagttttaaataataaaaactttgagtgggctggtcacagtggctcacacctgtaatcccagcactttgggaggccaaggcaagctgatcaacttgaggccaggagtttgagaccagcctggccaacatggtgaatccgcatctctactaaaaatacaaaaaattagctgggcatagtggcacacgcctgtgatcccagctactcaggaggctcaggtaagataattgcttgggcctggcaggcagaggttgtggtgagccgagattatgccactgcacttcagcctgtgtgacagagcaagactctgtctctaaaaaaactttgggtggattaattccagcattactgtttgactaagcctatagaatgctttgaatattatttggatccccaaaaacagtcttaaaaacagttaaaagcataggtattttaatacttcatttatttctaaacctaattttcagaggcagtgatcccaatccagtgaagttaaataaagtttgggtcttcctactacctgtaaatgaacagcaaagactatgtaattaagttaatttagagtatgctcagattgtataacctgtgaagcatgctaagtaactgagctctatatagcttccttttccctcactgtctcctctggggcaaatggtttcttggcccatgaagatgtctaaaccaaggggaagtgtttctggccccctagaattagtcttttggaaagattaaggaaatgatcagaaattacttaattttcactaacaaatgagggaatgggggatggacagcttttttatggtggtagatgttttgaatctgacttcttttcccttcagagtctgataaggaggagaaaccacaacattctgtgatacccaaggaagtgacaccagccctatgctcactaatgagtagctatggcagtctttcagggtcagagagtgagccagaaggtaagtcatggtgtgtgttgttacagggttttgttttgttgctttttgccttttgtgcatgctgcgcattaataacatccaggatgtgcatcctttatttggttttcaaattccttttccatttgaatcagaagtaaagttaacatgggttaaaggaactctggagtaataaagaaatgtgttgctactctgggaataaaaaggcaaaaaaatacaatataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtg

SEQ ID NO: 73169 - DNA, 1056 bp, Homo sapiens
tgactgattctggggttgggacagggaaaatataagctgaacctagagcatctcatagcgccagaaagtaagaaaatgctaaaaaaatgtgaagatgtgggtatgtcagaaggatactagaaagagttcccaagggccaaagttggaacaattggtgccacaaaataaataataataaattataaccctcagaatagaataaatacccatgagtctatactgatatgagtgcctaaataaataaataaatgtgggggaggagggacaggtctttcttacaaaataattctaattattaaatgtagaagaaatgagagaaatagcaagtcagcattagagcaccacagtaataattgttttgggcaagatccactgatgaatggtaaaattagtggtgaaacgttaaaatgaaacaatatttgttatagcctcaaaatatctccccccaaaatatttattaattataataattattaattaccatggttttaacatatgtcgaaaattctttgatattccttacttgagttgaagcttaattcttcttccctggagtgtgagctaaacttagtaactcatttcaagaaatagaataatgaaagagaaaaatagtaactttgtagtagagaaagcaggcagaccataaagtggtcaaggtcaacattgccagtaataagtcctactgatattatggacctgggttgtgatgagaagggcacatctctgtggtattccttctcaaaatccatagcctcagtctaatcttcaaaaatgtcagacagacccaaactgagggacattctaaaaatacctgacaataatcttcaaagtatcaagttcaggaaaaacaaggaaagactgagaaactgtcacagatttaaagaagattaaggagtcatgacaaccgaatgcaatgtagtatagcagattgtatcctggaacagaaaaaaggacgttagtggaaaagctggtgaaattacattacagtctatagtttaaatactagtgtggtaccagtgttaacttcttagctatcataaagtactttggttatgt

SEQ ID NO: 73170 - DNA, 1026 bp, Homo sapiens
tagaagaatgaaataatgctgccagttaaattggcctttaatgataatacgacacagcccaatttcagagggataacaatatgggtagaaatttgcagcgtagaatcaagaaggtgtggtatattgtggggtgctgtccttctaaagttctatcataggcttccctgtctttgaaagtcactggaatttcttttattttcgtctctttaatgtactaggctacaagtgatcagttttacagctaggtttcttttgtatctagtagtctttttcaaaattttcttggaaggtcagtgccttttatattaaaaattgcaattttcttactccagcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctggtaagctaaacaggaaaataacgtatttataagtgtatagacaatgatgctgaagttgattattcacagccttgcttgtggaaagtttaatatcaaatgtataacaatgcagaatgatgcttttgtttttgtttttaataggagcatcttgtttaaaacgtcatttcagaacatcttttctgagtcttgggtgggcacatggggcagggaggctataggagaaggactgtatttgctggataattttcattagtatgaggtaatcttagaaatttcttaagattgttttgaatgtattaatgctgtgcattcaaatttgcccaaatatgtggattttccctttacctataaagcagcaattctaacggaagtcagtatactttatgctactgagcatgagcatgatctctgggcaaaaaatactaattcattatgtttgatcagtactgttcttcagagcatagattatatttatatatgtttgtccttgaatttcctct

SEQ ID NO: 73171 - DNA, 1380 bp, Homo sapiens
cactttttttttttctgtgagacagagtctttctgtgtcgcccaggctgaagtgcagtggcgtgatctcagctcactgcaacctccacctcctgggttcaagcaattctcttgtctcagcctcctgagtagctgggattacaggcatccgccaccatgcccagctaattttttttatttttaataggatggggtttcactgtgttggccaggctggtctcgaactcctgacctcccaaagtgctgggattacagacgtgagccaccacacccggcctctttcactttctgaagtcttggtttgtttgcattgtttggcctacttaacatactctgatttctgttaccatttaagaccaatttctttcatttcttttctttatggatttttccaattagatatagtctttccattccacccctaccccccagtctttataccctcttgggtacttttgtcttatgttatcactatttgtgtgcttttcttatcttcctggtagacagtatattttttattttattttatttatttatttatttatttatgttttgagggggagtcttgctctgtcacctaggctggagtgcagcggcacgatctcaggtcactgcaacctccacctcctggtttcaagagattctcctgcctcagcctcccgagtagctgggattacaggcgcccgccaccacacttggctaatttttgtattttagtagagatggtatttcactacgtaggtcaagctggtctcgaactcctgacctcaaatgatccgcccacctcaacctcccaaaatgctgggattacaggcatgagccaccgtgtatattttttgagaactgtctcctcctcgtcttggtaacttcgatatacctagcatgtatttgcataagaaattggatagacttggccgggcgtgatggttcacgcctgtaatcccagcatttggggaggctgaggcaggtgggtcacctgaggtcaggagttcaagaccagtttggccaacatggtgaaaccccatctctacaaaaaatacaaaaattagctgggcgtgatggcaggtgtctgtaatcccagctacttgggaggctgaggcaggagaattgcttgaacccaggaggctgaggttgcagtgagctgagatcgcaccattgcactccagcctgggtgacagaacgagactccgactcaaaaataaataaataaataagaaggaaataaaaggtaatgactagaataaattgaatagacttaaaaattttttttacagtatttatgggtacatgccatatagatgaattaaatcagtttgagcacattgtatgatatatttgatttaaattccagtgtacacttgtctagttgcagactgctagc

SEQ ID NO: 73172 - DNA, 1053 bp, Homo sapiens
ctgtgtaggaggatagttttaaatcaagataagcctatttgagcatggaaagtattcagataaaaggagatggtagggtgcagtggtgcttgcattagctagtcatgctctaggaaatggaatggcaaccttactaccatggcttagtgcaaagaggtgtcattttcccaaggttaaaaaaaaaataaatccagggctgctgttgctgcatgacagtaccatggacgtaggctgtctcttgttgcaccggagtaggcggctctcctcttgcctgtcaccagaatgttcttgcatatgcaaatattaagccacagaataggcagaaagaagagaaaaagacaaaaggtacacgtagcctagtttccccccttttcactgggaaaacagtagctttgtttttatttccaaccaggagataatttatatagatctcattggctagaagtgggctgcttgaccaccttcagtggcagtggagttgatgggatgcctgaaacaaaattgttaaggaatgggggagaatagtcagtgtttgctttagttcttggtggcacagtggaatttcaaaactataagtgaattttggaagcggctctgtccttctgaataaaggattggtttgagcaagcatttaataggcttgctggtggctctttttatgtaggacaggtgggggctgaggggatagagtctagctctggtttccagaggtatgctatgacagcaggcagaagtgccttggaagaggaatgggcaaaatctgttgagggaataagtgaggttataggtttgtgaaatttagaggtgtttaaagagaatgaggaaatggggtgaagatggcaattttggatgaagtttatttatacctgtgatgttgctttgtttagtaagtgctctgaaaattctttgggcactgggtgagttcatctgaggttcttccatagtttgtttctcaggttcttgctctttaatatattctgaagagttcatatatattttttctgtatgtatattttattagaggatatgggaaatactgcttttcttttggta

SEQ ID NO: 73173 - DNA, 1030 bp, Homo sapiens
tacagattgtcacgtctactcatatctttagtggcctctctaggttttgattggtaagtcattcatttgggtgtttaatgtcatttgagagaatgggtggcatatctactttgtaatcaaaattatgttaccccttttccctctattaatagcactaattaaatacatgatagattcttcttcctttaaaggaaaagttataacacaaatagatacaacctgcttacttggttttaaaattgtgtccaacataagtttacttgtagaaacaaagtctccaagttagtcaaaagcatatgatattgcctcctgatgttcagcaggctttttccccctagatgcatgctcctggcatgaagaagatcaagttagacactccagaggaaattgcacggtggagggaagaaagaaggaagtgagtagagttcagaactggtgaaataactgttttactgtgacaaggcttattaatgtagttaaattcattgaattcccttagaatgttggaactagggaagaggaccataaggcatattatgtaagactattattgaacgtagttttaggaagacctaataagaactcttcatttaagtagcaaatgtgtcataatgggactgtatgttgctctttgaggggggctactgcatgtcacctgtcagatgttcagtggttgaggcaataatgggtgggtactcttaccaaaaagtgtattatacagaagtgtattatcacagaacagtacatctggcacatgactacccatgtcagtggatttaaactgaaaccttaaactaaggtgagctaagtacaaatgtaacctgctgctcaaaggagtttgaagtatctttcttgatctttaaggatagttcttcttgttttcatcccaggcttaccgctaaataagatgcacaggtgctaaggataagagatacaggtgcttgttcttaacaatgagaagatcaggaattcattcctatgattaaagaaatttgagcatcaccatgtaacctgtggttttacacttact

SEQ ID NO: 73174 - DNA, 1156 bp, Homo sapiens
ttaaaattatgcctgggtttcactaatatatttgttaaaaacaaaatgaaagaaagaaatagaataatctcttcattggaaatatactcacaagcttctcccacacgaaagggttattggaaacatcaaagtgtgtattactagaatgatagttatgtttttattattgattacagatttttcaccaaaagcctaattcctctctgtttttgtttgcagaaaagaaaggaaccagtttttcactttttttgtgatacctgtgatcgtggttttaaaaatcaagaaaagtatgacaaacacatgtctgaacatacaaaagtaggttttcttagttgtcctgaaactgatgtagcaattgtgcttcttctatctgtatatttggtagaaatgccaagcttgttttcctttaaagtttatagtttctgtagagatatagtttgacaacttgacagataggggcagtgaccctggggtttgaaagtggggatcccgctgcttcagggacgaggtaagatggtagcaaagaagggagctctgacagctttttgtatgtgtgtacctctactgcttgggaagaggctgtcctctcctctagttaccttgtgcatcttaatgagttctttcccctttaagtctgcccttgaccattaaaccatactgtgtaatgtggctgtgcctatcaccctcaaaggctggtccacaccttgtcaggtactagctagaaaactttaaccaaaatgtttaaaaggtttaaaaggaagcctttggttttgaaaggttctttttctgtttttgggaatgcccctcaactttaggaattaagagcatttcacaggtttattgatgtatgcctttgctcaaatggagaagtaaataagatatattattgtgccacatactctgagagtgtcattcctttgcctaaaggcagccctgttttggagtcatttttgtatgcagagataatactatacagatgggataactatgtaatacagccagaatatgtctgtgtatgtatagtggggtaaatttaacatggaaaacatttgttaaatagttttttttttcttttaaaaactcatagtgccctgaattagattgctcttttactgcacacgagaagattgtccagttccattggagaaatgtaagt

SEQ ID NO: 73175 - DNA, 1071 bp, Homo sapiens
gccctaacgtgggagtcagctcgggagacgcatgccacccgataggagtctcgaaatcactagtcggctcagccataccactggcgggtccggagtctagcacgcgactgtggagcaagcattaggcgtcacttcctttaccgtgaactacaaggctcagccaaccacaggctttacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctggtaagcggcggcgtctccgctgcccaccaggcccatctacccactccctggccgggccctgctcgctgaagaaagtcggaggcctaggagggcggaggagtggggagtgggcgcggcctgacccgagagaacttttctcttcccaaacagtagcaggggggaggaggctgggggaccctcctagaaacgagctttggcgtggtttggcttcgtgatgataatacattctcatttagccttaatatgagctgcacgctgccctaactgactgatacccactcagtcatttaagccgtataagaaaaaaactattttcccatgttgcaaatgggtacgcccaagcccatgccagtgtctagatcatactgctagcaagtgatggagcgcgacttagaaggaagcggttctcttaacctctgtgccatattgccttctgattacaagaaccttgcagatcctgttctctccagcccccgacctgccttcctagcctctcattctgttattgcatctgacaaacacagcccaatactcaatccagtctgagttgctgcgcaattccttaacgctctaggcttctgggcttcctctggttgcattcctaaacataactgacaaacttctccccatccttcaaggcccaacttaaatgtcacaccaataaaacctttccagattccccgaagcat

SEQ ID NO: 73176 - DNA, 1006 bp, Homo sapiens
tgggaacccagactttctgactgtcagtactgttatttcccctgccaggatgcctgtctgtggggttctgatagaacatggtgcaacctggaaattttagcttaggacttcagtgccatctgggttggtaacactggcacagtgacaactatggaaaaaacatttgtacaaaagcaaggatgaagaatcttaaaagtgtgaaagagagcatttttttattttttatttttatctttttaattttttccttcataaagtaaggctgtctccttttaagacccagtgttaaggcaagtctctcttttgaagtgatgacagttgcctcattatttggcagtagggcagctggaaagaaaatgcactttgacatcaagtagaccagggtttaaactctagctcagccacttactaattgtgttaatcttggacatgattttgctcatcttaaaagtggagtgacttacactgaccaggattgttttaaggaaacagatgcactgcttgaaatatggttagcacggtacccttttccctttctgtgggtcttaatgaactagctgcattcttctacagttccacatcattactgaggacaatgtatagatttttaatactgccatgttatatagaccacagattgctggcattgtctgcacatgctatatatgtccttagaagaactcaatttctactttggtagttctgaccataattataatgcccctaaggtatctttcacgggataatgaatctcaaaactgaaggaaagccaaggcacaaaataaaaaaagaccatcacagattttagtacatcaatttttttaaaacattgccatttttatttaatatagttctttttaggaagtgtgcatatgccagtgtcacaaagattgagaattattggcttagtctctaattattgactaacaagtagaaaagtcaaatgtgaaaattaggtttttaaaagacgtctagcagaaagatactaggtaatactagtaaaaat

SEQ ID NO: 73177 - DNA, 1112 bp, Homo sapiens
atcaattgtttttgctcagactttgtcttactagatacatctgaaaatgtgaacacctaccctagctaagaagaaaaaaaattgagggaattaagggaaaaagagaacgacagaaaactgaaaggaacaaaaattatcttagcttatggaacatgccaacatatgctgcacaggccttgaattttgccacatccgtgttcttactacttttcttttacctttgtttttgcttcagcctgacagtgcctttccttcctatccgtccatttagccttcaaagaccagcacgtctatgaagtgacaatatgattgctctttctttcacaccccgttcttggtttgtactctgatgtttagtatttaaataaccataatgcttttcattacatattttctttataaatgctgtcttggatttggaaaaaaaaaaactactggggtttgtaaatagccctccttaatgtgcaccattactatctattccgtttcatggtcatattctgtcaataatctatatacaaactatagtttttatttctgctctcctgctctctccaggaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataagtaagtatatttcagtgaggtatattttaatactgatcaatgtgaacttttctaaatactctattgtctttaataattgtgctgaaatctatttccttttataatagattaaaaattttatatttttataagtaaacagtgatttttgaaaagtcagccttgtgggatgaaaaatatgtcttactggaaaaatccctcataataacctaatagggcattgctattaaaaatgctaaaataaaaattcagcttatgagaaatggcaaaggaaggtgtggtttgatacttgagtaaatatgcatgctttattaaagatgaagaaaggcttgctggtt

SEQ ID NO: 73178 - DNA, 1045 bp, Homo sapiens
aaaactaaccaggtgcagtggagcacacctatagtcccagctactcagcaggctgaggtgggaggatcccttgagcccaggaattcaaggcagcagtgagctgtgattgtgccattgcactccagtctgggcaacaaagtgagacctcgtctctttagaaaaaaaaaaagaggccagtggctcacacctgtaatcccagcactttgggagggtgaggcgggtggatcacctgaggtcaggagttcgagaccagcctgaacaacatggtgaaaccccatctctattaaaaatatatatatataaaaattagccaggtgtggtggcacgtgcctgtaatctcagctacttgggagcctgaggcaggagaattgcttgaacccgggaggtggaggttacagtgagccgagatcgtgccactgcactctagcctaggtgacaagatcgagagactctgtctcaaaaaagaaagaaaaagagaagaaaagaaattacataaaagctgaggttgcttcttaatatctttatgatttttaattgtattaaacctatatcaatattcaaatgtgatttttgaggaaaatatgttaaatttagaaatattttccaacttactgagttttcttattcttacctcagggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttactgtaaa

SEQ ID NO: 73179 - DNA, 1042 bp, Homo sapiens
ggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactggtaagtaaacggtggggttattgggtttagcaagtggggaagtaaggggtgaacaaaacacgagagatggtggctacacccctactaagactgccttaccagataaatgaaatcctttttgtattaggcacaacatggtaaattaagtcttgctctaaaaaaaaagaaaaagaaaaaagagaaaagccctgatctaagagtttttagatgctagcaaccttgtttagatgtagatcttgtttagatgtagcaaccacttgacatttaatttatcatcttaaccttgaatgattctttgttttgttttttgttattgagatggagtctcactcttgctgcccaggctggagtgcagtggcgtgatctcggctcactgcaacctccacctcccgagttcaagcgattcttctgcctcagcctcccaagtagctgggactacaggcgcccaccaccgtgcccagctaatttttgtatttttagtagagacggggtttcaccatgttagtcaggctggtctcgaactcctgacctcaggtgatccgcccacctcagcctcccaaagtgctgggattacaggcgtgagccaccgcgcctggcctgaatgattctttgtatta

SEQ ID NO: 73180 - DNA, 1652 bp, Homo sapiens
atcccagtgcccatttgtgctaatgacgttggccagggacgccaatttactaccctgaccctgtccttcaaatattgtctctctctccttggctagggttggacatgttctgacacctttcgtctctttgaaccccatttttccgttctgataatctttttcttcagttatgctgaccatgtctttaaatacattgctaacgttttagctcatcccaccctacgttttaatccctcagatgcagacatcgcggacagccacgcccactcaagaaatttccgaaacagaaagtttgtctgcaacagcgcgccgtactgacgtagcagtgcgcaggcgcagtcccggctcctggcggcgtgttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggtaatgttcgcgagtctcccacttgcgctcctcctaacacaagtatagtttaagtaacttgagcctatcccgctccgtgcgcctcttaaagttcttttacggctatctcgttagagcttcacacattttgagaggcaggagtcattgttgtatctgtttgcagacgaggaattagtttagggacgcaaagtgtctttcagccagttactactctgaatctgcctggactagatctctttctcacggctttcctggaatcttgtcttggtgtccccagatttggacggtgcattttatcccagactgaagaattccttgtatcttcccttggtgaaactggttttagccatgagcctgcgtgaggtagttgaatgtctactttctgtacagttttctcggccagaaagtaggactggtccctgcctactcttaaaagtgttctcttaggttgatggtccttaatgaagctctcaaaagaggcgagagagccccaaactcacagaaggagaggtcattggactggagtattcttttagagcacatttgggtctcgtgaaactggccgtcaataaacgttttatgtgaagacagcaattttggttagctcacagtaagcactatttgtgctttattgtttcatattggggagtgttttctcctaggggagtttcataatacttaagcatattcaaaatgtgatcctgaaagtcgttgaaacttaaaatgtaaggacttttggtttcttaatgctttaactgttttatcacatggctgagttctcgtcaattaaatctaagaggtctttcttgtcggccttcctaaaacagcccccttgtgatcatttgctaacacgacagatgtgtattacattcttcaaagcacttttcacagtgtagagtgattttgtgttcatatgttcaaagttggttacctctgtctttccaacacacagaatcacattccatgagaacaggatctttgcctgtcatacccagaatagtgtttggcgcatggtaattactcaacaaatagatgatgaataaatgcatgacctctcattcttcagccct

SEQ ID NO: 73181 - DNA, 1574 bp, Homo sapiens
ctgttactatagtgagtgctgttctcttctgagaagccttttctgatagcctttctcttctgtgacctttaattggacttatttgggaagataagttggtgctttattattgttaggttatttgacctatgttagttttgtgttgccacctcgattaagttctttgagagctaaaatcattttttacgtgtcttagtattttatatagtgtaaaacatacagtagtaacttgataatgatcccttattagaggcagaaaataaaaatagaagcaatatatcattttatgtttgaaaagatgttagcatctaaaatagacttattagtgttttactttgttttaggttcctaaatatttgtcacagcaatgggctaaagcctctggaagaggtgaagttgggaaactgcggattgccaagtaagttatttacatattcttgacattttaaaaagctatttttgaaatttttataagtgcttttaaaagtgattataatttctgatcagagtttacttggaaaatgacaagtaatgagcatgtcaaggcttgtcaggagatggttaggtgccctgtaaggagacatccttgcacatacacacatatccccacacccacactcctagtgactggtggtataaatataatatcaagtttattggtttaccttaatggcggtgaagcagcagattatgtagttctttcacccctccatcctgtctgcctccttgagcaggtttgcttaggctgggtataactggatgcaccaaggaaagtacttgcagcaggactttgccactgtaccactgggcctacttataggggctttggaagtgggtggggagtatctagaaaacagtgtaacaatatagttttctggttgaggaaatggccttgttagaaaggaaagcctctaaagctcagctagtgtcagctggaggccttgtgttccattctttctatccattcattcttaaccaactccattcagattcgtatgtccatgattccattgaaacagctcttgtctgttactggtatcttcctctttatcaattagcttttgcttcataacaaaccatcccaaaacttagtggcttagaacaaaagccattttatttgctgataattctatggatcaattctggttggggctggcctgggcggccttcctggcaaggatgtcctcacttgtatgtggtggttgagttgacattagcaggggcaacagctatttatttcatctctagcaagctcattcacatgatggtgaaagagttctagtaggaaaagaggaagccccagtgcacaagcactttgaaagcctgtgcttgtgtcacatttgctaaagtccttttgaccaaagcagctcacatggccaagcccagattcagttatgggaaaacagactccaccttttgatggaagctgctgcaaaaaaaacttgtgttccttatttatttatttatttatttcaaaatatggaatacttcctaattcgcatgtcatccttgtgcaggggccatgctcatcttctctgtattgttccaattttagtatatgctgctgaggcgag

SEQ ID NO: 73182 - DNA, 1054 bp, Homo sapiens
taggggaagtatgaataggaattaaaacaaggcctggtgcggtggcttatatctgtaatctcagcactttgcgaggccaaggcaggaggatcacttgagtctaggagttcgaaaccagctggggcaacatagtgagaccctgtctctacaaaaataaaaataaatgttagctagataaggtaatgagcgcctgtggtcccagccactccagaggctgaggtgggaggatcacttcagcccaggaagtcaaggctgcagtaagccatcatcatgccactgcactctagcctgggtgacaggtcaagaccctgtcacaaaaagaaaacaaaacaaaaccaacaagagccaacagttgaataatgatattgttttattaacctggaaaaggtgttgcttattgcctgttagtgaaaagccaggccccattggtaccaaatccaagaagtattttaaaagtgtaagaaaaaggaaagacatgattaatacaaattaagaaaggcaacaggaatgagaccggaatctaaaaaagtagctgtggggtattgagaaatagactcagagtagtaaaggagaaaatgcacagcattctgagaaatttagtgaaaggatggccagatgtttacttcattaatttctgaagatagcactgtattgtacaataattagcatttaaaattttgcacacaggtcatcatacaaagggtatattatagttgtaatgtagaataacaaaaggttatgtgtacttcatacattcacacaccaagacaagggaatatgtcattcttttaaaataagttttaagtcttcaaggattagctttttttcctagagagtattaactcatctagagctcatcaatctatcattccaattaagatgctgttataattatatatgtgtgaaaatgaaattgtcctctcctcctgtgttccctgattgcatctagttaccaagactgaaaatgtcaacatgatctttaattcatcttttttcctatgctgcccacttccagtcatttcctcttctcttagttttaacaatttaatgacct

SEQ ID NO: 73183 - DNA, 2024 bp, Homo sapiens
tgctgcaaaggatgtgattctgttatttttttattagccccattattctgacaaatgggaatagattatctttctctcttttgttttttttaagagacagggtcttgctttgttgccaaggttggagtgcaatggctgttcatagtgagctacagcctggaactcctggcccaaggaatcctcttgcctcagcctcccaagtagcggggattataggtgtgcaccaatgtgtccagtttatattctctttttatgaccaagtattaaggagtttttaataaagtgtttaatgaaatgactggaaaacacatttaaaaacaatttgatttataacaaaaatttatatatatatagtttgaatacagaagtctgttataatctctggttaatgtgtctattaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcaggtaagtgggaatggaattatttaatgtgattcctgtacattttgtatagattttctgtctcaacatacactcctatttgctttttttttttttttttttttgcgatggagtttcgctcttgttgcccaggctgaagtccaatggcacgatcttggctcactgcaacctccatctcctgggttcaagtgattctcctgcctcagccccccgagtagctgggattacaggcatgcgccaccatgcctggctaattgtgtgtttttagtagagacgaggtttctccatgttggtcaggctggtctctaactccctacctcaggtgatctgcccaccttggcctcccaaagtgctgggattacaggcgtgagccaccgcacccagcctcctgtttgcttttttaaggtcattaccaatactgttccatctctcattttgtctacctctgttattcatactatgctacttctctgctctgtgtactttcttgtgattaatgaaattttggccattacttgagaagggtttaatttccatttgggatatgaagatgtagaacaaagcagatggaagaatgtggttcatcaagctgccttctaagatgttgaagaaatagtattctgaattttgccaagataaggtcatccttgcttgttttagtaaattgatattcagcaagtatgagttgtacttaaaaaatacagtttgatattagggaatattttagtctgaatttttcaacttgtatgctttgtataccaagagggcctttttattgcatagagataacttttaattgacactggcttccaagaagtttctgcgtagagttttaagattgtatgtgtttgcaatgagatattttaacagttcaatagatcagaagcaaatgtttccatttgtgaattaaatacagagagaactttcttgtggcacacactcagcttgagtatattttccttgttttgggatttttatctgtcactgagtttagaatactattaaagcaacaggccaccttagcttaatggagctaattttctcctatctagttcaaaaagcttattgacaaaagaaaacatttgtgattttgttgtatttcatcaagcatttcaaagaaagctataagaaattatagtatgttaagaacaccattgtttaaaaaaaggaacatcctcgtaaatttttttttttttttttgagacgtagtcttgctctgtcgcccagctggagtgcagtggagagatctcggctcactgcaagctccgcctaccgggttcacgccattctcctgcctcagcctcctgaatagctgggactacaggtgcccgccaccatgcccggctaatttttttttttttttgtatttttagtagagacggggtttcaccgtgttagccaggatggtctcgatctcctgacctcgtgatccgcccgcctcggcctcccggagtgctgggattacaggcatgagccaccgg

SEQ ID NO: 73184 - DNA, 2687 bp, Homo sapiens
ttaaaatgttagatgtatgttgtatatgtgcgttcttttctataggatggtaccagagctttcattggaatctcagaggaatctgtggcccagaaaagctacagaaccactaccctagttttaaccttggttggtcatgaacctgccaaagtataagtgactaagccattttacagggagtaagctgttgattttacattgaaatataaatgaagtaggcattatctgggatatttctacattttctatcaagtatagaactgtacctgcttttctaggctctttgtttctttttattagtgcacaggtctataaaatgtagagtttgtaaggaaacttgaaaccacattttagttcagtgtgttaggagttttagttttaataactttactcctgttaatgtgattttgctggtttttgagaggtctcctttgagcccattttcctaatgattgaatttggcacactgggtatcttttagggagagcgaattagaggagactaatgattaagttatacagtgttttctcattaattaaaataatctgcatgtcatcaacattttatgaactcagttaatttctttctaattcagtgttcctgtctgagagaatatattttatttttatgggctattttgggttaccctttcttccacttctgctttcctctatgaaattcaaaatgatctattaatatttttctgttattttcatggagctcgcttatccattacccttatctctgtggaaatacctcatgtgtttggccttacatttccctgccttgggtcttcagtttagtatttgtatttactatttattggtaaccatagatcatttctatttttcctgcctttggcatcctctttggcattcctacttttattcaaagttagattttcttcttttttttttagaggcagtgtctcactgtgttgcccaggctgaacttctgggcccaagtgatcctcccacctcagcctcctgagtagctgggactacaggcgtgcaccaccatgtctggctcttagatattattatttataactgccaactctagacaaaaatgttcattcatctgttcaatagatatttttggtgctaagccctgtgctagaataagattagcctcctgtgcactgaggcaactggtaagtgaataaatgctacaaatgctctaatggagatatgtacaaagaggaaaaaagcatgtgtactttgcctgagggaactggcttcagaagtggagataatatttgagctggaccttgaagtatatgaataggatgaaagatagtgaggataaattcatttttctagccttcaaggatccaattcttcacttggcattcttttacctgtcatcctctgtcatagctatctaaaagttcattaaataaaaattcattaaagcaaaaaacttagctgtggatgtcacagactaggttagagatgaaaaaagttttaattggtgcaatgggagtggaaaagatagaacatgggataatagaggtaatttttttttaatcttttttgccatcaggtaagtcgaccagaattagaggttattttgacagcttttggtgatgaatcggctgtgaggaaattggaagattgagaagcctagagtggtttccgtgctttttttggcctgagcatctggagggatagtgaaaccattactgaattagaaaatattcaaagaaatgggcaggcttagagctgataacgcagtgacttttttgctttcatttttcattatctttgacgcctttgtagcagttcattaattcaataaattaacatttgtgcctggttttttcaggcccccttttaggcttgggatgctttaacaagcaaaggcttagcccttgtggtgcttacattttactaagaggagacaacagtaaacataagtaaattatattgctggctagaagttgataaattttctgggaataaagtgggaagtaggctcgggagtatcaggttgggggtgggacctcattgagaaggtgaaatttgaacagtcttgaaggaggcaaaaggggtagccatgtggagtgagttagccagctaggagtttttaaggcagacagagaacagtaatgactaatgctccaagttgggaacaagactggcatgttcacggagtggccaagaggtcagtgtggataaagtagatgagcaagggggaagagtagtgggctaattaggttagggaagaagggtggatgttggcagtggcagatcatgaaaagatttctaaactataaaaagtattttggattttacttttagtgaagtgggaagtcactggagagatttaagcagaatagtgatataatttgatttacatgttaaagacctactctgactggtaggttgagaagagaccatggagtcggggcagggctggaaccgggaggctcttatagtaatccaggggagacatgacagaagcttggattagagtggtagcagtgacagagatctactcactcacctgatatccagctttatatctttagttgtgttaacagacagtccacttggattctttttttggtggggagagatgggtctcatcctgggctcaggcagtcctcccacctcagcctctcgagtagctggaactacagtcgcatgccaccatgcctggctagttttttatttttttgtttt

SEQ ID NO: 73185 - DNA, 1037 bp, Homo sapiens
tcgattttccaaaaaaatagtgggaagagtgccattttgcaggcatcattaatgtctgacagcttaagacaagctggattttcatctctacttctgtattcaatctgtaaagatctgctgttttggttgaagtatctgaagaaaatctacctcttataaatacatagttggaaaagggaggagtaattagtagcattttcagatagttgtggacattcttttgctactacactaaaactctgcaagtggtagtttcttaaaggtcacttgcagtatagaatctgaaactattagcaaaccttttctactctcttacattaaattcacaggtctgtcttgtatttggaatgaatctcttacccagacatgattttgtagcatcatacatccatcatctggagactattggtttcctgaattatgtagttcttttgaatgttgacacgtttcattatagaatatcaaaaatttacattcattagcatcactactgattttatcagaaaagtttttaaatataggggagctgttaagtttatggtgataggtacaagttcttcagactttaattttcacttaaaaagttgaattttattaatgacaacaaatcctgtcagctgttttttttttttttaaaggatgggcttttttcattgatttttgaaaaaatatctttcagatacccaaatctgaataattatgctttgtctgtcagtcattctttcaagtaacaatgatcttccacaacaaaagtagctagctcagcactcaactcaaacagttgcaactatgcttttctttgaggcaatcatcttatgttagtgtccagcagaagcatttcatgtgcatttgccatttggtgtcacagaatgttaaaggatgcatactcaagggttgaaatttaataaaaacagtttttactgttcatcaaggacattgtgaagtgaaacagactttttaaaaaattgcaagtgctaggtggtgaagaatacacctagcactttagtgtagtagcaaaacagtgatacagttttggt

SEQ ID NO: 73186 - DNA, 1021 bp, Homo sapiens
aatattaaggtttggaatcacaaacttattaaaacttatgatttactctccagtttttaattgtgaaatatttcaaacctacagaaaagtatagtgaatagtttaacctatgcctaacagctgtatttcataagtgttgacatttgccatatttctttaaagctagaaaacattttagatttctccccaccccccaccccctaacccttacctcacttgctagaggtaactgttgtcctggagttggcgtgtattattgtgactcattatgactagtctgcaattctcaaaacaaaatctttatagtttaactggtggaaactaaccaagttccttggagatgtgttaggcaatgtgctccaaatttctaacaattgtggaagtccagtgtttagcttgagtagagatttttttgtgtcatacctggagaaaatgacaggctatacaaacatatttctcttcttccttttgattttctgtagcttccagtttataaagtcggttctttgttttgattcattgtatacttaagatcttaggaagaacttggtttctttgtaaaaccaaacctaacttagtaaaatcaattaaaatgtaaattacttcagcgtgggcaacatggtgattccccatctctactaaaaataaaaaaaattagccaggcatggtggcgcacgcttgtagcaccagctgttctggaggctgaggcaggagaattgcttgaacccaggaggcggaggttgcagtgagccgagatagcgccactgcactccagcctgggcgacagagtgagactctgtctcaaaaaaaaagaaaaaaagtaaattacttagtcgcggtattaaaactaagtaattgaaacaattgtaattttaaaatactttaattttaaaaatttcatttcctttggctttttcaaataacattgccactatttttaaaaacctcattcaaggttatagtagcatgattttttctctagttctttgagcataagggtaccattatcaaaatttaaagt

SEQ ID NO: 73187 - DNA, 1032 bp, Homo sapiens
tacataaccataaggtcattatgatacctaaaaaaattaacaattccaaaatatcatggtagatctagtcactgggaactatgtgatgcttaaatttcagtgttttctgatattttttcccttttaaatacattctgttttctggtttatggtccaactctatcagaagtcaccatggattgcagttatataggttatagcatcccctggtgaagatgcacttcgtcaagtcattcatgttactatgaagacatgatgcagtctttctgcagaactgtttgagggatttggctgataaggaaatgacagaatagaaaattatttctggaatagtactgaggtactgatgtcaaactggagccagtgttagggaaagtacgaaagctgtgttcactgagcttcatatggattgttttcagattgcatcaagttaaagttaacaagcagatgagtttagaaagaaaatcttgtcaatccactatgaccagactttagggaatagggggctttaaaataaaagtcaaagtaaaatagaagtaggtggtatgagaattcgtatgatgaatggaataaaaaatgttatttaatgtaatagagtgaatatgaatagggactatattggtatatcccagtagggacattatatacaacttgtatacaagcctcaatttagagtatgaatttcttccctggaatattgataaataattgagaaaccaattttgtcttgagtttaaaatctcttgaaagttaggtccatttatatatctttaatacaaaactgactaattaaacatgtttaagttctgaaagaaaaccttattcttatatgttcctaccagccgttagacagctgtggcctgcccagaagcgaaactctggtagtggccagcacactttgaaagactgctctgtttaaaaagaaatgcagttgaagtcttttttttttttttttaaagaacttcgtgtatgtgtatcagcccacaaattcttgcttatacagactgtatcattagctatttcaaaataata

SEQ ID NO: 73188 - DNA, 1049 bp, Homo sapiens
gaactcctgggctcaagtgatcctccatccttggcctttgaaagtgcctggattataggtgcgacaccccgcttagcccattattttctacatacctgtcacctagtgaattttatagtatacctaaaaatgttgtattctgtaacagcaagaaatatatttgaagctcctttttcttctgtcttattaaggacaatctgcctgatatccagataatccaaattttccttaagacacaaagaaagagcagagggaaatataactgggaaccaaaatgtattttaatatagcctgcttccacttttcaaggtagctgaattttatgttctaaatctcaatgtgttagattttggctgtgttgtaacaccaacttataatatgttgtaaacttatacatattgtaagcacatgtagacttacacatgttgtaaatgcctgcggttgtgtttggttttagttttcgttttgttgttttataaatctatcacccacaacctttagctattgtacaacatggtgaatatacccagtaacaatgtattatatacttttaagtgttcttaccacaaaactaagtatataaggtaatatatatgttaattagtttgattagccactccataatatatgcatattccagaacatgttgtataccataaatgtatacaaattttatcaattaaagattgttttttaagaaagaaaatgcactaaatcatttatgacttttagattcttctgtttggtgtctctctccagttatctcacctttattagtaattatttccatacacagctatgcacagtctttcttttttctttctagatggatttctcttaaaatatctttgcgtagatagaaaaaaatatgtaaaaatcaaaatagttttgttaggatataggattatggtatcttcattcatatttttaacatggtttttttttttcttgaggcagaatctcattctgtagcccaggctggagtgcagtggcacgatctcggctcactgcaacctctgcctcctgggttcaaacgattcttgtgcctc

SEQ ID NO: 73189 - DNA, 1613 bp, Homo sapiens
ggagaccaaggcaggaggattgcttgagcccaggagtttgagaccagcctgggcaacaaagtgagactccatctctatgaaagtatatatttttttaaatttatattttaaaaatttaaaaggggtatgttttaattgtctcatttttaaatatccaattcagtatcttttctaaaataactggtggttgaaataaaactagaatttgtgtattttattatacaatgcttaatgtacatttctgcattgttagaaaagttttattaaatataggtcatttataacaacttatatgtgttcatgatttttgtttgctagaaaatattgaaccattatgtattttttaagagaagaagtagaaatacagtccacctcttcataaatttttttagccatattttagattcatcttaaatatttctctctgtccagcctattttcctttaccgccactcccttggtgtttgttgacagaaacaaattaattgtaatattatcttaagcaaaatatgattaggacgataagtcggctacagaagaagccattgtatattttaaagctaaatacaaatgatttctaagttgcatgctgttttggatagtcctccatattacatctttgttttgttagcaaggataattatgattcagatgctgtaattttaaccttgactaacatgcattgctgtttaaaatattcataatttattagattggcatgtctttaaaatagcattatcacatatgtaactccttactgattttatttatttgtttgagatgggagtctcactctgttgcccaggctggagtgcagtagcacaatctcagcttgctataaccacctcctgggttctagcgattctcatgccgcagcctcccaagtagctcagattacaggcacgcaccaccatgcccagctaatgtttatgtttctagtagagacagggtttcaccatgttggtcgtgctggtcttgaactcctgacctcaagtgatccacccgccttggcctcccaaagtgctgggattacaggtgtgagccactgtgcctggcccctgctgattttatattgctgacaaaacagctgctattattattttgttattgtagattttgacatgaagctagaaaataaaagtcccaagaaacctattatatctattttaaatgaatagaatgaaaaccatgcttgcctatagcaatttaaagtacagtcttgtgttttgtagtatctcatcacagaattaaacatgtgcttgttaaaagttctccattctattcatgtgtaagtagaaagcctaattaatgtaaatgtgcattttggggagacctgttcatggttatgccatgaaaatactttttactggacaagataataattagtgctttatcaaaagttcatgaaggtgaagtactttacatacaattcagaatttaatttaaaccttgcaaaagccctgtcaaatagttactattatccttattttactgtgaggatgttgaaattttaaaaagttaaggatcttgcttataatcatgtaagcaagttagtggaagttaatggaattagaacccaagtctaactcgagagcccatgtgtgtttcactgt

SEQ ID NO: 73190 - DNA, 1039 bp, Homo sapiens
agagcttctgcacagcaaaagaaactgtcatcagagtgaacaggcaacctacagaatgggagaaaatttttgcaatctatccatctgacaaatggctgatacccagaatctccaaagaacttaaacaaatctacaagaaaaaaacaaccccataaaaaagtgggcaaaggatatgaacagacacttctcaaaagaagacatttatgcagccaacagacatgtgattcacctgttttttaaatgacatgacattaaaaatattacttttctaaaattcagtttttcactcaatgttttaggaatacttgcattataaggttgtatcaagtgaggcaaacctatattttggtattctgtattcaacacctaccttgtgaatgcctgttttctgccacgttctaggtgttagggatataagtggcttgcaaaatcagacgtggtttctgttggctctggtacaggtatacctgggcttcaaatcctggttccacctctttataactatgtaatcttgggcaggttacttaaccccctaagtctctgtttcttcatcagtaaaaaggaaagaataattaatacctttcttagaattgtttgaggtttaattgagagaatgtatgttcctagcatggtatccggcatatagtaaaatgcttaataaatgttagctttttttatcaccctaaaagtaagtaacatttgaagtataagttttgtgggggtttttttgtttttgtttttgttttttttgagacagaatctcgctctgtcacctaggctggagtgcagtggtgcgatctcggctcaccacaacttccacctctcagttaaagcgatcctctcgcctcagcctcccaagtagctgggattacaagtgtatgccaccacgtgtggcaaattgaaatacaagtaattttctttaaaaaaaaaaaaaaaactgaataagctgattcagtaacatcatcttcagtctggcatggtagtcatcttccttgaattatttgaaaagtctcgtgtttcatttgttctgtataccacc

SEQ ID NO: 73191 - DNA, 1038 bp, Homo sapiens
agcttcactctgacttataagtgacattttgtgtgatttcttgagtttcttgaatggaaagtatttctgaatatatttagaaaatactaacattaaaatatagatattttctgtatacttagagcacaatatttaggcatttgaatatataaatccaagtacaagtaatttggaatttaaaaaggtacatttataaaaagttacaagggtggtcagtctagtcagatttccttctagattactaaattgttttagaacattgtgatttattagaagtgtgaggaggaattaaatgtgtccagatacaagttctaaaagatgctacataaaaatgaatctgatatttttaatggtttctatcaataataactttgttaagatagttaaattctcctctttggatttgataaaaaaccttacttgtaatgcttctaaggagatctgttcagctatatctcctgtaaaaagatatgtcagggttatttttattatccgtaatgaaatcttgtaagagaaaatcttgctctgacagtaaatcactacctttttttcattaccaaagtccaaatgccaaggaaaagtcaactcctaagttggagaggcatataaacagttcaattatagtggctattcaaataaattttacaattcttttcctgtttttatagttttgttcagtcttgattaagctgttttaaagtatgtaaaagataatgttttagtagaaatctgtttttcttagtatatataaaaatattatgtagctaatgtggaatttggtttttaaatgtgatttttgaaggaatttttttgtagaacagattttaaaaggtttcttttagcatatacagccaacttttacattacattagatgttataactagaagtcagttatagttctggaaatgaacattagctttacttattctaagtttttatgagtcatcaaacttttggcatatatgctaatttatgtaacctcagtcaagattttcagacatcttcttgagattattaaaattaagatttagttacca

SEQ ID NO: 73192 - DNA, 1848 bp, Homo sapiens
attaatacaatcaaagaaggtagcagtgcttttatttactttttattgtcatcaagcagttttctaggaattttcagcaaaataccaattcagctataagtctaatatgaaacacaggaactgtgaatataagcttttggtgcttgctatggaaaaatcaaatcaatagctttaatgtcttcttacaatctcattttgtttcactatagctctgttttagttagatctgcacatctgttttgctccaggtagttaattttgccagttcagtttctctgtagatttttgccatagtagaaaaggattttaaatattaatagccccttaaaatattttattaccatttacttaaatgaacgatagataatgtacatgctttcttttttgtgcaaatacccaagacaatctgaattgaaagacagcttaaggacaaataaatagcaaaagctttcagtctttatttacagtatatagaaggttactgttttcattttaggtggaagagtctgatcagtaggaacaccccagaggaaggacatctttagcgatagaatttacataccgttagctcacagtaattgattagtagcagggctctgtagtacagagctagctgggcatgttatttgggatgtctttgatgctgtggttttccgaagcttgctggctgcatgcttgttgcctttgttcgtgacacaggtaattacttgataaaatgaagtgcatcgctgtgaacaattgaccctttggaacaatccaggctggtcagcagtctaaagccacactttaaagccatcatgatagcctcaaacttaagagtttccaaggtacagacaaaggtgttgtcttcctttagtacaagtcgagtgccattttcagactttatgaagtatttaaattggatgatatttgacgatattgaaaactcctctggaaatccatccagcctgcttttggacaccagaacaatgcgagactttatttttgatatgaaatcaggagcattacagaagattcttaatccttgtgaacgatcgtggttatctgttatttccaagaaagtagtctctctgggtgttagctgttctttctcccacctggatttcacttcctctgccagtcccttgagctgaaagaattctgcttcttgtgcaagaagttgattttctcgaaacccttcgggcaatagaagttctccatttcgtaggaagtttaggacatgcctgaagaggagaccatccctgtctatgaaataatgaccatcagcatcaaacgggcagaggatttttccatttactataccttcaaggaaagtgtctgggtacttggtcagtgtttgtttttgagtaatgtataaatatccaccaacgttgagggtcatcagtgtggatttgcagttctttccttgatcagtatcttccaggctgttgtgtttcccttcatactccttttctttttctcttctgtttattttacgctccattttttgaagatgctatttcagcttgttcttcttggctttgagattttttaaaaagagacactaccacacaagcacgcctttattcagccccagcctggtgatggaatggaaacgctggcagcatcgcctgcgctgtcagctcggttttgcagtaggtggcgtatcagcctatgtatgcaggagctttctggagtaagacggaaaagagaatttgcatttaactgtatcagggaagggatttgttgtgaaaggattttcatgtctatcctttgaagtaataagagttactcagaataaattgaatttcctcttgtcagttaagcagatccaaatgtttaattcttcatccaaatgtgaatgtttaa

SEQ ID NO: 73193 - DNA, 1066 bp, Homo sapiens
ttgttgtagttttagtttttaatttatttttgtagagacaagtttttgccatgttgcccagacgggtctcaaactcctggattcaggtgatctgcccacctcagcctcccagagtgctgggattacaggcatgagctactgcgctgggccacactgttaaaagttagactttagtttatatttctcttgcattaaaagtattttaaaattatttaactgtatgttgacataggaatattggaagagattcttctaaaatgcatacttcttattttctttaaacaatattagattttcaggtataaaaaattatattcttatagtgatcttgaagttaacatttatgtattattgagatcaaaagttcgttgaaatcgaactagaaaactaaggcataatgtttttagagctgtgtttttgcttagagactgtgaaattcaacttcctcatttcaccaaagataacattgcattccagagaatttttagtattttatctaggacttcacagcaaagccaacattttgactaaaacgtcctttactcctgcagcacttaataagacttactcttatattctgacaatctcatgtttgtcttgattttgcttttttagattaagtcttttctgtcaatacaactttttaagaaatactgaatagattttgagggagaagggatacaactctggaagtacattcatggaattcttgtgttaccattacaaatagtcactgcacatgagtagcatcatataatagcaaaatcaaaaaggcataacaatttcatttataggtatagtcctctttttttgaactttataggataccagaattagtacaacataactgtagtatagtgatggagactgtgctagcatgttcttgtttaaataaagtgatgtggatagatactatgtactctgggtctgcttccttacaccctgtttggcctgtctatagatgtcttcatgggaagccccaatgctgttgctgttggaggataggcttccatgaggtgatgagaaggcaggagtgagtcaggacagctggaagtgggactgctga

SEQ ID NO: 73194 - DNA, 2102 bp, Homo sapiens
tcctaccatctgcataaggcagaactcattccagcaggaattcccatctttttaccaactccttatgggaaatgaggtctttgtcatcccgtgattgatgcaggacatcattgtaatatatacacttgctccatttatatgccagagatactcccatgccatggaaggaagtgaaaccttaccaggaggttatccctcccgactggaagatacaaaaagtatgataattctcctagacttaacagatcattcctctataaaattcagacactcttcaaggaaaaggaatggttttagaagctgcgtttgataagaacagggagcttctgtctccacattctcccctgctatcaaatcttggttgttgtcagctgcatgcttctctgcttgtcttttaaaaggatttcattcccattaccttagaaagaaagtaaaagctagagaagctgctgtcaactttttacttaaatctgacagtatatctctgccttggacttgcccacattttttttttgtttttttgtttattgatctgtgttttgaccttcctctgcctttcacaagctgagtttctttttttttaacatgtacttgcttcattgcctcttgtcaatagcactgaatgtaagaaacattcattttgatattgaggtatgaatattttgtgttggcttcttttgtgtgttaaaaataaaaattacactgtctaattattgacatgttttaagaatcaaggattttcccatgttaatgtaattctttttgagtgtccaaattttagttctattttgaaatataaaatttatctgctctaaatgttgtctgctactggtattacactaacaaaagtactatggcagccactttatgtaactgattgaccacagcatctcacaaactgtgccaagtacttgaaccttcctaggactaataggacgtaacctctggccacaaggtcgtgtgaacatgtcattgcagtccaaagaatacagctgtaaatattttgcagtgttgaactgcgtcttcaaggaagcccaggaaaattgcctacattggtaaatgttttagcttcatttgaggagtatagaaaaacataaggcactatgtgtcaaaaggagcacaaataaagacaacagactagctcagaagttcaggtgaaattccattccacatttctttgattttcactacagaggcaatcttgacaatttataagtcatattaattcatgttttacatgtactttggaaaatgagtatttcagggaaacctgtgttttataattttgtaagcagaagtcataccttaagttttttaaaaatgaagtttttttttgaaatataacctgtgcgttattatttactggaaaattctattgtaaccagatgagcatagcacttatgtaagccatcaaatgaacattaaaattataatattgtacagaactcatttttatagtgctatttggcaaaatgcaattttactttctctttgggaagaagatattttaagctaataaccattatctacaatctcaaaatgaagggcataactttgaaaactcttgtaaaggtagtacagttaggaagtaaatgactaaagagggtctctgttaccgtatactagcgcctgccactgttccttctgattttctcatcacttaacatctgcttgtgtcttcagtgatgaggtggtgtggagaagagagaagaggatctgaacaggagaacaggatgtgatggctcaagggagcaaatgtggtttcttacagagtagggaggagttataaactagggatggagaactctatcatatcacacatttttttcatatttaccatttctataactgaggtacatcttaatatcgttagcttgtcaaagtttagcagcagtattttgtcttggtggcacgtaaaataatggttgctattacaaatgatagcatcttatagttgatgaaatatttgagcagctctgtgagctattccctccgtatcacaagaaagtaaaattaacagacagggaggagggaaagaattttgcagggagatgagagagagagggagagacaaaacaatgtggctgcttgatgttaaaatt

SEQ ID NO: 73195 - DNA, 1046 bp, Homo sapiens
tctgcatcttcttgagatttgttgcatatgttgcattaagggaccctggatacattgattatatacggtgtgcttgtaattagttcgtacagagtctcctagattttggagacatccaaagatcactaaaaaaagattttttagtataaatatgtaggcatggttctatacactttctgcattttgatcaatttatctgtctcccccagtgaactgtatgcttcttgaaaacagtactgtgtcttaatcatcttgattccacaatgcctagatggggccttttgcatagcagacattttgctaatgttagtggaatgaagtaattctctctgaaaagatgaatcataaatgcactactcatgagccagggaatttcctgagtcttttcttaaaacccaggtgaattcttgtggaaatatgactgtttctaaccacagtcatacatttccagggtataaagctggtaccattatgagacatttatatgtgtattatacaataaggtaaggtctgtcaagtgaccacaccacaatgcttggtggccagtaggcacacaatagatgctagcctttgtttcctttttctgattctcctaggttttatgtcagagtcactataagaattactaaggataggggaaattgcctttctgtttggacaaatattcatagcagttaaagattctgttttgacatgcccagatttagaattctgcaggaaaacagaagtcagagcagctggcaggctgaactggtacacaatataacccagacagtagacctgcccagtgtcacagtattttctgggctggctgttttagtcacaaggtacttgagaattttattcacatacacaaacacacacacacacacacacacacacacacacacacacggtctttgatttagtggtttagactagctgtgttttcagaagttacttctttgtcaaagacgatagcctttatactctttaatttgattttatgcccttttaagctaccttatttagaaggagcagagtgtataaaagctgttcctggcaaa

SEQ ID NO: 73196 - DNA, 1013 bp, Homo sapiens
tttcagtatctgggctgtttatttgaggtattttaagctactttgttaatacatcctggaatcaaagtttttaaactacattttctagttgtctttataaattttgattctttaaagacatgtataagatctttgtaatattttattttccagggctgtaatttttccataataaatatgtatccgaaatactgtaactgggccaggcatggtggcacatgcctgtaatcccagcactttgggaggctgaggtaggtggaccattcaagcccaggagtttgagaccaacctgggcaacatggtgatatcctatctctacaaaaagatagaaaaattagctgggcgtggctgaggtgtgaggattgcttgggcctgggaagtgaaggctgcagtgagctgagagcatgccactgcactccagcctaggtgacccagtgagaccttgtctcaaaaaaaaaaaaaaaattgtactgtataaagcaagtgtagttgccagaatatcgtcctattctcttgatctatagagaaatttttataaacatatatactgtgttagagagtttgtttcaggatcttcccctgccccctaaatttttatgtggttaacattttgtaattagtatttaaaaatgctgattgtaaattcttgataccccaaattttatgacgttcaaagagtcagcaattttttaagccctgaggaaatatattatacctgtttcatagtttatttttaatgtgttttagccccatgtgatttagaattatactttttttgttcattcattcagtacttactgtctgccaggtgctttcttagaagtgagagaaatagctgtaaacaaagcaggcaaaaatctctgcgttcgtggaccttccattgtcgcagattgtaggtacactgaatcggtagtggagaagacactgctgaagtagtggtagtggcctgttggatatcagcattctcatctacataagaggccagttgagctggatcatctcaaaattttgca

SEQ ID NO: 73197 - DNA, 1009 bp, Homo sapiens
ttagtgtagatctagtcataccacttccctgcttattgcagttaaaataaaatgtacaaatcctgcatcatctggccttcagaactttgatctgatcctgaagcttttttaacctcttcttccactacacatctcattcattagacagcagccatagttgccaccttttatctgtcaaaaagaacaagtatagtcccatctcagggcccttctttctgtctaaacacatatctttcatcagatcttcagttggtagcccccttccaaccatgcagttctctcagtttatatggaacctcctcagatgggcctttctcgaccactgctgggtgaaatagtatagacttctccccaccgccgccactaccaccacctaattatgtgctatgacattactcaggtttattgtattcttaacacttaccattgtgtgactaccttaattaattaattatgacatactgactatatctccaccacctagcatagtgtctcatacataatagtgctcagtaagtattcattgcacgaatgaatgtttatcataacctttttagcctctttcattttaggagatttatctgaagttaacaatgtttttctgttaacaaaaggaatacatacaatacaaacaaaatcctttgggattttgtttatttgggaatttaacaagggcccttcccttgttaagttttttatttgttgagtccttataaaattgaattgacttttatttaatgtattccaagttaattttagaatctcaatgaaagaagcccccttctctttaaaatggcatgtctttagtataacatatcatgatacataaatgtactttagcttggataaggaattaaagatgtcatttcctgttagaactaaggttaatactataggatgagcacattttttttcccctcagaatcaatattgtaattccaagggttttacagcccaagcttcagaaatgcatgtaaacccattcagtaaaccttgaacatctattata

SEQ ID NO: 73198 - DNA, 1071 bp, Homo sapiens
ctatcagttattttcatcttgaataattttatggagacttcatctctataaaaaccttaaaaaagcagctgagggtggtgtgtgcctatagtcccagctacgcctgtagtctcagctactcctgtagtctcagctactcctgaggctgaggtgggccaatcacttgagtccaggaggtgcaggaggttgcagtgagctgagatgatgccactgccctccagcctaggtaacagagggagaccttgtctcaataaaaaaaaaaaaaaaaaaaaaaaagttgatttttataatccaaaatgatgcagttgtataggagaaacaaaacacgtgcgcatgcgtgcaccccttatgaggctaatacgaacaagaaatacataaaattaatttataaatctgttgtttaccaatcctgtcgggtacgcacaccaattttggagggagtgggggtggtgatggccaaatgctattgttcacagaattttcaattcttattacataattatattgaatgccatatggtgttttattgtagttcattaaattactagcagtttatacttctatttgtgttatcattaacgcatttcagtagcacattttttaaatacaaaactttagatattcctttttcataaaaaactattcaagatgaaaataactgatagaatactgcactatgacttttctagaagtaatcccccatgtcagctctaaatggtgaataaatgacagtactgtgctatacagtccttcaaatatataaaataagaattgttgctaagcatgttaacaaagaactaaaaatcttaaaggatgtcttgtcttgacaattatctctgttggtttggtacattaataccattttcccttcttgaaattctagaggagtaagttatttctagtagttgggttttcaaaatagttactaaactcctttaaaagtttgtaacttaaaatttttagttcactttaatgaatgaatatctttctaagctatattatatattaaactgtatccatacttcatgaagagtttgttgagaacataatctaactttctctgtaacttag

SEQ ID NO: 73199 - DNA, 1031 bp, Homo sapiens
attatttcatttttcaattttttctttctctttaaggtatataattatattgcctgcaaaagtatgttgacattttaaaagtatttattagcatatgaaatttagaagagcatattgagttgtatatagatatatattttcatattcaattaaaaatgtaagatacagtttccaggttattgatcagagatagatagtaacttatatattctgcttcagtttatccacagggagagcaaaattcagcattgaagaacctaggttataaggctggacagtttttctaagaatagcaaatgatttcacagacatatacatatgtgaaaacatcaaattgtaccctttatctacagcttatatgtcacttatatctcaaaacttttttaaaaaacaaatatcgcaaaacttttgcttgagttaggctttctctgtgatagtcttgcctttatttgctttcattgaagaattctttaaaagtttttactaatgtattttaaaaggaatatagatcagtagttaacatagtccctgataggtgacagacattctgaatgtattaaatggaatgtaattaaatgacatattgggttatttttccttctttaacaccatgctggtgctcactttttaggaggctgtgggaatcctgagtcctctgcagtagagagatgagtaaagtgcatggggaaatggcacaaatgcccagggaataagggaaaaattttctggggaggtgatggcccaagggatgagtttgccatacaaagaagggggactgaaggctagaaaacaaggtgacaaatcctaggaattaccagtgaagaatcctttgacgttccagaagctctttcatttggttgctagtctgtcttgcccacccctcctgtaggttgtagctttttccttttcatttcttgagcagtacctgacattgggccagacttacattaggcctccagaaacctcttgagatcagtggcatttgtccgcttaccatgctcacacaccgttcttccctttaaccgacgggc

SEQ ID NO: 73200 - DNA, 1045 bp, Homo sapiens
aaatatgtggtgctttacgaaccacatatttccaaattatattattttgtacaaacctagataaaccttaccttgactttgaaagcatatcaaggtcagtaatgtttaatttagtacattgttcagtgatgaaatggagttgccagttgttcttgtcacttcatgagatagtgttaaatgaattatttagtgttaaggaccctgctaaattattttaaacgattcaaagcgagttaaagtattttaagatttagttctttgttatattttcagttcatacattaacctttttagttttgaatcataagttgtcctcttttaattaaaacccttgtggttgccttttaaatgtatgatagaacagttaaatttttaaaatgagtttatttttaaaaaaaaaatcagtgttttcctttatgtaaaaggttaaatgctttgaggataaaaactgcatgacactgtatgagtgatgaaattggcttttagaattgtagaattaaaattgaaaggaaagtatgctgcataaacctgagtctggatgcagtggctacaaataaattcaagtgtaagagtgtgaccagaataagctaccgtttataaagaagcacttcactaaacaaactgaaaccctgaggaattttcaaattgtgaagtaatgggaacaatcatttaatatggaaggaaggagctagtgcatgcctccttccttggatgtctcataagatcaaatcgtggagatgactgaaacagggaagataatttagcggcaacataacagattaccatttagagaggccaaacccctgagagctgattgcattagaggaggatggggggccaagattaggacacaggtgtgttcagaaacaggctgacacttacttgtgtttcccacccactcccatcccccaccaagttaacacatttagctgtcccgacactttgtaaacattcctatatctgtcttcaatcttttttctctctctaaaggtttatctcttagaagctttgacataactttccttggaggaatcatttccaccta

SEQ ID NO: 73201 - DNA, 1033 bp, Homo sapiens
ttttatatattagttttcattgaataagaattatagaaataataactcttcatatttcactctgctaaacaagagtgttaataatgccttatattttttttcagattgcaaatagaagagtcttccaaaccagtgaggctatcacaacagctggacaaagttgtaacaaccaattacaaacctgttgctaatcatcaatacaatgtaagtcttctgcttgtctcttttcattcttttatatcttcattcttttctgtatcatagagtcttaggtttccaaagaacctgagaatttacacaccttgccatcaggtgcttgaattacagtacctgatctggacttagtaaggaatatgacaatttgctaaaagtacagaaaagatgttcactctacattgcaagttatatcatggcaaaaagaaggcaaccactgtttaaagtacccttgataaatttttacaaagaagtaaaacacttcaattctcaatgttgcaatgttgctgatgttttaaattacaatgtactaactaaatattagttttactatttttaaaaattattctatacctttgtgatgaaccataagaaagtttttaatgtgttaaaaaattttaaaggtcatggaacagcagtaatttttctcattgattattaagatcactttgcctgatttcagctttcacaggcattttaatggtctcatactaccatgcaaagtgaggaccatctgtacagtagtactcccttgtccacaattttaaaactttatgcagtttcagtgacccacagtcaactacagtcaaaaatattgaatggaaaattccagatgtaaacaattcataagttgtaagttgtgcaaccttctgagtagtatgatgaaacctagcaccatcttgctccatcccatccatgatgtgagtcattcctttgtccagtatatccacattgtatatgctacccacccattagtcacttagtagccctcttggttaacagatctattgacacatgataaaaagaaagaagaggctgg

SEQ ID NO: 73202 - DNA, 1068 bp, Homo sapiens
tcttgccaccccacccttaccaccaaggctagagttgaagacttgttgcaaaataactggcaaagtggcccttgacctttgtgagtgttgtaccttgttatattagcttagctattgctgatacaaagctatcacggtgttcaatgtatttaaaaactaagcatacagaacatgaatgcaaatcactgtattttgagagcaaaacgaaaacgtattttgtagttttgacaaaacttactcttaaaattatactctttcatccctttaaaattttttatcttgtgtatgcttatatctatttataaatacagtagtacgtttgtccagtttataaagatatatgcatagctcatgcttttaattttttgctcacaaaggtgtataatcaaagttatagagtcagctgatgcgtaaggttctttgcaactccctccaactttgaatccaagtaagggcgactctgtgtgttctggttgactttgtgaacatcgtatctagcctatgtaaatttcatagcattcttttatgtatttcatggcctcttataaactttctcataaggaattccttttcttctcataaggaatcatgtcctctgttgtctagacatttgttttcggtgttgctgtatactagaatcacctgggaagcttttaaagaagaaaaataggccgggtgcggtggctcacacctgtaatcccagcactttgggaggccaaggcaggtggattacctgaggtcagaagttcgagaccagcctgaccaacctggtaaaaccccgtctctactaaaagtacaaaattagctgggtattgtggcacatgcctgtaatcccagctacttgggaggctgaggcaggagaattgcttgaacccgggaggcggaggttgcagtgagccaaggtcatgccactgcactccagtctgggcaacaagagcgaaactccatctcaaaaaaaacaaaacaaaacagaaaaataccctcagaaactgatttggttaatctaatggggaggccagccatcttaagtttttaagcttcttgggtaattctagtatgcagccactg

SEQ ID NO: 73203 - DNA, 1047 bp, Homo sapiens
tatatgctctgttcccttcagtgtggcagccgactgtgttagtctgcagaactaagatttggggtttgagtggttgatcttttaaagttctatgcataaatttgaattttcctaaataaaaaggatgtttgtaggactatatcatgagggcttttcagtaatatttgcctgttataatacatagtataagtatactacatgctttgtccatttgaatttgcacacaaaggactgaccaattctaaagaaataatttcctcccaagagataatgacacactaggcagaaatagaagcattagttgaggggagggggaataatatctcataaggatttaacatgcagaaccatgatattcaaagctgtcatgctcacttcaaaagttaaaaggctttacaaagactgccttgacaaaacacagtatttctgcaaacaataatctagaagtttatagatgtctgtattataaattttaattggtagtgggtggcatttataattttagtcagtgattacagcttcagtaatgatggttgaacatatatataccaaatccacaaaggattgtcaacatttggttgcattttagtcaagaataggctgggcgtggtggttcacacctgtaatcccagcactttcggaggctgaggcgggtggatcacttgagtttgagaccagccttgagtttgagaccagcctgggcagtatagccagacctacctcttcaaaaaaattttaaaaattggctgggtatggtggcatgcccctgtagttcctggagttcgagaccagcctggccaacgtggtgaaaccctgtctctaataaaaatacaaaaattagccaggcatggttgcacacgcctgtaatctcagctattcaagaggctgaggcaggagaatcacttgaacacgggagacggaggctgcagtgaggtgagattgcgccactgcactccagcctaagcaacagagtgagaccccatctcaaaaaagaaaaggtttgggggccgggtgcagtggctcaagccagtaatcccagcactttgg

SEQ ID NO: 73204 - DNA, 3157 bp, Homo sapiens
tcaagcacatccttgctaatttcaaaaactaccaggtaaataccttaagtatctggatcaaaggattgtacaattttaactgcaagagcaaaaattaagttgattaatcttcaattctatactagtattccaggtgtagaaagtggctttcccagctcgcaggtgtttccaaatcttgtcttctgattgaaaatttgcttcccagatgacatttctcagtttttctttttgtgaattgcttaaccacctaagtgttctttcagttttttgcttacaattttaatgtgtctcattgctactggtcctccttctaatgtatctgagcttgttaattctacttttggaaaatgtcagtggctttccctttcctctaattttccagcttcatgcatcccctggccataagatacttccagactgtatgatatattctatcactgtcagccttatgttccctgtggttgactatataagcacgctttagggtttgggattgtatttaggattgagagtaaaggtttcctgaaagcctagtgttcctggattgctctgtacgttatttttctatttaggtcactattaaggtgccttaatccagtgaacagatgtctatgataagtgagcatcagagcttttgggtactgaagttttgatttttgtggtggtctaaaccttcccttgtactgtagtttgttttgaatggcatgtatttgtatgtaatagtctaattctaggtattttgtttgcttcccaagttctttattggtgaaaacatgaatccagatggcatggttgctctattggactaccgtgaggatggtgtgaccccatatatgattttctttaaggatggtttagaaatggaaaaatgtgtaagtacaaggaagtgggttaaaataaataatgtaaaaaagacattttagatgtgatttgcaattgttttgtgacactgagaatgagttttacagcgttctgaaacatggttttagttttctctttggggatcaagagaattgtgtttcatatgtaaaaaattcttagggtataaaaaggcttagaatcttatttgtggaaaacgttgagtgcagatggggcataataaagtacagtttaggctgggtgtggtggctcacacctgtaatttcagcacttgggacgccgaggtgggtgcatcacctgaggttgggagttcgagaccagcctggccaacatggcgaaaccctatctctgctaaaaatacaaaaattagccaggcatggcagcgggcacctgtaatcccagctaatcgagagcctgaggcaggaaaatcacttaaacctgggaggggggttgcagtgagcagagatcccaccactgcactctatcctgggtgacagagtgaggtgctgtctcaaaaaaatacagtagagtttaaatgctgaaggagatcagagaacaccattgatcttcctctagatatggcctcactttcacttcataatcatattttgctgtatacgtatggatcagtatcagtggttttcactttggtttactgataatgggcagctgatcattgaaaagcctagtgcagtactagcttagtaaatagagctgactgctgaactggtatgcaaattgttttactaataataaataacttggtgtcttctatggaaggaactgctggaagctgtacagaaacaaaggcattcattatcctagttttcataggcttctgtataaggaagaagaaaaacataaagctatactgaacaagattagagtcaacagtagacagaaattacttagaacagtataagatgacttaccaaaggggttattcagacagtatctgaggtttttgttggtagagcagggtgtgggtggtacatgccacagccttctgaaaaatgagctaccgctgatttggtaagggtgttctgcatccactgatagaccttgaacaatttactgttgttcttttggtttgcactaggatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaagcaactttgtctcagcttatttcacataaagagagcgaagtcttttgggatgaatgttaattaaactccctggtaactagaacagggactggcaaactagcctatctgaccacctgttttgtacactttaaggtggttggttgcctttttaaatggttgaggggaaaagaataccttgtgggatatggaatttaagttcgagtccagttttattggaacgtggctatgcttattcatttatggattgactgtggctgttgtcagtgcatgagcagagttgtgtctaacagactagagcctgcaagtttgccagcccctgatttaaaagatgaaggtacacagaatgtgggctggctggtgggcaaaggggtaaaaatgttctctatattgtatctgaaaagatggggtgtctgaataagaaaatgcatctatttgacagacctggagcagttgctatctgctgctatggtttccaccacagatgcaagaagaaca

SEQ ID NO: 73205 - DNA, 1912 bp, Homo sapiens
cgcagggccaaagtttaattcctctaagctccacccagctcccagcacctctccaggcggccccgtggggtagggcggagccgggtccaacgtactccgcttcccccgctccacccacccagggctagggagcgccccgagagttggcctcctcccacgctgcgcgcgcacctccccgcccccacccctacccgctggcgtgcccagtggaacggagccttgtgtctccgcctcaagtccccggatgctcacctccccgactcgcccccgctgtggccccgcccccgcgcggctcttcgtgccacgtcaccgcctgcgtcgcttccggaggcgcagcgggcgatgacgtagagggacgtgccctctatatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccgtgagtcctcactgcactatccttactgccgcacacgggggtctggggtgcgggtgggggcggggaaggcgcagccgtcgcgggcctaggggacgccggcggtcttagccgagcgcggaggggtcggtgcccggggctcgcgcccagctctggtgtgctacggaggggcagatcccgcgtgcggccgccggcgcgggaaatgcgggaaatggcggcgccaggcgcacggtgatgggcggctctgtgtatccggcagacgatgagatgttctccgacatctacaagatccgggagatcgcggacgggttgtgcctggaggtggaggggaaggtgagtcggtcgggcctgcgcgtgggggagtccgggccgagcgggctcgggtttcctccgctcccccgcctgaggttgtgcaatcctccccgccgcctcctggcggaggagacgctctttccgggcttgggtttttctagaaaactggaggcggagctgatcctggaaataggcccgccgcctcggcgcccatcctcctcccggggttgtccgggacatgatgcttccggcttaggagcctggagtcctttcgtgtttgtcctgtccccacttaccaaccggaggcatcacatgcccgcaactggaaacaactttttaatgaccccattttttgttccggccaacagacaactcttttaagttaggtcgttttgagaaatccacgggtcacaactttattcccaaaatggtgctttttttattttcagcaagaactaagaatacttcttatccgtgaactattggcgtggaaggtgctttggatgcgtttgtgtcttttgcaattatactgctttttcttaatgcagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcgtaagtgatactggcagtacctagctgatgtctagaatcttacaggatttaaagattggctaacttttgaggttctttcgcagtgggtatacttttgtgaaagtccttgcttttttattaatgagttcacggaaaagagtggttgcttttctataatatgagcatactgaagcctgcagtctgtttccgtttagaattagaatagtattttgaaaatagtcaacaagaaatgtaaacattcttgaaagataccttctgtgaactagtaatttcttaacagctggttgcctttttcagtgttttctttttttaagcttggatattttt

SEQ ID NO: 73206 - DNA, 1479 bp, Homo sapiens
aagctgaccttggaagatagtttgatgtggttaagggtggaaccccttttatttaatcgtgtccatagcgtgggtctgcctgtacctatttgttattaagtgtgccatttgtaagtctgttgttatgcactggagttgtgaagatggcattttctgtgtcatccttaacccataaccacagttctttgtgacatacgagcagttgaagaaattggatttgtgacaagccaaggctgcatgagacatctttctgaaaatggtaacttctgaaacagcaaagcttcctgtgtttcactctgcttctcactgcttggctcatcacagattctgggatgtgagcaacagatgaagactgggttagttgagattgctgtgtgttggcattggatgctcttcatcaaacgtttaatggcataaactaacatccaaacactagtctttaccactgaagtgcccttcaacatcaaagataatatgtgaaatgcatgtttcttgctaaagaaaacttgcaagaaaatcaggagcgatgtattgttttattcagggagagtagctcctgatgcatctcagctcatgactgagaatcagactgctctagaaaagctcactggaaccatggaatggagcctccgagaaggtgttatggtttctgaatttctgggagattttgctccttgtcaactgaagaaatttcatgtatggagacctggactgttcaaccccaggtataaacggtgcaggaaatggatcctaggaatatcacactgctttatcatttcctattttggcaggatcttccacttataataagtgattttaagctttgaagacttgacatttgtgagaaattgttacaaagtaataatctctaaattcgtggtggtgttatgtgttggctttgaaggttgcaaggtctgtattggtggggggtgttttcaagcagcttaggttctgtcttaggtcatgttagtaattagctttatgatttttagcaaagcatatgtatttctcaatgagtaaaatggggataataacgtctattgatgtagagggtcaaatgaagaacaaatagtagctgctgctacttgactggaaaggtaaatgtgtttacatcatgctgtggaacagctctaaacagtctatgtagaagaggggcatgttctcatgggcttctcatggtaattgtgaatgaagccctttgttaaggtcttgttgaagaaagaacactgtataagttcaggctttagtacattttccttagcaaaatgttggtagtgaatcaaagagttgatttttccaggtttccagtttttactttagtttatgttgtgcctgtcttggactttctgtttagtttggatggaaaatacctgcttgaaattttaaaaatgatttctttagtgcatctatttagctagtttctgataggtggtatgtaatattttccctttttctttccttctgtagacacaataagtc

SEQ ID NO: 73207 - DNA, 1141 bp, Homo sapiens
agctgtcgctgggatttatcagctagtataatcggtgctaatatgtaagcagtttatcaagctctctagatatggctcttcttgacatgtttcatgttgatacatgttagttcaacatagttttggggctgggcatggtggctcatgcctgtaatcccagcactttgggaggccgaggtgggcagatcacttgaggtcaagagtctgagatcagcctggccaacatggcgaaaccccgtctctaataaaaatacaaaaaaaattagctggatgtggtagagtacacctgaaatcccagctacttgggaggctgaggcaggagaatcgcttgaacttgggaggcagaggttgcagtgagccaaggtcacaccattgcactccagcctgggcaacagagcaagacttcgtctcaaaaacaaaacaaaacaaaacaaaacacgaaaaccacaaacaagaaaaccccatagtttgggcagaagctgttttctgcctttgatggtggttgtagctcagtgatggttaacttttttttttttttccaatggtgtctttatagctcaagcttcacctgtggtctggcaggggccctggcctcaaaccctgttgatgttgtgaggacacgtatgatgaatcagagagtgcttcgagatggcagatgttctggctacacaggaaccctggattgcttgttacaggtaagagcagatgtctgtctctgcagggttgtgaattatatatttttttgatctaagaagtaactaaattatgaaagctactaaaactaagatgaatgatgctttaaagcccagagatgtacatgtgtgagaccatttttgccacactgtgcttagcttttataaatacaatgttgttttctttatacctccatctgctgtgaaaggtgaggaaatatttcctgtgattataaaagaactgggtctccttccaaaatgtactttcttcctgttgggtcaaactagtatgaatatccctcattcagacatctctgttaaaggaacacatcaatcttactttaattctcagtttaaataattgggcctcctgttttatgagtgggtgaaaggtttcacctgtctctgccactagattgccagtagtaggattaggagtcacttttttt

SEQ ID NO: 73208 - DNA, 1048 bp, Homo sapiens
tcattgagaataaatatgaggggctaggctttcacttagtgagctaataatttgcacatctggacccacctgtgtttttgttggattttgaattttacgaaatcgttttagaggccgggtgcagtggctcatgcctgtaatcccagcactttgggaggccgaggcctgaggtcaggagttcaagaccagcctgaccaacatggcgaaaccccgtctctactaaaaatacaaaaattagccaggtgtggtggcgggtgcccgtattcccagctactcgggaggctgaggcagaagaatcgcttgaacccgggaggcagaggttgcagtgagctgagatcaagccattgcactccagcctgggtgacagagcgaaactccgtctcaaaaaaaaaaaattgttttagagaatgtagtttgattatggatggcactctgcatgtgggttgcctagccgatgttaagtgatttttagattgcttttgtccctttgtacattggtttaacaggattgcccccgcgatgttacgccaggcatcctatggcaccatcaagataggcacttaccagagcttgaagcgactattcattgaacgcccagaaggtgagtggggaatctgttttccactgtggacaggaggttggttgtctgtctttttattcaagtggttttggagcaggttttcttcagcttatttgtgactttcctactgctacaagaactctgggtgtaaagtcttagttaattgtgctgaaagcaagttggttatcaactcaattgaggggagaaataatgaaaaggaaccatctctgcaaacattttaattagttgtccccatctccaaaatgcctagaccaggggatgtgttgttactattccatccaacttaaaatttgctaaaatcatatgaattgtcatctatttttcaggaaaacagtgaatacatttcttaatattaacaacactgaatgctaatactctggctttttggttctgtggctttgttttgatccatagaactgtccatcttcatctcttttcacaatggga

SEQ ID NO: 73209 - DNA, 1011 bp, Homo sapiens
cacatagtatatgtgtgtgcagttcgacccagcctggatcattcactcatggcatctgctttcttggtacctgtcagcatttgagtttgctatatctatggcagacagaagccactgaaagtgtttaagtaggaggatggacctgatcagctttacattgtaaacatcacctgcctgccatggagagaaagaattaagagacagggagcactagaagcagggctgtcatgtaggaagactagatgaggatctgaattggttttggggatgaggaaaaagaagacaggctagaaaactatttagggtgtaggactgatagcactacgtgacctaatatgaggtttccatacatgaagcgggtagaagggaaggaggagccaagactaatgtctcaattggtggtttttgccagtgtgtagctggagcttccatgtcctggtttaggaaacacaagaggagagatgactgtttggagaaggaagagaagtagttcagtgtgggaccctatctgaaggtatacacaggacatctaaatggagaatcttggaagattggaaatgtgtctttggatccatgttggaagcatggatttggagtcatcagtcttttattttatttttcatttatttattttgagacagggtcttgctttgtcacccaggctggagtgcagtggcacaaaatggcttacagcagcctctacctcccaggctcaagtgatcctctcattgcagccccctacatagctggaactataggcacaacaagccactgcacctagctgcacacacacaaacacacacacacaatttttttttttagatggcgtttcactcggttgcccaggctcactgcaacctctgcctcccaggttcaagcaattctcctgcctcagcctcccgagtagctgggattacaggcaccagctatgacaaccggccagttttttgtatttttagtagagacggggttttaccatgttgtctaggctggtcttaaactcctgacctc

SEQ ID NO: 73210 - DNA, 1054 bp, Homo sapiens
cagggtctggttctgttgctgaggctggagtgcagtcgtctgatctcggctcactccagcctccgcctcccgtgctcaagcggtcctcccacccgggtctcccaagtaggtgagactacagatgtgcaccaccatgcccggctaattcttgtatttttattagagatggagttttgccatgttgcccaggctggtctcgactcccaagctcaagagatccacttgcctcggcctcccagagtgctgggattataggtgagactacagatgtgcacgaccacgcccggctaattcttatatttttattagagatggagttttgccatgttgcccaggctggtctcgactcccaagctcaagagatccacctcccttggcctcccaaagtactgggattattaccatgctcagcctcaaacacaagttttatgaatcatttttggattgtgtctgtccgttttccttgtcctttcccccagctttgccactgttaacctgtttggctgtaaagaggtttgagaagctcaagggtgttccctgagccagatgagatggactgtagttatctagtcactttctgatgatgcacattatccagttcccatttgtgacttcctcatcggttgggttccacatcagatcctgtttgtttattctctggagtcattcattcagcaaacactgattgagcagctgttgaatgccctgtgctgggttggggacacatcattgcttccagggctcagtcactgctgtccaaggatagaatactgcccctgtgggactggggagaattgaggccaaggtgggtaagctggatgagccgtggtaaccacccactcaccagcttaggctctctgtgctggtgggctttcccattgacacagtgaatcaaggttactgtctgaggatgggttttatatatttgggtggactatttgttaggtacagtatttaacatatttatctgcattatcagatttattttattttattttggagacagagtctcactctgtcaccctgtctggagtatggtgacgtgatctcggct

SEQ ID NO: 73211 - DNA, 1025 bp, Homo sapiens
ataaaatggggacttaactcatgatgagtacttatctcatagggaattgtgagaattatgtgaaatcacgtatgcaaggtgcacgtggcaagttacttgctattattcttgtgctttctttcaaattattaacatcttaaaagaatagattagaatcctgtgatgctgagctggtataggtgtcattcagaccaaaggtaagaaaaggagaggttaagtgccttgaggaaggttctgagactccacctatacctcttcagtaatttgctccaagcagagaacaaaacatcaggtttcatttagggaattaattgatcagattgattataaaagtggttttctccaacccagaactctgcaagaagtaaagcttgggagagaaaggtatgttacttgttatttcagggacctgctcagctggtcaggcaaagcttgagaatttattgtacttactatttaatgttagtgtctccatttgcataaactatacagtagctctgcagcactggcccattagcaatctagaactgtgttctctctctagtggtgtctgtctgctccatctggaagccaggacagtgctggtaagcagcaggcattcagtcacctcctcctgagaagtgaatgagaggtcagaacaggaaagtgtgtgataccaccacacccctttttgacttgtcattctataccaggtgttttgagaaaggaaggcagctgcctagtctacttaatgggggcattttctcgtatgttattaaaaagcaacttgttttgctactttaaaaaatgatttgtttgaagtaattgcattatggcttctctcttgcttggtttgagagaagatggttttgtattagaacaaggaaacagggagcctccttttgcctctagtttttaaagttcttatgattgaaaagtagtatttgtacttgaagtaatcaaatagaatactcttataaatttagaatatatttactcacatctaggttacagaacatatctggaatatctatagtagtttctca

SEQ ID NO: 73212 - DNA, 1054 bp, Homo sapiens
agtgctgatagaattatgtgattgaatttgtgatgatctgttcatatagaactaaattttattgctaataaaatataattttgtaaagacggctttacaagaagttgattagatttataaacttactctgttgctgctattagatgggaataataataatataatatcagtactcaaatttattgcttacaatatgtcaggtctgtgctaagtgctttacatgcagcattgcttcaggtgggttatcttgagtcttgggtggctccccaaggagacagctcatgttgctcattagaagggttctgcagagcaggtgtagatgcggcttatctcagcacagcttcctctgtcctccagaacccctagtggcagcatacggttgctgatgacactttagactcaggataaattcttactggatttgagaaacttaattcttgctgggccacagtccttttatactcagggattgtgttaccattcagaaagagtttacatgaacaagtgatgcccttaataagaactgtttacctacacctaggaccctcctgactcttgagccaggctcatttgtggggagaaggcagatcaaggaccttcctaaatactttgtctgcagctttccagcattctaaaaagccagttttcccacatctttgttttcttttttactcttttttttttttttttttttttttgagatggagtctcgctctgtcgcccaggctggagtgcagtggctcgatctcggctcactgcaagcttcacttcccgggttcatgccattctcctgcctcagcctcccaactagctgggactacaggcgcctgccaccatgcccggctaatttttttttgtgtgtttttagttgagacggggtttcaccatgttagccaggatggtctcgatttcctgacctcgtgatccgcccacctcagcctcccaaagtgctgggattacaggcgtgagccaccgtgcctggccttcttttttactccttatagtaacgttatgatacagacagtgtatccgtatcagctaagagaagataatt

SEQ ID NO: 73213 - DNA, 1022 bp, Homo sapiens
ctcgctgtgatcttggctcactgcaacctctgcctcccgggttcaagcaattctcctgcctcagtcccccgattagctgggattacaggcatgtgccactacgcctggctaatttttgtatttttagtagagacggggttttaccatgttggccaggctggtctcgaactcccgacctcaggtgatccgcccacctcggcctcccaaagtgctgggattacaggtgtgagccaccacacccggtgaaatggccgatgttttaatatcctttgcttttcctagcatatgggtattgtggatataattaaactattttctcctggcctaaaactgattatgtctgagccctaagcaataaaacttggataacgtctgtccttttgacttgctgcttagcatgtagccacttttaattttgtcagttttagttttgttcacaatataatactctgtttttccagtttttctcatggtttgcaaagctgcaaactcagatggatcaagatgaaggaactaaatataggtatgtgtgtctcttgcatttgttgaatatcttaatttttagatcacagtcatctgaagcatttcataatcagtgtctttaaataaaactgaggtattaagaaaactgtaacagccatatattctttaagaatagccagtgagaagatttgggtctttaaaactgttatttagaagttgtgtgattaaaaacaaaaagaattacattataattaataggttaggagggatagatgttagtttttagatagctccagaaagaactaggttcaggtaggagttgtagaggaattctaggaggtgtttgttgctttttagaaggagaaacatccctgaaagactttcaggatggccacttaggttggttgtaactatacttctgtcagtggatgctgacagcatgggggaaatgttgacggctgatttgggggctgtgggttgagtgtccacattcagggtattgatttgttgatggctattattgctaggcagtgtggtag

SEQ ID NO: 73214 - DNA, 1292 bp, Homo sapiens
tattcttattttacaaatgagcaacctgaggcctggaaataataagttacttgcttaatctcatgcagactgggcagagctggggcttggacccaggtcttctaattctaaatctagaattcttgccatgacatcacaccatctttcaaagagggaagtgatctgaaggattggccttacttggtgccttgggatggctttggtgtcccagtctttagaagttgagccagtgattcattgccttatatgtgaaaagccagattatggcttcaaggctaattccttttgttacttataggattagtgatttgccttcttaagtattgaaacggtttatgacataacttttggtacatttcttaacataatcaacttatgtgcataggcagttttcctcctgaaattcgaacattttgggaaaaatgagcctttgttgtttttttactgtgcttattgggggaaaagattattgccaatccccttttggttctgttttctagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacaggtaatttggagtaagagagaggatcagtcattatatttaatattttaaaatagatgaatacagttttattttaattttcttaatttctccaagatgttcaactctgctgtgtttgaggccctgtgctcagcatgcagattgttacactgacagcctactttttaagtgcatgtgaatagcaaaggcaagccttcttatgttttgagctgttaggtctcagtacaatttccaaatgtagtggctatgttggtttgctctgatcactctttattactgacacttttattttttatttttattttttttgctctgttgcccaggctggagtgcaatgacgtgatctcagctcattgcaacctcggcctcctgggctcaagcgattctcctgcctcagcctcccaagtagctgggattacaggcgtgtgccaccacacctggctaatttttgtatttttagtagagacagagtttcaccatgttggctaggctggtctcaaactccttacctcaagtcatctgcccgccttggcctcccaaagtactgggattacaggtgtgagccactgcacccagctactgacacttttcaaagaagcatagtgattgtaccaatggtgagattttga

SEQ ID NO: 73215 - DNA, 1877 bp, Homo sapiens
gcgatcatttactattttatgaagagatcatataaaatttactgtaatattatcgccccttttagttcatgattgtagaaatacttgagctgaattctcatatctgatataaacctctgtgtctaatgtaaatctgtttagtgtaactttgagactggcatgttgattcttatattcttataataattgatttttctcttttaaaaaatgcaagtcggaacttgttgatctggctgaaaacattcaacaaaagctttcctattttaacgaattggaaactattaacacagtaagcattgttctttacttcttataaagttagtgatttttgttttatttttgcctttcttcgtgtcatcttttaatctataaattggcttgagtgatattttaatttagcttgcttgctgatagatattcctatttgtagacagtggagataccattaccagttcagatttttaaatatttgagttaagatgtgtttcttaaattgtattcttggtattaaaatctctttattggctacctcttatagtttcttatttgtaagctttgaagaagattgtaagaagaaatattcagttttagattttgctgtggttatgctaccatgatagtagtcaaaacatttttaaaacttattctcatgtttagtttgaagaaaagtatagtcctcaaaatgtatagttgcatcccaataaagtataatagttccaataaagacaagtgtgtaaattatatttctgtgtttctgactcataaattaatcataactatgtataagtcatgttattaaaatcgtttaatcataggtatttagtttattaaagacatagaactaaaacttgtggctagttaacaatggaatgcaatggaaagtagttcattgccaagctatttgtatatcaggataagaaatgattgactggttgcattttactttcatagtatgactgctaaatatagtatgactgctagttaatcctttaatcttcagaaaaatcaccactgcaagtagaaaaattatgtatattgtataccagaaagtgagaaatctaggtatttcatatattatttgaatatgacattgtatagtggggtaatatataccatgtcctaattcatgaagagtccaattaaagcttattaggaataaactgaattaaatcagtatgctttttctgtttgtcccttctttattgtacatgtgggctacattcgaggatattttggtgacttttaaaatttattataaagacatgttatgtcctaaaggcaaatatgctgactctaatccatagtttccaacttttatctgtatcattttttatgaattaagattgttttctttttctcttaaagaaattgaattcccctacattgtcggtgaatagtgacggatttatacctatgctggccaagttagatgattgtataacatatatctcatctcatgtaagtcagagtatttttgcatgttttaaagaaatccttagattcctattcctgttcctatctttttgtgtttttcaacttttctgtgtttagcagatgttcctattatatcacttcttgtgctgtaaagtgattatttctgtccaagggaaaaatatgtatttgtaacatattaaagaaaagttgtagtgaattcttagtcgttattagcagtggtgtaaaaagtacttttagctcctgcaatagcccctggaatggaacacatcctggctgactcagctttatcccatctaacaggatgagccgtttttaaattgttggtgtcttgacatgcccggtatttctttggaaacagaaagtgttacttggggggaaataaagggacaagccctttgatttaatcaccctctatttctgtt

SEQ ID NO: 73216 - DNA, 1050 bp, Homo sapiens
ttctttaggcagtgagtccatgctaatttttaaaaaatatctgtttcaaaaatagcatactgtagctattatcacataaagcaaaaacctgttatttggattggccagttacttgaacaaaaacatttctaatattcagaatgtatccagtcttaaatctgaatagtttccaaatgtcaagttgaaaatatatatatatgtactttgtataaagaacatgttcatgttgccaaacactgctgaaaacggtaacattccttctgatttctttatacagcagattgcacagagtttgaaagatgaacagaagaaggtaccttcagaagcttcattttcagatgttcacttagaagaaggagagtctaacagtctgacaaaatctggtatgttatgatgtcttaactgccagcatttattcatttgggttaacaaacctttactgaggacttgtcctgtcccagacatgaaaaacaacttgtgcctttgaggagcccacactttatggggggagattgccaagccacagacagaattcagtggtgagtgagatgctaatggtttgcacagggtacccttggaccatggatgaggggcatggaaattgcgaagggagatgagctctgagtgtgggaaggtgggctcagtgtggggtgtggtgtctgagagctataatgtgtttatgaagagtatgagagagccaggtgaagtaagtttgtttaagatagatagaatagaatgtagaaaggcatgcaggaatggaaaaccatggctattttgcataattcaagtggtttggtatgtttgggcccaggttgtatgtggggaaggagcaggtaaaataggccagatagggatagatgtcatgtgatagtctcatggcctttggacttctagctggcatagtgtatcatggtgactggaccatcagatttgcattttgtaagcatactgagtgtctgggactggagtaaaatactattgacacagttgtatgggatggcttggactagggtacatgttatacaaggagcaaaattgtcccaagaatca

SEQ ID NO: 73217 - DNA, 1015 bp, Homo sapiens
gtaagtgaataattgagattaatagtcattttgcaatttgaacttctagaaaataactctgtgagtactgtagccatcactggtgctcatctcactctcagcctttcatggaggtgagttgctgaaggtgaattggctttttgccttgtggtggtagagaactggtgtatgttactcatggctttgctgttgaaactttacatgttcactggatgagtaattttgtttcacagatgcagcatttaaaatcctgaaccctatgactgtcccaagattttttaggctgaatagcaacaatgccttgatagagttcttgttggaggtgagaaggagtctgtttcattggtggtgggagataaacgacattctttacatgtctggtgatttctaggcacataaaaacaggaggaaattgttatcttctttttaagggtactcctgagataagagaacattatcttgactctaaaaaagacgtagaccgtcatctgaaatcggcctgtgagcagtttattcagcagcagaccaagctgtttgtagaacagctggaggagttcatgacaaaggtatagaccttggtgcctatgtggtaaagtcattttgcattcttccttagatttccttttgaattactctcttgtgtaaactctggcagaaggagatattaagcccaagtcttaatgattctgtctaggaaatcactgtgtttcctattatggaagctttctggtttatggacttttagatatgcttgcacagtttttgtttttaagaggaagagtcgaaatattgcaaagctagttatagctgacccctggttagctgtgttctgtttatccgccttgtaggttatctgcatgtgggctgggactctcactttctcctggacctgcatggcagcaaccacagtcctgggaatcagggtttcctattcttaaaatgggtgatttgttttcctctttgttttacatgccgtttttctcttccattttgcatggataattgagaactgaag

SEQ ID NO: 73218 - DNA, 2378 bp, Homo sapiens
gacagggcctcccaatgccagtgcccagtggctgcctcagaaatagaccaacattgtgggccagtttctactttatagccatgtttactggtctcataaaaatcttggtctttttctctcattctgtttttggggctctaaacaactttttttttttccattctaattgctttattttatttttcaacttttattttagattcaaggggtacatacatgcaggtttgttacctggctgtattgcatgatgctgaggtttttcaacccttgtggttcccctccctccttgacttttcttgaggacggtattccataggagaactaacatagctcttaattttgcttttcagctgagccttctgctgttggtttctaaataagcaggccagccgggctgtgcacctaaatgtctgtctgggaggagcaggctgagaagtcttgcagtctgcaggacaccgaggaatcgtatgtgggaacgtccccgagaaccacacgagcgtgctgctcagtgctgactgcagaatgaaatagaagcaaagtgttacaggatcagtgttttcttttctaaaacatcaaaatgccaaagattaatctgtgattggtgataactgcctcgtttaaatggtcacaagaaatgtgaagagagagctagggcagacatgcagtgaaatggttctttgttaaaaatgtgcaataaaaatagattacaataagtagtgcaaagaactttacagaaatcaagcgaattagaaggcctgtaagagtaaggtttgctaaaacgtgaaacactgtaacacttttaaccactgagcattccacagtgaaatgttatttctatgctcttatttaatgtaatgtttctcctgtcatttttgaagttgagtttggagtagattggttgcttctgagaacacattctgccttcctgggaagtcggggtgtcatcctttcctctgtttgatgtgaggtagtttaaagatacaaggactttgtgtgaagctccagcatctgtgccccttgaattgcttaggtgcagacagttctaaagcaaggagctgcagcattctcatcatagatacgtgcagtatctttaatgagtatcttcatggtatgatagtgtgtgtttgtgagtgcgaagtaccaattaaggtgtcttaaatttggcgcatagaggagagaaggaaacctgaggagtagtgttcctcctgaatgaaggttcaggtcaccagccttctgtacactgcctttggttttagcagttctttgaaaagcaaacactttcatgtcctgtctattcattcagctggctgtgctgtgctgtggaccagctgtgtggatctctagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaccttgtcctcacgtgtctgatacgtgtgtgcattccttgaggaaaatttctttaattaaaattttaattgagataacttgtgtcagactcacatgcagttttaa

SEQ ID NO: 73219 - DNA, 1014 bp, Homo sapiens
tcatatccctggaataactccttttcagcagttattaccatgctcattaatatattgtttgtgtgatgagttgcttagagtctgattcatttgccaagccgtaagctccataagggtaggaaatgcgcctctcttattcaccatagtatctacggagcccagcaccgtgcctgctaccagagctcttggtactgttgaaagaataaattcaaaagctacactaaatcctctgaagacaaggtggggcagagtttatgtgactctggccagcataagccaatcagcccaaacagagggttgacgtctgagccagactggcaaaggcagactacggtttagctaaaaacacagaactaccaaactgagtagagtgtctccattttacaagtgaaataatttgaggtatcagtaagccacggtaactttttaagtcctgatggcctacagaaccctagagggtttccagcacccctaaccttgaggccactctctttcccacacaggccctgtcttcttctgggttcctcttcttttatttcctccagttacaaggaaatcatggccaagcaggtcagactcttagtgagtgatggggaaccaccactcgtcagtgtggagtcgtgttagtctggactcttcagggaaaatgatggaaactgaacttcccaaagcttaaaggggaactcatcataaaagtactggagtacaggaccctggacgggataaaactagggcagctgagccagaagcaggtcaccagctgccttctcctgctttctctcccactcctgtcttcccgtctctgtctctctccttctctcaccctctctctctgtctctccctctctctgtctctccctttttctgcagactggcctccttccgacttcagcctggtgtgggtaatacccagccaccagcaaccaagcatgagagcctcagtttcagccatgagaaagaggcagacaactctcttggattcaaatttcagaatcccactgaggggctcctttg

SEQ ID NO: 73220 - DNA, 1116 bp, Homo sapiens
ataaataaattcatccaaaatgcaatgtaattaaaccagaggaagatcgtgttggatgggggagttgcatgtgtgtgtttaaagttagggaacttctgtttactttgcagtggcctatcgtggcattcagggagagactataacccagacctccgttgattatggcttgcactggcattccgtggatactggtaactagctgatccctagcatgtgccccagggtctctttaccatcttcctttcctggtgaaatatcagacagaccaaatatttacaaaaacatagagggactctgttgcttgggtgagggtacatgcaagcaaggaaactttatggttcacttggtgaaaaggaagagtggattttcctgctctttgagaaactgagtctgggcttccttccattccttaagcccaggttaggcagagatgcctgttttcagagtgactgataactacgagccatggataccgttcttctgtctccctgacacccactccaaaaactgtgtggaaatttctttctttcctctttatctctctgtgtgggaagaaaaaattcctttgtttatgatatacaggatgagtaggaggcattttcttgatcttgaatgtgttttgtatgcataaattgaaagttacttcagttatgaaaatgtttttttcctgctgttggtgcataatattgagtaagcctttttggtattttaactgtgagaacagcttaagtactacgaattgaaatgaacctgctgagtataagtagtaactgactttaatgactttaacaacaggttcataaaacacattaagatataagtttaaataatgaactctctgaaatctaagtacatacaaatttacatggtagatgagctgctttaagacttattcagttggacacagttttaaacattgaaaattgtgaactaaaaacatctatattgaatcaaaaagacttcaacctaatcttatccataagtaggctgaaataatattttatttgaatgaaaatcccaaatgcccagggtttttttcataacactgaaatgtaattcattactttatttcgtagctcagatattattgtcctatacatgatgcagttgtttgtc

SEQ ID NO: 73221 - DNA, 1502 bp, Homo sapiens
cagatatgatcaacctggtttctggctgtggcattgccactgtcaagttatatacatttaaggcaatcaacctctgtgagtgtcactttcccaatttataaattaaggcgattgggttgtaccttaagtttccatgactttctttgtcactcctctgcttaacagtctggatgtttcatattttccatggaacaaagtccaaacacaccactcttcacaatctcaccccaaaatggaccttctaaccacatcttcctcccaggatgacttatctgcttcctacacccaatagaccttcacggctccgtgtgcttgtcttctgtgagactttgagtatcttaggtattgcatcttatgcaccttcctgtccagtgtagggcacgctgcccggcataccagtagtttctttaaaaatgtttctttaaaaatgttggctgtttcttcctcccccttgaatactgactgacccctgctgaccatccctccaatacctccttcacctattaagtttgtgtttatccttccgatacattcttcgcactttttcaatgaaacctttctcttcccattccaaattaactgttctctccacactttgtttttgtctgttataacatgcctctacagtacattggactattacagtctctacgatatcacatctcctaaattaggactctagttggttgtataggtgtcagcctattttccatattattggtaaaagataagcattggcatattaaaatttagagtttatttaagcaaacggtgattcctgaatcaggcagttccaaaccataagtggttggggcaccacctgaggtggttgcattgaaagcttctagagggccagtgcagacactgaacaaagacgtgttttgattggttaagtttgagcaattaccttattggaactatcccagtgggaagctcaagacaatgtaactaaatgccagttagctgcctgtgattggctgaacctatatttcatttccttttaaattctgagttagaggctgggcgtggtggcttatgcctgcaatctcagcactttgggaggccaaggtgggtggatcacctgaggtcaagagttcgagaccagcctggccaacatggctaaaccccgtctctactaaaaatacataaaattagccgggcgtggtggcaggtgcctgtaatcccagctactcgagagactgaggcaggagaattgcttgaacccaggaaggggaggttgtagtgagccaagattgtaccattgcactccagcctgggcaacagaacaaaaactctctcaccaaaaaaaaaaaaaaaaaaaaaaatattctgagttaggtttcagtttgctcacttagcaacccagggcactggagccgccttagtctaacagcctcccatgtagttatttgaacaggataatccacatgaattcaggagccatttctaattgatctttttagtccccactcctacgctgctccagtgaacagctttttcac

SEQ ID NO: 73222 - DNA, 1036 bp, Homo sapiens
tcaagtttaaaaaaaaaaaaaaaaggtgggggggggatcttactatgttgcccagatgatctcaaactcccagcttcaggcagtccttccatctcagtctcccaaagtgttcggattacagccgatagccaccacctggttatactgtgatagaagtacaattggagtagcttaggtaaagatgggaagtaaatagacatgaataaaatgtaaattgcagtgattgcaattaaagaaaaaaccaaatgactgagatgagaaataagtgtagcgattgggagttgggtactacttcagattatcaagaaggtcttacgtatgagatgagtcctaaaaaatgaaaagaagctagcaaagagcaaaaggggaaggagtatttcaggcagagggatggggatatgcaaaggcctaggaaaagagctttggtgaattccaagacgaaaatactactatggctcaccactgggtggaggggatgggggttgctagagagaaggtctagaacagtgctgttcaacagaatattctacaatgatggaagtgttctgtaaatgctgccccccaaaaaatggccaatacaagcttcatgtggcttgtattaaacacttgaaatatagccagtgtgactgagaaactgagttttaaaattttgtcattacttttaaatagctgtatgtggctaatggctaccatttggggtggtgtaggtatatatcttggcaaagccttgtggaatatggaagtgtttcccacagtagagtataaaacaagttctgtatgttctagttactttgcatggcaagtggtactgattgttttagtttactgtggcaatataacatttctttttggaataaatgttaataactaaacaaattaagtagtcagtgtggaaataggacagaaattactggtgctcagataattgaagtttagaatatgtaggctatgtatgaagttggaatttcatttgaaagcaaaagtaataagtaataataaaaggataaaaggcattcaatcacgtcaaaacaggcaa

SEQ ID NO: 73223 - DNA, 1123 bp, Homo sapiens
caggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtggataatattgttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgttgtctttcagtttgaaatctttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaatt

SEQ ID NO: 73224 - DNA, 1447 bp, Homo sapiens
ccatcacatggaagaaatagtgccattcaacaacagaacgtgcagtgtgttttttgtttgttttgtcattggaaatgataaagtaaaaaccggttgattacctgtcagaaattgttgagaggattcctactttaagcaagaggttaaactaggtgccctctaaaagtttcttttcaaagattcattgagcccaaacacattttctaattttgctttgaaatccaataaagctaatttaatatccaaaatgaaatactcttataactttgatattttgggtagaggttaacctgcccatctttcctactaataatgtacatcttttttaaagtttgtttttgttttcttcaaatagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgt

SEQ ID NO: 73225 - DNA, 1853 bp, Homo sapiens
cttacactttgcagcccagaaaattgaaatcggctatgtattgcagcttcattttgttctcagtaaaatgtgtcttttatttttacccaggcgtttactgcttttctttgtgggttgtaaaagtaacctgcttgagcgtgttgtatgaatagaggcagtacctgctgtctttcgtactcttgaccgactcttatttatttggattactgactggtcctgttctgttattttgacttcctttgtgtctatttttaacctaacctctttatattttattctatctttccttaattcttctggggtttttttgtatgttcagtgttttctcccctaccttgcatgttgtgacttaaaactaagtgatttaaatttaatacattgtcccaggtttttatggtgaccaaatctaggacaaagtttgcaggttatctaacaatcactttcttaactaatttttttagaggtcacagacttgaatattgttataacatttgaatcttgctataataaagtcttgaaatctaaaactctaaatagtagttgatggtaagcagtatactgaattagagttcaatgattcttaacttgaacgtttctttaaaacatcctttaaaaacgttctttaaataaattccctggggctgggggcggtgactcatggctgtaatcccagcactttgggaggccgaggcaggcagatcacttgaggtcaggagttcaagactagcctggccaacatggtgaaaccccatctctactaaaaataccaaaaaaaaattagccaggtgtggtggtgtacgcctgtaatcccagctactcgggaagctgaggcaggagaatcgcttgaatccaggaggtggaggtttcagtgagccgaggtcgtgccattgcactccagcctgggcaacagagagatactttatctcaaaaaataaataaataaataaattgtttaaaattaaaaaaaaaattccctgggctctaccttgagatccacatacagtctgcttttcttatattttaagtaaatttaaagtggctatcagaatatttattcttgtttgagactaccaacataactacgtgttgaaggtgcttcacagagaatatattgcctttaatgtgaaataattttcaccaatgttgctaactttaataaagtataaaatttgtagaatattcagttaagtagttggtaacccttttctattttagtaaaacttaatgcatgtttacttttttttgaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaaggtactgttatttccttggaaaaaatacaaagtgaatagtgtgaatggcctatttttcatttggttgttttaaattgagattgcaatcttatgtttttatgagtttggtttcctaatcttttatacatgtaaaaagaagaatgccattaaaatgtataatatgctttattttacttcaacagtattaatgaattttgttttaataaagtttaaaatattccatttctgttaaacgttttttgtgaaaagctttcaacaagcaaacgtattacaaaaatttatttaaattgaaactcaaggaaaaaaatttcttagagtgatgaggatatttatgagagtagtatttatgagaatatacaaagttggaagaaagggaaataaagcgactctatataagcatttgagaggaataaagagattgagaagtaagaggaatagaaa

SEQ ID NO: 73226 - DNA, 2162 bp, Homo sapiens
tccttcgcagtggatggattatttgctctcagtgttaataattgtcactctctgactcttaaagggatttcataatgaaatagttgtttttaaaaattaaaatgtatgtgtgcacacactgcaaacacatgtactcctagatttaacccttaaaaggattctggtaccaagtttcaaaagatcagacccaatctgagtgaaatcaatagagttctttcattggggatctcccatggagttaaaatgagttatttgtatgggtgggttgggttacctgttttcttttggtgggaaggttttttatttgtcagagtccttagattctgagtattatatgggaaggcttttattttaagaataggacatttttggtttaaagtacttttcattttttctgttttctccttgatttatgtaaatgtctatgtagataacaagactgctatttcttggtgtaaaacaaatcttactttttaactttttacagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaaggtagtttcattttactttaactatataatgtctgttaaccatttaagatgccatctgaaggggattctgatctgttcttatgtagcacttaacactgtgtagaaactattttttgagaaatcattttataatcattatttaaccctcatggtcaaagtttctctttaaaatttattttgagaagaagagttatcccacagaaaagttgggaaaagagtacaatgacctttttgtatgaaaattacttattaacaggccaggcgtggtgttgcatgtctgtagtcacagctactcagggaggttgaggcagcaggattgctggagcccaggaaattgaggctgcagtgagccatgattgagccaccacactccaacctaggtgacagagcaagaccctgtctcaaaaaaaaaaaaacaaattaaccaataagttctaatatcaaagtgctcagtggtttgcccttggctaaatgaagcagagccaggaaaaacagactacatatttttcatgtctaaagaaattgggtattttggcagccctttcccctagacatctacccaaatgcaggtgtgtaggttgagtctttaacaaagtgattaagagcttggtctgtaaggccggatgatctggatttcagtaggcacaccacttactggctattacttaatctgtgtgttagtgtcatcatctgtaagtcaggaataatcataccaccaacttcctatggtaattaggagcaaatgagttattacaggcaaaacacttagaacagttcctggcatatagtaatacccaataaatattaactgctactttgaaaatatcctatcacgctgatttttgacctcactgcagcaattttcagttattccagattatctagcttatggattctggtggtaggggttgtttggttttggttttcactgtctctgtctcatctagtacctaccttagtttattttgcaacttactaatactttattaatggggagggacgagtagatggtaaaaagaaggaaaaggaggtaaaaggtgaaaggaacaacattaattaacaattttacgtcatgtccctggacataaaagtttagttagtattaaatttttcactaatacaaaataaaaaaatattgttttatgagttttatgaattcatgcccttcctttactctattagcataagcagtaaatttttttattttaatatagcccaataaacctagagtatacatgtacaaaatacatataattgttaacgtgtattaaccgaaaaatgacccaagacttagttcttgccctactgtatctgccttgtttggttggttctgtgaccttaagcaaataactcctgtgagcctcaattttatttgtaaagtgatggaataaaacccctaaaatcttacccacctctaaagatatttgtttctgtgaccttttgctagtagcatttcaagttaaaatctggtttga

SEQ ID NO: 73227 - DNA, 2005 bp, Homo sapiens
ctattcttcatgcagtcaaggctgcctcttttgaccacagaaaataagataggggagtaggaggagatcaaataatggagtgattagttctattaatgcctaatcattttatgtacttcttggaagatattttatggttatagtggaaatagacaaggaaacttttttttttatttattagaactttgagagaggaatttttcttaaaatgatttatatatttggatatttatagagagaaatgtatatgtagaatatagaaatatatagaacatatagagacaatatggaacatagaaagttacatagaatatggaaaaaggtaaattatgttttaaaggaccttgaaatgaagcattttgtttctattttatcatgtgctaataactctttatatatggtatatttattttagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagaaacaaataaatccgagagaactgagagtctggaaggtgagtgctacctctgttgtctgtgatactgctttatttcttttcagatttcgtgggaaacaactattttcttttgaaagggcacccactaatgggcaaattgactccattctccattcttctatagaggaagtagatttcagaaggaaaaggcctgtaagatagagatatatatatttttttaatgtggtccccttagcagtaccattaaggcagatttggttcacataaacctaaatgaaataaaagattgtttagatgcagtgtgtatagatgttgaagaataaccatcacatccttttcttagatgttaaaaaaataagattacaaaaattgaaatgacttcttagttcagagagggattcaaataattattagtgaatccctattttctagggcagttgagaacaaatatatgaaacaataacactacctaaaactgtatttaatgtaggattgactagaatcccactggtactccctagtcctagaataggaatgctaagtccgcatcaactcagagccagcctcagctatgtgaaacctcactctccatgcttctgttctttacccttcagcccccatttactagacaagctgactcatgcctttccattctctgcccttctttgtacccactcataccatttcctgatagacctttttcttttatctcatctttcttactcaaaattcaagtcccaatttatacattattttctcgatgaagccttctctgctcgaggcacttactgtttcaaattcatctcttcacattacattttcatctcaattttgagtataaatagcatcaaatcataaagcatggttctgatggaggtacaaccctgggatataattgaatataattgaattaatcattataatagctctcttgtgattggagtcagtatccctcatctctaaaatatataatttgctggttatgatcacagataatatagaatagaaatgtataggtgaatcacttgctatgtgatgtaaagtttttactcaaagtaggaaaatgagttggatcaacttgaaaagttgaaaatcctatta

SEQ ID NO: 73228 - DNA, 1549 bp, Homo sapiens
atttatagtaaagccatatttttatttttactaaaattattgtcattttaaaagtttttaaatgatcttgatctcttgatctcatgatccacctgcctcggcctcccaaagtcctgggattacaggtgtgaggagaaattattataatctatatgtaccatgcagtggttactaacctggtgagagtgtgattgcttttatcttttatatagatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcaggtaataaaattgaattgtgatctagtcactgtttcctaggttagtatattttatacacattttaattctaaagtaatgctaaattggttactttacatgctgccttaaatttt

SEQ ID NO: 73229 - DNA, 1436 bp, Homo sapiens
ttggcctgaaattagaggtgtgacttacgagggaaattttttttttccttcagctcctatgttctacacctcctgctgcccctatcctttgccaccagtgttctcaggtcctgctggggggacagagaagatcagaggtgaagggtagagatggcagaaagtggggttggagcagtgggctggaggtagggtagggagcatgcagagaaagatcaaagattgatcagtgggaggggggaagggggttgacggggagcaggaaacatggtcgttagagggcaaataaaaattatctttaaaaaatttaaggtctaggggcgattgttacttggatattaagttaaaattaaatatgctacttggtttgtaatttgttgccagtgtgaccctatcacagataaaatttaagatttaccatgctgtcttaccaataggttatctgtcaaattaatcactgacaaaacttgattttcattgtagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagtaagaataattatcagttattaataacattttacatttcaggaaagaattcaaagtttcatttaatgcttttcaatatactcttaatttcctgttaattttttttctctgtatattttcctgtttttcaaatttagtatatgtatcggtgtttaaagtttttttacccagcactttgggaggccgaggcaggcagattccttcaggccaggagtttgagaccagcctgggcaacatggcaaaactccatctctacagaaaatacaaaaattagccggacgtggtggcacgtgcctgtatcccagctacttgggaggctgagatgggaggattgtttgaacctgagaggcagaggttgcagtgagccaagattatgtcattgcactccagcctgggtcga

SEQ ID NO: 73230 - DNA, 1030 bp, Homo sapiens
taagtagaagcacatctttgaataacacattttgggggaaagataggggaagataatttagacattttaaagtgatgttcttatattctttccattttcctttgaagaaagtagcattgatattttggttgggaaaatacatctcccataaaagcatgtctgaatagtctatttgctgatattgctgtaattagaaatttaaagtatgatttgctataagttaatggtattgaatttgtttcaggttatcttgtaatgattatgatgttggtatgactcctccaaaccaggaattcagacaatacaaaagatgggtagatagcattctaggaatccaaagtatggtacagaagaaccactttaagttggtttcagcaaaagtgaaagggtttaagaaaactgacttctaatgcatctaccatctctgtgacattgggaagacaactctggaccataatttctgtttttaaatagaaagggggagaagcaactgtgtaggatttcattttgattcagctttaaaatgctatgatcatttgtatctgggtctataacctctaaaatagtaaagataagataattcttgtcttttcaatcagtgattaggaagggaaatccagaatactgtattgaacccttcctagaaacatcctaaaattgttctgcttaatgagttgatgttagatgttccacttaccaacctgttggcctgattataatatgatctttatcaaaaaccagtagatatatagtatgtaaatggaaacatcacagtatcctagatcagaccgcagtagttgctttcaaaaatggctgtctctttgaaaaagttcatgccatcctcttaaacgtttttttatcccagactaattttctgctcaactgggtatttgggcagcatgcattcatttactctgtgtttatgtgatttgtgtgtacatggaaaaaatttatataaaatgtgatgaggttatcagttaacattttaagaaaacagctcttcatctgagtaatcatttatgtaattaaa

SEQ ID NO: 73231 - DNA, 1081 bp, Homo sapiens
gttcaaccacatgtattgatcttctactaggtgccaagaactttgatagttgctttacatatattctgacttagtctttacaatatccttgtaagtgtaggtatgataaaataattcatgttttcacagttttggggattagatctaagagtagtaagattacaatattatagagaagtaggttccagagctggaattcaaactcaggtcttctgaccagaagttcagttctctattttaattttactgtaactacttcaataattatgagatgtatgattgaaataaaaatatattttggaggctaatgaatattttacaaatatttgttgagtacccatgtcaggcactttgctaggcacttgaggtacaataatttcttgtccttgtagaatttaatggggagagggaagaactccccacccaaaaaaacaaagtgtgataaaatgctactactgtatataaaagttctgtgagaagacaaaggagcaaacacaattctgagcaattccaagaaagctgcctaaagaagtgacatctgaattagggcctgaagaataaaaggaaactatagaaggagcactttacagggagagggtgcagcatgtacagacaccagaactgaaagaaacatgtgctttggagtagtaaggaattatgagattggagtcagagtatgctataattggcaaggtagaaaagaaaccagggaaaaggactgatgaaagactataggccaggtagtaaatgacctaagtttagcctagtcaggctaaaaaatttgattttaattgcctttcactgcctacaagataactacttttaaacagttggaagaaataattttcatcaaaaacatattaagggtgttgggaaagattgaaaacaaggataccaattagttagactgttgatgacataggcatctaagaagacctgatcaaggtctgagttaataactatagctatggggacaggaaaaggaacaaagaaatattttagaagtgaagttgattgtacttggatatgatgaggcttagacaacccagagattgtcagctttaatgaattggtatgtcat

SEQ ID NO: 73232 - DNA, 1093 bp, Homo sapiens
gtgcttaagtacatttgaggaggtcacagatggtctagtttagcctaacttaatagttgatagaaaagattaaagtaactgaagtgtctttgtatctaaaagtggtttctgaaaagtaagccgtcaatgataggagatgaacttatttgtttcagttgtttaggatctggtaagttggggtgagttggggcagtataggtaagttggggcagaggaaattcatgttcggagtttatctaatgaagaacattcttatcaggtgttaattatctttggaattttagcttctttattttttgcaaagaacacgaattgtcattataataaaatttttaaagttctgtattaaatatgttttctagtttcctgaaactttgtaaaagcaattacagtcaatttccaaaattgcattacagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggtaaggtttttgacttgtctatgaactatatcttatatagaaagtataaaatctcctaagatttctaatatgttgtttcttacatttgttatcattttgtcacagtaatttttaattaattgaacttgtagtcttccttataaattcctaattggaattactagttaaaatagcaaaagataaatggagcttgagctagaccccccctaagt

SEQ ID NO: 73233 - DNA, 1049 bp, Homo sapiens
ttcaagatgttaaaaatagttctctttgagtagtagaattataggtgatttttactttctttgtctacttttctgtcttaaaaaaaaacagtttaaacagtcattgtattaacatcttttctgaaagtgtcttcctatttcacctctatcttttctcagaaacctgcccctttaaagttatataataataagcagtgttaacaaaataagtatcaagtaaattaattcttcagccatttctgttagtttttttttcttcttgatattggttagtagtatacaaaataataaagggcaagtaatgtaaaggaacgctgctgtttttaagaaggctttaaaaaatatccttttggcatatttgaacctctaatgatagctttttgttaccttcagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtaagtaggattgtatgtttttaacaatattaacttttgtagaatatagaatatttacttttcagaagccgttgggcattagcatattgggttttttagttttgtttacaatagtgtgtatatttattttaataattcccataataattattattatgagtcatggataattcagtaagccttaatttttacaatttatttttcaattttttattgtggtaaaaaaacaaaatgtaccatcttcatcattttaaagtttatagtttggtagtgttaagtattttcacacttgtgaaacaattctgcagaactttttcattttgcaaatctgaaactctgtatctgtcaaaaaataactccccctttccaccttttcccagctcctgttaactatcatcctgttttgtttctgtgaatttgactgcttcagataccttatataagtggaatcatacagt

SEQ ID NO: 73234 - DNA, 1229 bp, Homo sapiens
atcattcacactggtttaattactgtatttcttatattctactatgttgttgactttacgatgcaccgttaatttaataataaaagcaaaaggacctggaaaaacagtatattaaaaatacaaagaaaacatttaattgagtatagcatttcttttctttttttttttttggagtataacatttatgcagtttacatttcctagagtgtgtcaagtaatcatcttttaattttattgctggatcatactatcaactcagaacatactaagcacatgtaaggattagaatttcagttaaaactcagtggagtattttaaccagtgtcagccaactgaggtgtgataatcaggtaaacaaatttcttggtggtcttactaggttatcatattgaatggaaagatataattactgacaaattaaaacttacacttttccctgaaagctggcatttttctttgtttgacatttattttgagatatagtctgatagtaagatttgtcctgatatatgagatatggtataatctaaaatcataaatatattacctattctgtccatctgcacttttaatcttagtttttattaggtgaatttttctttatagctctttgtacagagaatattaagtatgtcaaaagctaatctaaaacaatagttttgaagagagagagaaaagattaaaaactgataaaagtaaacaggtgggctctttgccacaagtctgaagtaggctctgtgccactgaaacaacaattagttgactttttaaatgttgaagatcttggtgatttcagaatacacaaaaccagttttggcctcttcagttggaaagcactgtaacgtaattgtgttttctaaccacatataattttgatggtaatgtgaagaaatgctgtactttagtaagtatattagaatagtccagattgtgattatagccaagtcccaaaatgtcggtggtttaacacaacagaaggttatttctcacgtaaagtcaaaatgagtgtttctgattgacagatggctgtcctatatatggagattgagtaacccaggctccttctgaccatgattccactttcttgggttttcaaggaaaccaaagaacgggatgtacaaagaaaaacggaaattgagtattgcagttatttagctctatagtttacaattgcctggcatatgagagccctttgaaatttgggcctggaggtggtatacatcatttcc

SEQ ID NO: 73235 - DNA, 1036 bp, Homo sapiens
aaaaaatttttgtctttcagtatatattatcaagagattgaattctttataacttagaattactgtagaagccagttgaagaagtaaaaatagaaatgattatattcagggactaagaataaggagaagatacattttcatttaaggtcactctgaactatttatattttattttaattaaagtccataccctaattttatcttaaaaaaaatgaactaaaaatatcttctacctaagatttaatcagttaacaagccctgtctatttgaacctgtaatgaaactcatatttatctccctccttctagttcctagaaactaaccctatttcagactctacttaactttttgcctagattattatatcactaactatattgactttatgtagtttctacccaccacccacacaggtgaacattttcattcagctacctcaacccatttattttgtagatgctgtcagagaaatcttaaaaggacaattccaattaatttattataccattgaaaaactcagtggtttttcattctgtagaatgaaattcagattccttagaatgacatttacactttggtcttttctttcttgtcagtagtttttgtccagcttcctcctatctacccccttctatctcaattcttcaatctctagctcaaattttaagttttcccatttctctttatggaacataagttctgttccctttaggtacctatcagattttgcttatacctccatgttgataataattgcctgttgcattatatttcagctgtgacttatgttttataacctttattaaatttaagctccttgaagattgggatcttggttattcatagttctgtcttctcatagtgcctacttgacatagaactttgcattgtaataaggcacttagtaaagttgagttgatcctctccctcatattgcctacttggcatagaactttgcattttaataaggcgctcagtaaagttgagttgatcctatcctttgttcatgcaattgagtaaatattgcaaaggtata

SEQ ID NO: 73236 - DNA, 1015 bp, Homo sapiens
agttttagatattaatcatttgtctcacaaattttaaaactgaaaagcctatggaagcaatgttgcacacgtaatataacctcactttgtatgatgtattttagtagcgtatctttaggaaaatcaaggagataatgagtcgcatcgtatacagcatgaaatattgaaggctttggtatctttaaggcttagaaattcagctgagtgcattttgtcttttaaaattccatctcctaacaaaaaacccaacttccaaacaacccaaaattgtttccagaaaacccagaaacttccaaaatatttggcttttcatgaagaaatcaaccatggtgattttaatcctttatagaaatggtatctatttcttttatcttttagaagtatgtgatcctgatgaaagactctgctatttagatttgtgtaagaaattagttgaaaaaagtctgtatgatttttggcatagataattatgctagtttctaacagtaatgcaattttattttaaagattctgacaatggagatattaattatgattatgttcatgaattgtcattggaaatgaagcgtcagaagatacagagggaattaatgaagctggaacaagaaaacatggagaagagagaagaaattatcattaaaaaggaggtatgctatttattgcaataaatatgttagtacttaatagcagcatttgtattgatcagataactcagcttcttgctacatcttaaattatattagtatactgatatattgatcaacccactgtatatgtactactccatatatattcatttaattttcacattattctattagataagtagcaaatatttatgttattgaataggtgagcaaagctaagagtttgttgcctagagtcaccagctaatgtaacatggggtttgaatctgcctatgtctgtttcaggcccatgctatttctagaatgccttgtttcttttctaaaaagtgaagatacagttaatttaaatataatttatgatttttctg

SEQ ID NO: 73237 - DNA, 1063 bp, Homo sapiens
tacataaaatattataaatgagatttttaaatcttaaggacttgggaaagttatttccaagaaatgtttgacttttatctttcagaagaaatcaaaatcagattaagatagagacctggatttattaataaaaaattagcaaaaaaattttttttcttgagacatgctctcactgtgtcacccaggctggaggacagtggtacaatcatggctcactgcagcttagcctcttgaagtcaagcagtcctcctgcctgttatctcagcactttgggaggctaaggctggagtaccactttagcccaggagtttgagaccagtgtgggcaacaaagtaagaccccatctctacaaaaaaacaaagaaattagcctgacatggtggtgcatgcctgtgatcccagctacttgggaagctgaggtgggagcaaaatcatttttgagtcatcaataagcatttattttccaccccttgaatgttttctccacctctttgatgttctgaaagatgggcactgtaatgtcatattaccaaacacagagaaagagaacttgtatttgttaaatgcattgagtgggggtggacaatttaatgtaatttatataattgtcttattatttcaatagctttgttactctacttacagatgacaaaactaaagatcttaaaaatttaagcaactttttcagtgagaagctgaaaacttagaccagggattagaaaactagagtgtgtgggccagtcactggtttttgcaaaaaaagttttattggaacacagccatgtccatccatttggttacatattgtctgtggctgcttttgagctacagtggccaagtcgagtctttatgacagagaactgagaagctacaagactacaatattaactactatatttcagaattatctctgaagacttaatagactaacagttgtaaagtattgtaaatacatctttccagtaattgttacatcagtacttaaaggaaacctgttccatctttggacagtgctgttaaaaaattgcttctaagaacaaataggaaacttgtttatggttact

SEQ ID NO: 73238 - DNA, 1031 bp, Homo sapiens
gcatgagccaccagcaaggtattaattatttttagtgttatatttgacaggtaacagatactgatcatttttatggtgcattcttgctgcaacacatgactgttgatcttcatgtaatgaatttctctaggaagatcaggcctatgttaggtaagggcaactgtggaatagattacataggcatagctaagatagaatgggtgtgattttcagcaaattagctgtaattcctcctcttctctgtcactgatgtcaactccagtgtgtttgaattatgaggttggtaacccttgatcttgtggttatcaaattcataaatggataacttgtaattctgtagcatgtgatagtgtgtcagaaagatacgagcaaaatgcacaatggagagagtaagtaattacctggagaaccagggacctcttcagggaaaatgacacttggactggtgttgaaggatcgacgcggtgtcagaggggagggaagaagagaaaaccaacacaagaactgtaaggagttttaaaggactaatgtgtttgaggagcttgtgaagctgtgtgcctaggttataaaaatgataacgtggacgtgagatgaaggctgaagtagattaggaccagattatcagtggtcttgtgtgccaaactcacagtttagcaatagagaaaagagacatgctgagatctgtcttgctcaccagtttacctccagaccctggaactagtaagttcacttactgaattaatggaaagtggttctgatatgcagccatgattgagaaaccctgctgatgtaaggtctgtgctgtcaaatgtgggtagtctgaattgaagtgtgctgtaaatataaaatacatagtgaatttcagagacttagtatgaaaagaaagtaaaatatctcaaattttaaaatgtagattatatgttgagaggacaatgattttggatatgctgggttaaataatgttatcagtattttaattttacctttatctttttttctttttaatgttacaacaaggaattgtaaaatta

SEQ ID NO: 73239 - DNA, 1049 bp, Homo sapiens
tgtgatttgtttatatcttttttatatatagtactttttggtagtcaaagaggaacagagcattccttaacttcttttgccctgttttaaaggtgttgtagaaatagtctttaaaggcagtctgttttccatctctcctttgttttttcccactgatagtgaaaataattgcatagccatatactgtcaaatttctagtataaataataaagccttaccactgttgagtataaatatgtatttttcctttagttaaaaaatttacagcagaatatgaaaatcactgttgtaaaattgccttgaatcctttatctttattctgaaataatttaaaatttaagataaattttaaagctcctatatttgctttgattcttacttaaggtacataaaatattttctcagttattgatgttgcatccaaccacaggcatgtgtatacaagaaacttatttcttgtaatatcttcttatatctttcagtataaatgataatgctgctacctctagattaattttgcaactttgtagtttaaaactttgtgttactactacattttgctcccacatataactaatatatttatgtgattaataggaaaacaagtcaagctattagttcctttttctcagttcacatataatttcttattcacatcaccagtacctgccacttcgtggaatttaacatatacattttgattgttattgggagaaaaactgtaagtgttgctcgtgttttgcatattaatatttaaggtgaaatttttcagaaattcaggagtcaaggtcagttagaaaaagtgtattgagatttgtgaggttatttctgtaaatacattcttataaaatgttattaatatataaatacagatttttgttgttttgtttcgttttttgttttgtttctgtgttttggttcaaaggtcaccagaaagacctacaggggatcttagagaaagaatgaagaacaagcgccaagacgtggacactgagccccagaaacgaaatacagaggagtcatcctcacctgttagggtaggattgaat

SEQ ID NO: 73240 - DNA, 1049 bp, Homo sapiens
aataccaagactatatctgatagcacatcccgaagacccagtgtatttgagaggcttggacccagcactggcagtacagcagaggtgagttgtcactagtatagtcacaggggttctcttagaattctattattgaaatgcttatttgtatcataaaggtgaacaggttgttttattgtaggaatgtttgttcagtaaattttttaaagtgtgttttataaaaagaagtgaaaagggtgataaggtttatgggtttttccatatttttttcctgaagtttttattatttggggagtaatatatcacaggttagctggaattttggtagcatttgttttaattttgtcccgctagcattttttttttccagaaataaatatgaaatttacatagtaatatctgtctcttagacacagtgccgtaactggctgaagactggcaactgcctctatggaaacacatgtagattcgtacatggcccttcacctcgtggtaaaggttatagcagcaattatagaaggtaaactgagaactttgtattgttcatgtactattagaagatggcttttgtaatttatctagtataaaaatctgaaatacaaccatatatttggtcagattttctatattggtggtagtcttaccagtaattgaagatcgacaggatctttttgttattttcaagattaataaaatgtttgctttcaaattaacttatttgttcattatttatttgttttgacagtagatctttttgtagtatgtgtatggcttactttttcccccctaattatgtattaaattgctgcttaagacagcagaattccatggtgtctgaatttctttttagtgaggctatttttaactcttaaaatagtaaaattcaaatagggtataattttagctgtttaagatgttctgaattcaaattttgtacaaattctataggttaaaatgcatttgccaaatcccttagcacagtatgttaatgaaaatatgtatttatatgtggatgaatatgctccatatttcgaacatcgttttgcctt

SEQ ID NO: 73241 - DNA, 4160 bp, Homo sapiens
actgttgtggtgttcattttcctttacgggcccaaagttttaaataggattgaaaattctaattgtcacattagttggtaacatttagttttaatatatgaaaaaggaaatgtttttctgctgtattgtagatagtgtgtatatttttagataaatgggatttttaaagttatatattgtgttctttacaagcatgaagcattttgtttattcaaattcatgaatgtctcattagtaatatttaagtaacattttattgttgactacttgtggaagtttttacatggatgatcagaagaattttttcagttagaaatcttcagtttctgcttttttcttttttcaccagacgttttacacacacacatatatatatcacattaaagaacattttattaagaatatgtgtgtgtgtattattgttgtcattattcttgttttaaatgttcagtccaggaccttgctgtaacccagaccgcatactcagatgctgtattactttaggacaaagtatggtactcttggagtctgagaaaaagtagagtacatcttttttttttttttttttgagacggagtctccctctgttgccaggttggagtgcagtggcgcgatctcggctcactgcaacctccacctcccgggttcaagcgattctcctgcctcagcttcccgagtagctgggattacaggcgtgcaccgccacacccagctaatttttgtatttttagtagagacggggtttcaccatgttggccaggatggtctcgatctgttggccaggatggtctcaatctcttgacctcgtgatccgcctgccttggcctcccaaagtgctgggattacaggcgtgagtcactgcgcttggccacatttttacttaatttcatttcttcgctaaattgggagactcagtacagtagtagctgcaagtgaaattcctgggataattactatgtaggtgaatcttgaatagttcttgatgtcactggtaaaagcaattttgtctctgtggaaagaatatgggcgtagggtgagggaggtgaggaggtggatcattagtcttcacttgattgtctttcatagcaagtccaacccttgaaatcttcaaagtttttttttttttttttttttttttgaggcggagtctcactctgtcacccaggctggagtgcagtggcgcaatctcggctcactgcaagctccgcctcccgggttcacgccattctcccgcctcagcctcccgagtagctgggactacaggcgcctgccaccacgcccggctaattttgtttttgtatttttagtagagacagggtttcaccatgttagccagcatggtctcgatctcctgacttcgtgatccgcccgcctcggcctcccaaagtgctgggattacaggcgtgagccaccgcgcccggcgaaatcttcaaagtttgccttagggagtctaggattggagagaagctctcagaccagcaaagcaataggtcaagggaggagagtagtgcgaatcaggcaacagaggacagaccagaaaaagaaactgtagagttaatacctggaaccctcaaaaagtaaaaagaaaggagatgatagatgaccaatgttttaagtataataagtacgataataaatagcctgtcgtcctaactggaaaccattaccattgaattttttgaaggagactgagctgggagtggaggcatgttgggggtagtagagatgttgggggcagaactaactcatttccagtgacagtggagggaaaaataaaaaattagtgttagtccacttgaggcagtgtggtgggatggttgtgcctgttttctaagttctacataactagcaaataaggaaattttggaacctattcaattttgtttattaagaaatgttttaaaaattgaattattggttgaggattactctatatttgtatattaatgtagcaatatataatgaaactttatgtttttctcaaacttcttatacattgtgatacatttacttattattgaatcatgcttggatatatattgttaaaaaagtttttctcaaagctctacattttctagatctttctcagctccacttctcttagctttcagttttttcgtgctcagtaaatcaaatagacataggaaattttaccagcttctcctccgtatgttcacatttcagctgagaatgagtctaagaaaaattaaatcaaagattatcttataatgctaacaccagtatgtagaattggtgtgtagttccttacttggagaacaattaatatttaattgattttgtgttgcagcaaattattgtttatgtgatgctctccactggttcttaaatttataattactgtgaagtaattctgtttttaaaatcactaaaaattaattgctattatatcaaaagaattattacattttatattgataaaaatatagattttccaatttaaaatcaccatatattatttcatattttccttccttgatgcaccatcttttatttatcaaatgttgttcttagtctttggattcttttaaaagtgtgacctgaagtacctcattgaaccaaacactgtttataattttttattgctgtttcaattaggtactaccacgatttaatttcctttaaagtgatatgtctttactttgaaaccacattaaagatttgtgatctttatagagactaaatgaaacttttttagctgctgtggttcattctagtaacttttgatgattgataagatttcaactaatatttagtttgtataaagcgggatatagtatggtgttttttttccttccccttatgaggcagtttctaccctcttcccacagtagtgtatgctctggattgtatcttggtctagaatttaatattgttttctaatgtcataatatactgtcattatctgatacttgcaaatctagttgaattacccaattatgtcattggattagatttttactatagtttcagtttttgaatgttttatttacatacatatatatatatagagagagtttttttgttttttttgagatggagtctcgctttgtcgcccaggctggagtgcggtggtgtgatctcggctcactgcaagctctgcctcctgggttcatgctattctcctgcctcagcctccagagtagctgggactacaggcgcccgccaccatgcccagctaattttttttttttttttgtatttttagtagagacggagttttgccatgttagccaggatggtctcgatctcctgacctcatgatccgcccgcctcggcctcccaaagtgctgggattacaggcacgagccactgtgcctggcccttaaaaaatatttttatgtttacatcaaatctaacagagcttaaacgtaaaataaaataaaaatatttttacaatttgccttttttgttattactaataatggtaaaatagtctgataattacttttaacacctttgaattttatgtcagtgtagtatagattatagaaacacctcgactttttctagttctacagtctgtcctgttttgaaagttgtttctatcaacattgagttttgttttgttttgtttttgtgttactggaaaataaatatgcttgatcagattgttttgacttctgtcaggcaaagaaaatactaaaatatcattcatttttctcaacctgatttttggaacataactgctgttgtcccttaaacttatgaaacataatttctgctatgaaaattttcacccaattttatttttccattttctttagcataactctttttcagttaaccagttgatggttaacaactttgagttactaaattttgaagcaatttttgtaagtaacttttataaagtaaacattttgtactgtatcttctgaggttgattgtactatgaaaacttcactgtgtgagtaggatcatattcgttcactctgcagaagaggtacaattctagccaacagatctcacagctgttataaattcaccagtaaggcatgttttagaagatattatctctgtttacctgtgacctctcctatgctttttttttttaatctcccaaggaaaatctcctgtaattttacactgttacctatagttttatctacttgtaagctgtgggctcagttatttaaaac

SEQ ID NO: 73242 - DNA, 1100 bp, Homo sapiens
ccatgaggaactggtaagtgctacttaattatttttctcattagcattttggaaataaaataatacttagttgaagaatcaaaaactgggaaaaattttgtcctctagaaggcaaatgatagatgttttaaatcatggtgtgatcctgttgagagtcaccctgggtcagtgttctctaagggaatataaagaacgtgccttaccctaacaacacacactttattcagcacgtgggcttcctaagaaaatgtcagacaaattccttgaaggttaggaaggaactactactacacttgacctgatctgcatgtgaagcggtataagcaaggatgagtatggaatcatgcgacagctttgtggtcactagcttcctacaacagcacaccacagattaagtctcaacacagcactcattgttttggtattagcagcaggaattgttcctgccctgacttccctaaccctcagggttttggtcctattaaagtacctccaattttagcattgaggagagagtctgttttttggaacataacagacaatacaggaaattcaaagaggactcacacaatttgatactcccttagcactttttagtccaagatactgtatgtttgggttcatggcaaaagatgcaaggattcttgaaggattgtagctaggcttcgacaaatcctcatcccagatgctctccagacagtggaagtgttacatcaacagccccattcttgggaagggactaatttttaggtagtagcttgtttcttagtgactcatttttttttctggctctcttaacagaataaaatatagtcacattacaggagctagcaattgctgatgacaaatataagattatttgcattctctgaaaatagcccatttagaacataaatgtacttgatacttgagcttttttcttctcaagggaaaactgttaaggaaagcacctttcaaaaatattatctttgaagaaataaaaggaaatttatcatgatttgggaagtagaattagtctaattatgcttttttttttttgcatcactgccagcacacatatatgttgagagccattacgtgtaaaataccttgtcaatgga

SEQ ID NO: 73243 - DNA, 1032 bp, Homo sapiens
actataaaagctttctgccacccctaaactccaggggggacaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctatattaggtgtctctggatgtttcattttgaaagtttgctgacagtgtgctataaatcgttcattcattcattcctccaacacgttcgagtgcctagtatgtgcaaggcacagtgcaaggttttaggaatgtgcctatgaactaaacaggcactgtgctcagctgatgcctgtcttaggaaagacggaagttaaacaattaaaataacagatgtgacgagtgataaaaagaagggcagggtgagacatgagtttatgacaggaaacagtctgaggagaaatagtttagctaaaaactgaagaataaatttccgttaggcaaagcagggaataaaattaaagctgagagccaaactcagaaatacactgaacttgtaggagtgaagaggtgtgatacctttcctcacctat

SEQ ID NO: 73244 - DNA, 1079 bp, Homo sapiens
cagcagttagaaagatctttttaaaaatgtgtatcagatcttgtaactctgttgatgagaccaccctccctgcaatagcttcttgcctcctctgctgtaaaaggcaacgccctgtgtgatcaggcctctctgaccttatctgctactactctacccctcttttgcctcttcgcattggccttgaaaatgaaacacacactcttccctcggggcctttgcgcttattccttctgccgggaattctcttacccctgatatcttcagggcttgctccacttgcactccctcactgtctgcccttacctccctcatgtttttgttcaaatgtcactttctcagaaaggcctttcctggtaacgtcattaagaattttaattccacactaccctcaaccctgattgcatacacacacatagacttacattccccttctgcgctttaatttttttctccctaagacttattactatctaatatgtacttagttatcttaaatatcgtctgtctctctcaactggaatgtcaattccataaggttaggaactaatgtcttatttatgcatttgtatctccagtgcctctaaaagtacctgagataaagtaagtactcaagtatttgttgaacaaatgaatgaatggatgaatgaatctgcactggaaccccaatacaaattttggtgaagcaggcattgaaccaatggaatcatccaggccttgcgacaacttttagcagcaattcaccatgatacgttactcaaaattcctagacttcttctaaattaacattagccatccaatatttaccacaccaaagatttcttcctagttcctagctaatgatgatgattgcatagatcaagcccatttcaacattttgcatgatttattatcagtctctcagtgttattgttactgctcaaccaattcactccatatgcaccagtaatactcatttcatcaccatttttatgtgtttaaaagatctctgttttaaacacataattataattgtatgccccttctttatgttctttcagcattcttaagtcttttgcactctttgtaaatgctgaagttat

SEQ ID NO: 73245 - DNA, 1052 bp, Homo sapiens
ccagctactctggaggctgaggcaggaaaatttcttgaacccgggaggtggaggttgcagcgagccgatatcacaacactgcactccagcctggggcaacagagcaagactctgtctcaaaaaccaaacaaaacaaagtatagtttgtgttttctttttctggacaattgtctacactggtgaaattcactgcacattattttatttttctttatattagctacagtctttgatggatgattttttttccactagtaatattttactttcttcttacaataaattataaatactttttccacatatcaaagttcatcaaagaactcccaaaattaatcttcttcatccttcaggaattatttattcacacagcagaccaccatttcatattttaaatcctagggctctcatgcattccttgtgggcctcaattagatgtccacagtgttcttctcctttctcgatgatacacgcatcgcgtgccttcttggtctccgggcaagtgcagcagggcttcagcggcctcttctcctgagactcaggcagggcagggtttgagtcaaccagacccggcatctttcgcgccaaaagcagctatgagcggagacagccaaatctatgccagcctcggcaaacgccaattcgtccgatttctttaaattaaagttgattgcacctactgtgctatacatatcagcaagaccatctcatccttctccctctcttggtttcaaaattaagaagtcattttaattctgtcactccagataagctcttctgtaatgctctatatatcccatttccaaaggtcaggggctcaaggctcagactcttgtcaatgtggaaaaggaagctctgcctgtttgcttctgagaggcagctgttctctgaaaacatctaccccaaagggaagcgtgggggtgggggagaactgattgcctttgattacttttatacccctgtaactggctttaactctctgacttttcatctctttcaataccagttcatgatacaaatatcccttgacggattggggaactaatagtgcc

SEQ ID NO: 73246 - DNA, 1745 bp, Homo sapiens
ccgccgggcttgtagtgaatcccagtcggctgccgcttcggaagcgatcggccctcttccttccgtgccttttgctcaccgcccacacagtttgggtcctaccaccgaggctacctggttctcagttacccaaccgttgcgggggccccaggaaaggacggcgtggcatattaaaggcaaagtaattaacgtgagcctgttttcctgtgtgagcccggcaagttgtaactcgcgccaataagcagcataactttttcaagttacgtcatgtgttacatacttctaaaacgtctgctttctctttggtagttggagttccaggagcgggatctataaacaggaaggagggtggtggaataggattggggccttagggtctatacagaactgacttggtttccggccatccggttccgctccctgggggagggtttgtgtcatagcaagcgcccaacatttcccagggcagtgggtgctccgttttggagccgctgcccagacctcttggctgtcatcgcctcatggcccagggtcagaccccctgggtcttggatgggttgactctcatcacaggagcacccagtttaatcttgtagtgggcaagggagcaggcagtgggtttttggaggctaggtttccagtgtcttttcccccttttaattcaataaacatttatctagagccttaatgaatatttagatacagttctgagttcactggaggcaaagatggctctccagggtcattaaactttgtaatttggatttagggatagtcaggaatcggcaaaaaagagggaatttccaaagttgagctgtcaacagctggggagtgtctttcaataagacctcttagttacatcttctcaagtggaacttattccaagaattgcctgaatcactgacttaaaaaactacattaaattttacttcccttctgctatagagtgtaccgtgagctagctatgctatggttggctatatctgcagaaaatagagctggcatgactaataataataggtttgtgtagttcagtaagggggcttcatagttgttctacttcagttatgctaaggattatttacaaagttaggtgaacttgatgtgtctgctgtgttggcatttctttgagaagaccagtgcttttagggatcacatcttttagctaagacctcgccatgtgaagtggatgctgaaagtgttcttgttggcttgtttatggcaagcttaagttgtgagttttgcaggtttttatttatgagctcacttgcacatgttttatgctcaggaaaatctaactggttaaaattcagaggctttatgttaattcctcatccaaaaatacagtattatttgggggaagaggagtggagggatattcatgtttgtagaaacttaagtcaaccccatcagaaaagtattcattgcagctagttattttacatgaaattagaatacccaaatgtattaaatatttgcttctgcaaaacgtctttgcctcaggtcaaaagctaggtgtaaaccacatgtactctttgttctaaagataaatttaattgagcacagtttcttatttgagagaccagaaagcaaaataaagagttaaagttacctccggtgtacacagtgttgacacagcgtacatgtaagagttctagtacagttgaaagtttgagtagtaacatttataataaagatagtggtttctccttgactcatatttactttaagaatgtctcttaaaa

SEQ ID NO: 73247 - DNA, 1051 bp, Homo sapiens
tgggaataacaccctagctctgtgtgatctggctctctcaaatgtctgtacagattcaaaggatcttctctgagatttgtgggtggttttatctcttgaaggctgacttccacaccctattcccatcctaaagcaatggagtccttgggatgttagcactctttagtcgttggaattcacagaagacttgataacaaaatctagtcattttcaacaacttaactttatttcataatttttgccatcaatatgtttcactataaatataataaaatttttgaaatcacatgtgtttccttaaaatgtatgttcttttatagttatatccagttttgaattatcgttctgctattgaattaaatttggtagtttttaacatacctgttgctttttgtggtggttactatcagataaatgcctttgtttattacatgtattctaaatattcttccattcataaactatgattcatatccttttctttcctattactattgttttttcttccctgttaaggtatagataaattccaacatcaaacaaaagcttttggaacaactcagacaatatctgtagtggttctgaatcacgtctagatgggcccttccacatgtctgtggtatatggcaaaaacagtctccacaaacctacatgctattctcattgcttgcattacaggctgctttcttgaaaaggcaaggacatactaatcatgcttctagaataatagcatacaattataggccagggaacctctgggaatttttggtctgtgccagtttataaaggaacagcccaaggtttgaccttcatcactgagatgactctactggagagtttgtcagtcactgcaacatctgatttgatttttggtaggtgtttgatactaggccacaaattagcacaccctgtcatttaaaaattcttgtttaaattattgactgagacttttttttgtgtgcgtgtgttactgtaatgaactgaaatttcccatggcatggcataataactctttgtaataaacatttaaagggtagataccttttgaaat

SEQ ID NO: 73248 - DNA, 1060 bp, Homo sapiens
tggatgactccggctcatctggacccctcctccatctctcatagacttagaatcttttcggtggttggtgggtccctagagtcacactttatttttagctaaggtggggtcacttctcaccaacatttgcaagtgttcgataagcaatgttacatctaaaatcaaatgagttatagtgaattctgagggagatgggcaggtgttttataatatcaaatattgtttgaaattagcaaatgaaaaactaatcaatatcttttgagcacttattgtgtaaggagcatagccaaaaatataaaggcatagttccacctagtttgaattggatgaggattaaagaaattatgtatttgaaagtcccttacacatacagtactccaattaacaagtattatttcaccaaagcctttcagcccttagccaaatggaatttcttccttttttttttaagtatagcttagtgattaaaaatagggtttcctgagcttcaaagacctgtgttcaaatcttggccttgttgcttataaactatgtcactttggccagatgacttaaaccctatgcatcggtttcctcacctgtcaaatggagataataatagtatgtacctagtagagttgtcatgaggacattggttataataacaacagctaacattagcaagcagttattctatgtcaggtattgctccaagtgctttatatgcaaatatatgtattaaatgtatgtaatagatgtttcacctcatttaatgcttgctacatggtctgtattaactagagtgggggctcaataactccaagcaatgcctttctattgcaacctgaagagggagattagaaatgtagaaaccatccattcatatctctccctcatttaatagctgaggacactaaggcccagagagtataatcatttggccaagggtacacagcatggcagtaggtgccagagccagggcagagtctcccaggctcacatcaaagggtcgtttctgtggagccaggaggtgacattgggatgaagggaaggctttccctcatccatagggttctcaggt

SEQ ID NO: 73249 - DNA, 1173 bp, Homo sapiens
taaaaaacagattttttttgagtgcatgcaaatcaaatccaacttaaaggaatctgtgcaattgacggcaaatagatctctctttgtgcagttcccttggaggtgaaaatgataatctctgcatgcaatttaaggcaattttgtgtgtgtgtgtgtgtgtgtgtgtgtgtgtgtgttttcctggtgttttagaaagcctggataaatccaagttaattttagttgtagcagtcattccatcggttataggcttgtaatcaactcttagctgtggtttgttcagatatttacaatgaatgctttcttgtatctatacagtactgtaaaaggtactgtgctataactttataagtacaaatgtgcctaaatctgatatattttataaaattcagttggcagctgtgaaggcttgcttttgtctcttcctcccctgcacaggctaagtccttggaatcagtatgttaatgaagacttggtatctcaatatgaaatttgcaccatgggagttctgagataatgcgtcctgatagagcccctaatgcctgcctcttaggagggcgagtgacaaagacagtataactcagctaagtcctttcataatcaggcagccttggtctttctcaagtggttccatagtttctgtgtgtgtgctttcttgtgtttctgtgtctcagacctcttctctccttgggcagtctgtctgtaatcttttaatactgcatggtagattggattggatgagccccatcacctttggataagaaaaggcttttggacacaagtccatgcaacactcttttctttagagaacacaatagatcactgggaacatcataagaggtgctctcagagggtgcttataagtggcaccatcctaaatccaggtttaccggggacagtctgggtttataactcatcctggcctaatgaataatagcaccctcttttagcacagcatgatttagataagttatatggtcaccccatgcacatgggatgtggtagataacaccttttaagaataaagtgaaatggattcaagtgaagtgacttacctacccatgtctagttgtgtcagattgaatccagaattggtccaggttatcctggtcatttcaccagctacccatattgctgtcctttgaaggaattacaatgcttggctggttctct

SEQ ID NO: 73250 - DNA, 1030 bp, Homo sapiens
ttagtgatagaaaaaactgtggctgaaccaagttttctgggatcactggaatgatgttagctaatggagtccaatgttgaaagcatttgttgcgcacctactggatgtcagacactttgcagacacgatcttatttctcctctgagcctaataataggtatcatttcccttaaatttcctcatgtgtagaattgaggcctatagatgttaagaacttgcccaagatccccatgcaaaagtaattaggagaattaggagtcagggtttgagccccagggatctaagtacattgttaatgtagagaactgccctttgctgggagaagttaagcacttggctggctcccctggttgtatcgtgtagcaccaggaccatgtggcgtatcacttccaaatttcctaaatcactgtgatcctgcatactccttgcccagacccctcctgtggctctctcctgcttgcccaccgaggctcagctgcctagcagcagatccacagggcctctggtatctggcgccaacccgcttatcctgctgggttttcctctagctcccctcaagggcctgtgtggctccagctgccttttccattagtgttcccatatgttccaggttaaggcctccgctttgccttcgattgtaccttttctgtcttcattgcacttgccaaataaaataaacaaaacaaaacaatgacagaccccagctctccagtccctgtcaagcagtcatctcaaaattttaattcctgcctcttctaggatgccccaaatgccagcctccctctctgcaactctactcatcttttcatctaaaacagagtttataatgattgagttggtccttaattgttctttaattccatgtcttttttctctaataagaataagaatgataatagcttcatttattgagtcagatattgtgttctccactttatgtggcttccctcagctaactcccagagcaatcttgggaggtaagtacacattttcttcccatctgacagactggaaaattgaggctcagaga

SEQ ID NO: 73251 - DNA, 1065 bp, Homo sapiens
gaggtgcaatcttagctcactgcagcttccacttccccaggctcaagggatcctcccacctcagcctcccgaatagctgggactataggcacacgccaccaacacccaactgattgttgtatttttagtagagatggggtttcgccatgttgcccaggctggtctcaaactcctgagctcaaagcaatccgctggcctcagcctctcaaagtgctgggattacaggcgtgagccaccatgcccagcttcagttaatgtttattgagttccctccctgggttaaggaatgatacttcagctttaacagtgaggggtaggcgccaggatcaggtcctgggatgtgtggctgtatttttctggcatgagcagctttctcaggcattggttctttccaagcaggaaagtttattagaattttgcacagatgcggttcatttcacccaggattttgtcttagttttagcagcagagacagtgaatctcactgggtcttaatcaggaaaaggagttggccgttaaatgacctcaggagtggcttctggcttagaccctggagatgccgtgtggtttgctaaggatcaactagctcatgacaaatactagaagagacttaataaatctggacctttctttaccaatccaagttgcttgagttgtaaatgatgtaaaaatagcaccctacagacactagttgttcagggtgaaatctcttatttccattagccctgattctagagaagagtggagagttggccttaggtgccctctttgtctttgactgtatatgtggcacactttcttcagccaatggaatggcatacgttgtatgccatctgcaagagcctgataagttgcattacaaatagagtgtgcaaacaatagtactgattaagtgacaaatgttgaggcctgggaactgatttttggcactgacaaattaaggcagattagaccgcctttcaggacacttttgataatgctacgtgtatgtgaaagaagaaggtatcagaaaaaacttaatagagtttcttagcaagagtactggaacataattgtggatgccta

SEQ ID NO: 73252 - DNA, 1007 bp, Homo sapiens
tcagaagagatgagttccagctatgactcagtgtgagttcctatgtcataattctacatttctggagtgcttacacctgacaggaataaactcaaggaaacaaaaagaacaggaaaggccttaggcacatactggttgttctagatgtggagttctgctggcaactgccacagagtgaaattggccacatggaatccaaagcacggcctcacattgtttttttttttttgaatattttatgtaagacagggatgttaaaggtagaggaagtaattaagaatggcagctatgtctttaaaattaaacacatcggtcataactttaatgaaggtgtaaaagtgtttttagttttaaacaggcaaaaaggcttttaaatacaagtaaccagttttgagactttaaaaagcagaagtttttcatgccagtgcttcctattttagtttcaaaggaaaggaggaggagctgaggtttggatggttatcatagatgagggagttgacatgatcaaaaatgtttttttccctgggaacacatcttgagtgcttatctcttctaatagataaagggctggtgaattttgaatgtttcctgcagctctgaagaaacactgtgatcctaatgaacaccgaggaaagcttgtattgcagccctaaatattacctgcttcaaggaggcagcatgttttggtacagtctgatcatgactataaatcaaagcatctttacttctccagggagataaaaaaaatcatgtgttactttataaggatcttgtagttgcagtatgtctgtcagatgtttccatttttatgatttaagacacttggtgctgctatgaatagcaaattggaaaaattgggcattttttaaattttgaattttatcttagcatatatctggaaatgaaatagcgatcttggaacagagacatctttgttagaatatgaaagaatgtcagtgaattctaacttgaagctacattgagatgacatgttaaaggcatgaata

SEQ ID NO: 73253 - DNA, 1076 bp, Homo sapiens
cttcttgcctcagttctcatactgtaaacgagtgtcctggatgcagacaattcagtgccatgtcttctgcatttttgggctttttcttggtgatttcactgtttaaaatggctccccaaatatagggctaaagaactgtccagtaggactttttttttttttagatggagtcttactcttgtcgcccaggctggagtgcagtggcttgatcttggctcactgcaacttccgcctcccgggttcaagcaattctcctgcctcagcctctcaagtagctggggttacaggcatcagccaccacgcccggctaatttttatatttttagtagagacagggtttcaccatgtcgaacaggctggacttgaactcctgacctcaggtgatccaccagccttggcctcccaaagtgctgggattacaggcgtgaaccaccgcgcctggccctgtccagtgtttttaagtgcaagaaggctgtgatgtgccttatagggaaaaatacatgtgttagctaagctttcttcaggcatgggctttagtgctgttggctgtgagtttagtgtcaatgaaccaacaacttagatcaaataagccattttttttttaaaaaacagaaacacacataaaatgacgttataagttggttgatgaaaattttgtgaccagaggcttgcaggaacctaaccctgtgtttcccccagaagctaaggattagtatttcctatggcggtgttcaaggcaacttcatagacagaactaccatcatgaataacaaggatcactgtgtgggctgagtgcggtggctcatgcctgtaatcccagcactttgggaggccgaggcaggcagatcacctgaggtaaggagttcaagactagcctggccaacatgatgaaaccctgtctctactaaaaatacaaaaattagccggtcaaggtggcgggcacccaataaaatgacaatagagtttaaactccatggtttctgaggcattttctgagtaaattggcatacagcgtatgtactctttcctctagaagttccagaaacaacactatttctttatgtgcaaaatggcct

SEQ ID NO: 73254 - DNA, 1122 bp, Homo sapiens
tctgtaatccctacactttgggaggccgagttgggtggaacacttgagcccaggactttgagactagattgggcaacatggtaaaactccatctctataaaaaatacacaaattagctgactgcggtggtgcctgtagccccagctactgaagaggctgaggtgggaggatggattgagccccggaggtcagtgctgcagtgaaccatgattgtgccactgtgctccagcctgggcaacagagcaagacccggtcaacaaatacatacatgcatacatacatgcatgcatacatacatacatacatacatacatgtaaataattaaataactcatttcttgtcagataaatggctgtatctttataataagatatctgtatcctgtgacttcatcctgtaaataattttgtgcctcttgtgctttctatgatctagggaggagaaagctaattcttcttcattttatgcacggagcagagacacggagagcctctaatttatttcttcttggtgtggccctgttttctgagcatgggtgtgtctgatccctggggagagcagagccacactgtggatctgaggtgctgggaagccatccagtttcctcctcctgaccctgactcaagtcttccctgaaatctctgtcagccccattctctttctgtcagccccattctctttctgtcagccgccctccttacataacccaaatgggttgtttgcaaagctagtgtcgctgaggtgttctgtgtacaacagaaaagaatctagggaggattcctatgtgtcactaaagccagtaattaagtggacaacagggggagctaacactgaatgcaccaataaatttcaagactcctgctaccctaggtaaccgagtcaatagtattagaaaccattttaagcattggtagttttaaacatgctgtttaaaaacaattttaaatttaccttcacttttctaattggatactttactattcagagtactatgagatgagggtctcgctttggagtgcaggggactgatcttggcttactgcagcctcaatctcctgggctcaagcgatcctcccacctcagcctcctgagtagctgagactataggctcgtgccaccat

SEQ ID NO: 73255 - DNA, 1049 bp, Homo sapiens
atgtggtttcttaaaacacgagtgtgattattttctgcatcctttccatagcaaacatttccctcaaactacatgctccaaaagtaggttctcactgcacttgccatgccgtctcattgcttattgagagtgactgtctctttacaacaaatcaactggttacaattttgaggctttttaggtggcttccaaacttgtcttggggtttgtccctcatatgttcagcagccaaacatgctcaatgcattgtatatttcccagcaagccatgaagcactattgacttattatgaaacttaatttgatgataatgaggcaggtctataaaatagcactttgggtagtttttacccataaaatagcaatttgtggaagaccgttagtatgtagcatggactctgaagctagagaacttgagtttgagtctcagcttttctactttttttttctagtaattttatttattttatgttttactgttaaattcttaacctacctggaatttagtttggtatagggagtcatgtttggatctagctgttgattctttttaaatataatttttagtgatttttttattgtgataaaatatacataagatttatcattttaaccattttaatttagatgtacaattcagtggcactaaacacaatcacaagttttccactttttagctgtgttagaggtcaaattattttacctttctgcgtctccgtttcctcttctgcaagtgggaataatactcccattaagttgttatgagattaagacttaattcaggccgggcgtggtggctcacacttgtaattccagcactttgggaggccaaagcaggtggatcacttgaggtcaggagttcgagaccagcctggccaacatggtggaaccccatctctactaaaaatacaaaaagttaactccgtatagtggtgcatgcctgtagtcccagctactcaggaggctgaggcagcagaattgtttgaacctgggaggtagagtttgcagtgagctaagattgtgccactgcactccagcctgggtgaccaa

SEQ ID NO: 73256 - DNA, 1049 bp, Homo sapiens
ctctgggagtcacactgagaagtcatcttggattgggacaagtgtcttgcatgctagggttgccttagaaaacacagactttatactttttttgttgtgaactaaaaattaaatttaactacatttcttcttacttgtagaagaaatgtcttctctccttgcactgacaattctaaagaaagtctcaattgtaggctagtgtttcttctctcttaaaaaaatgaaagaattgatgatgtcttcctaaactggaaaggaggaggagttttgttcaattcgataaaaatgtgtatcccacattctttcatgaagatcttaccccattcaaagagaaaatgagaacactttagtgtgtatattaatgtatatattttcgagctggtctttggtagccaggttttgttttgtgaaatgacagatcagcagaaagacaccaaaaacacagtgaactgaactggagtttgaaagtgaactgacttaaaatttgaaaatatttttcacaggatagcagagttggaagaggccattggagtcatccagtgcatacgcacggccaaccatgtggagtttacgctttgccttttctagtgctcactgggcatctattttcaaggtggaacccgtagccaatggtccctaaaattattaatgtgtttataaattattgtgcctgtaaaattatgtccattgccattggtagctgacaggctttataaagtgtgaatgagtgaatgattggctatttcttatcagattgaattccttttaggatagttcatatttggcataacttccaaggaggattttcccattattacatatcacctgatcatagctgttgttttggatcagtgtgtattgaaaaaaagaacagagagacacaaaagggatattatgactttgataactacagtagtgtcagaatgtgttggttttgttttcagttctgtttctgatcttaatagagttgttaagatctttgtgcagcaggttagtgctctggaactgaggtaaatacccactcctaattcaattgtattttttttttg

SEQ ID NO: 73257 - DNA, 1029 bp, Homo sapiens
tagtcttgttagacataaagtcttaggatttacacacattttgtattttctctgagcttagaacaggttcttggacagagcaggaactcagcaggtgtagaaaataatcgacttcttttcagtatttgacatgatagcgccttcctttgttgtctttggtcacatgctttcctggtcacttttctacttcctttttcttctctattaccgtatctggatattctttctcttcctgcaacttagtgctagagttccctaaagctttggtcttcaatcttctctccaagaccttatgcctcttgtgtctcaaatatgttctttatccctttgactcagttgagcactagcccttatttccccggttccctaatattcagttcctcttagatgtcctagtgaccctcaaattccagtatgttctagactaagcccattttcttcttttccaaattagtatatcttcgatccttgtttctgttcatgctcctactgtttttctccagcaccccaggtcagaatctcagaaattatctttgacccctttcctccattcatttttacataaatcaatcattaactactagttcagtatctcattgcctcgtgcttggaattctgtgccctccttccactgttttcctggtttacctgtacgttttattccagaggaaatgagaaaaggctgcactgtgtagaggggagatcacagaatttgatctaaagcctgacccacccggtttcaaacctgaacacagaggcactcactagccaggcaacttataatgaattatttaaattctctgaatgtcagtttttgtgtctgaaaagtgggaggtcttagtacttatgttacaagatggttgtgaatataaataaaataatcgtcttagtgccaacacagtcccttatatatattagccaagaaatatttgttgacttgttgaattaagttttgtggcatgctgtgtcatcatgcaaattgaaatatgggttaagaagcaaagtgtcaaaagagctagtatttgagta

SEQ ID NO: 73258 - DNA, 1041 bp, Homo sapiens
tatggatattgttcactgctgtgtgcatataaagacaacagtcaggtgtcatatgcaaaacagcaaaaagttactctaactttgatgagaagcaaacagggtattcataaaagagcataaaaacaaaattaggtgaggtatcctgtgaaaaggaaacttactaggctaaagtaaaataattgctgtttactgtaggtcgagtgccaagcacagacagtaatattcaaatcaacaatgactggatccttgctagctcctttcccttgctgagactcagtattggataagcccagagtatccacgctgtgaaacctgcccagctttctctgtcactctttagattcaggcctgtgtcatttccttaatagttttgtgatggttaatgactttacatcattatttccattactatttgaaaacaagtagtaaacagagattgtaacccctggatattcatgcttttccagtgaaatggcaggatcctggaattaggaaggatgagagagaaaatgtcatttataggattatatgttgtagtcttggttatccagattggaattaggtacatggtttgtttgggcctgaaattttatagcccagcctgattcaccctggcatgtctgagctatctctttatttttaattggtatatgttttcagtgagggaaacattaaaccatattttaaaggtggctaaaattttagcaattaggatgtacaataagtaaaattaataaatagagtcatacaccacataatgacattttggtcaacaatggaccacatatgtgacagtggtataagattataatggagttgaaaaatgtctatggcgtagtgacataggcgttgtagccacatcttaacatctgagcataacacattaccctttctatgtttagatgtgtttagatacaaaaatacttatcattgtgtcacagttgcctacagtattcagtacagtaacgtgttgtacaggtttgtagcctaggagcaatgggctatatcatatagcctagccatggagtaggctagacactt

SEQ ID NO: 73259 - DNA, 1087 bp, Homo sapiens
atgagcccggtggttttgtgagttgcagcaaaattatcttccccatccctactgcaatggatgaaatgatgcctgtgtggtgctggttgctttggtccagctgagtttcctgcacacattgtcaggagagggcagttggcaccagcttcccgttgctattggttgtgcaggatgtgctctccatctgcctcctggctggccgagggctcagcttctaagtggcggtggcggggtggcggggtggcggggggactttgatggcattccttgtgttgaataaagttgtctctttgagaactgcccatacccttattttttattttttatttttttttaaaaaaagaaaaacatattttgttttcttacatacttgtcatttgagttgtcacacagaaaatatattggacttcttgtatttgtaaaatgtcttctcagatcactcctttttcctttcttgttaaaaacaggttcacagacagtatgaagtggcctttctgtttacatgtgttcttgttgtattgtctttgcagtcgaaatcagctgtccgccctgcctgcctgcctgtgtggtctgcctctcaaagtcttaatcgcaagtaacaacaaacttggatcattaccagaagagataggtcagctcaaacagttaatggagctggtatgttaccgatttttaagatgctcttttttgttggttgactgatcatagcctctcaaggtattcagaaaacctttttgctacggttggacaaggtagagcctctgttgtttgagggcaggtatatgataaagacattaagtggggagaggaacagctttgaaacttcactgtgacagacacagttcctggaatttaaaggcttcctgtaatttacagctcctgaagtttgcaggatttgccgtttttgaagtttatgggctatcatgttgtagttagtattttcagattgcatataaatttgtaaaaaattatggctaaactgccaaaataatctccaaataagttagtaggccacacttcatgaaggtataaaattaagtcagaagacagaaagaatggggtgctctgattctgtcgagattttaga

SEQ ID NO: 73260 - DNA, 1027 bp, Homo sapiens
tatttttaaattgttcacattagactcagagtattccaaatggaattttttttttttttttttttttttttgagacagagtcttgctctgtcacccaggctggagtgcagcggctgtcgccgaggctagagtgcagcggcacaatctctgctcactgcaggctccgcctcccaggttcaagcaattctcctgcctcagcctcccaactagctgggactacaggcacgtaccactgcacccagctaacattttgtatttttagtagagatggggtttcactgtgttggccaggctgctgtcgaactcctgacctcaagtgatccacccaccttggcctcccaaagtgctgggattacaggcatgagccaccatgcttggtcagaattgtgaactctctttttttctaagtgtgagtgaacattccagagtcagcaatcccttaaaaaaataaataaataaaataaaaaaactttagccatctacaacaaagcagttgtcctttctaatttgtgaaaggaattggagttggaaaatggtatcttatctttctaaatacattagaattatataagatctttttttaatgcattcccattcagtcactgccttgtcctgccatttgagactgtgcagggaatgtcgaaaagcagttgttccccctcccatgaggaagccacaaagagacactactgagatgtccttttcttgactcaacaagagcagccaggttgtatttccacattgttgcaggtgcaggaaaacttatggaatcttagctccatggagctggcccctccagggtcatttcagatgggaatgatctgaaactttctgaccttcctggctgctctgaatgacttctatgtgctctgttgcctcactgctgtagcagtatggatatgttgctttgtacgtctatctgcctgtgctttctataaggggaagagataaagcattcacatttactgagcacctgctatataccaggcactctgctaggtatacatgtattatttcatatagtctt

SEQ ID NO: 73261 - DNA, 1065 bp, Homo sapiens
ttggccaggctgctctctaattcctgacccccagggatctgcccgccttggcctcccaaaatactggtattacaggcgtgagccactgctcccaaccatatattccttatttgaatgttagctggaaaatggaatttaaacaccttaaaacatggttattgattatttagagacaagtctccagctcaaatgttaaactgcatgagagaaaaatgaagtgctatgctttcagatgcttaaccatgtaaatattttgaagtttattttctttttaaataatttaacagcttcttaaatctacaattatttttaggctctgaattgctttctatcagctcgaaaataattgtgcttttctcatcttttgtaactggaatttcaccaggctggtcatctgagtttatattttttatactatatatacttgaatacatttttgttagagttttatagtttaatgcaagaaaaaatgggaaattgcttaagcatgattttctattcaaagtagaatttggagggaatgattcccaaaattcttacatgttttggaaaggacggatttagtgtacattggtagggtgttacttaaaatgaaactgggaaaattgaaatatacagagtaaggatttgatacttacattttgttttgtcattgaaaaatgaatatgattgctattaatttctttgtagatttgcacaaagggcaaagttcacatatttaagtatctgagcatacaagcatgccagattaagacagctgactccctttatctccacaccatggagaggccacatttacaccagcacgtggaagatgggtgagtcatgccctcattcaaagccccagtttaaaatttgcctaggccaaggccctccaggtagctgacttcaaaatctgtttgttttaagtcaccatggtatctgcagaaaacaaagcaaaacagaacaatttggtttaatcacctaatttgtatttaaaacaagaagttgagaaactattgggatatgaaagaaaaaactgctgctattgagaatattttggtatatctcaaatatcatctgtct

SEQ ID NO: 73262 - DNA, 1022 bp, Homo sapiens
aaagaagaaagcagagtgtcaccttgttccacctcatctgggaacatacacatcctgggactcaaattttttaccactctgtagatgtctgcagatgacctccagagcaccacgaatactggttttgggactaaaaatacatgttggtgaataggcaaattcacaaatgcagaatccacagataatgaggatcaactgtaaaaccatttagcttagcaaaagcaacccagtacgcctgttttgcctaatgaaaaaaagagacattttatactattggctacttttagttgtgaaacaaaaaaataaaaagaaataccctttgcttctatcattgaaacccaacaaaacgaagtaagaacacgttgtcttggtcatttctggtagtatatttttacccatgaatttttctgtcatttggagtgtggagagtggcacagtcttttatacgttgactgtattgtacatgaaaagtataatcactacagaaaaagtccaagtgtgttcccagccagagtccagcattgggcagctagccatgtccttgggaaaagtcttgtcctaacaacacatctggaggactggctggtccccagttagctaatgatatgccagaaccttgacaccaaaaatggtccttttggctggtgttctctcctagctagggaaatgtggccctattcaggctggctttcattctagccatgagctgggttaaagcagcgtttctctgtgtcagagatgaacgtgcaaggaggcctgtggaaggctcatggtggtacatgactttccaaatagccagtgtcactacattgccgctttgggaaaaagtggggtgacagtgcagggagaacatttgagtgattctggatgttgtacacgtgaaaactattagatgcaatcagaagcacttttctgttgttaagaatgttacactttctcttttccccactacacacatatgcgtgcacactcacacttaaacacacatccctgctctcacaaacactaggatgcatcttcac

SEQ ID NO: 73263 - DNA, 1048 bp, Homo sapiens
attatgttttctcttttcataatacattgacatttctatgctttaaatttcactttgtatctttttttttctttccttgttctcacagtggtcaaatacagctggagacatctccggtgtgtgaggtaaggctgctggtagattcaccagaactctgtgcaatattttgccatggaatactggccaccacattctgtaaagatttgtcagggagtgaaacatctttattaatgaggccaatattcagatttgttcaggacacatttttcaacttgtttatacgtttgcctctttagttctgcttttctgctatacctcaccctctgttgaagatgagagttggctatttctattagattctgtagatttttttacctcagatcatcttgctgagtcaagcgatggcaactaaaatacatagggaatctgcctgtgtgtcagaacctggaggaggaccattcaatgtagattttagagccaagaaaaggtctgggaattggccagatggaaattagctagaaaacacctgaaagacaagaacaaattatttgggaatgtcgaggaggattgagagaatatcatgaagagaaactggtggtgatatttgaagacagggtaaggatgggttcagtagagttacatggagtgaaatttggatggctgtaaagaaagcagttttgacataacactagagatgaccttagaatgtcctaaagccagaatgttaccccaggattagagagagaagttcgagctggtgatttgggaatgaaacataggctacaacccatttcctgaatggatttaggatggctaatttaggcaccaagattgtgtacaaacaccttatgccccactgaggtgtttgcacatgtactatagtaaagcggtttcacgctcttaactttgtctctatgttaaagaaataaggaaaagggaagtattaatgtaaaagggaaagccatgttgctagagagtgtggtttcattgttaagcgcagcgacttggaattatattaggtatcagtcccatctcaaagactggctaa

SEQ ID NO: 73264 - DNA, 1011 bp, Homo sapiens
ggaagtcacaaggaaaagaaaagagagtagtgaattcacagggccagtgataaggattatggagagctaaaatatgatccttacttatgatttggttatttttatattctttcttctgtctcattcaagcagaaagtaacatctttcagcatagccctatattaattcaccagtatttgttgagtgcctgtgctagattcagccttgtttttgtgtaaaggactggaagatgaaggctatgaagttgccctcactttagtgaatttttttttaattgtgggggtaagatttagatgttgaaaaatttgcagaagaaataagatggtctgcagtcctgagcttgttttaggtgctcagggacactggggaaggggtagagtttaaggagaggaaagtaaacttagactttgggcatttttgggtttggccctgtagccaggaggctatgttgagcaagacaccgtggctgtgggggatcagctctgtgtgagccacacggaaaggggaggccaggattatgaagcggtttgtaattggtggcacatcacgtgatctgactttaaacatactttaggtgactgtccacatcaagtgtggatggcactggcatccatgcaggaagaattgcaaattgcatggctcatacataaatatcgaacggggaagggtctgcgagacgataggacaaactagaggaaagaattgcttatagaaagaatcaaacctgaagttacttgttagcagctctaacaaagccatttgattgaatagggatatttgtgacattttattctaaaaatatggtttcctcttggatttgtgtcaaaggtgggaagatttttaaatagcactcctcaacaatgaataggaacaggcatcttaaatgtacaataatttggtggcatatatgaaggtgtttttatatgagctaacgcccaattttttattagggaggatcagggggttcttgactaccttataaagaaggcagatctgggtaagaaactagag

SEQ ID NO: 73265 - DNA, 1191 bp, Homo sapiens
gggaagaaatattctattgatttttttttacctaaggaagataaaatagctttggccccagtggttcctgctgctcggctgagttaaggggcagcctgcctctggaaaagtgactcctttctgagacatcctcatttgatttctgagtctggtaggttctgtgtgtttactcacataacagagtggtcatttcaaggcttgcatgagtggtcaggagttacttttttaaaaagtcttttgagaaagcattctgcttatattaccaattttaatttgttattagtttattcacaaaagtaaattatagcaatgtacaaaataatggttgcttttgaaaagaaagtactctgtatagaaaaatttgattcttctgatttctccatttatttgaagttctgttgctaatcttccttcttttaggtctttctttgttttaatatttttgactctttggtatttagtctacacttactactgatgcttttaagcaagtgctaataaagaattcagacgcttttaaataagaactggtagagaactcagatgttcttgagttctccagtaaagcattttgacaacagtagaggttatacatgtgtatattttgcaaaaaggcacccataggaaaaacaaagatgattctttaataaaggaaatgtttttcattcttggggcaggttgattgatgggtaacaagtggccaggtgtaatggtttcctggcagtttgaatgggccatagaagaaaagccatttgagaaagtgcttgagtgtgacaagggttagtgagtgttttatggagagccaaattttacatgaaataaaactcaaatggctggtcttctcatgtttggagctaagcaaatgtgatcagttccgggctgaggcccttggctgggttttcctttccacggtctcaggtgtgtcctgggaggaatggaggtgagtccaggcacacctcatctgtgccttcagtgacaacccaccaggagacttattttacacgctgaggacctcatgttgagctgcagactgtctcctaatcctcacagtcagttttacacagtttaaaagcatggcataattgagcaaatcaaaagttgaatggatcttcagagaataatattcttttgaatgtataacttgcaattgtagaattattttggtgacttttttattctttttatagagtc

SEQ ID NO: 73266 - DNA, 1007 bp, Homo sapiens
tttggaggttgtcattttttcctatttgcaatttgtctctactatgccctgggcaacagaaaaatttctgtaccgaaatagtctttacaaatatttgtttaggttcccagatctgacttttatgtttatcttcattctctttgttcttaactttgacctgtgattggaatacattttctaatgtaatgctatctttgtaaataacctttataaataaacattatcttattaccagctcaacctaacataatgtaacttgacttttatttatacatttagttattatttttggtaaggttgtcctttttttaccttgctcactgtcttgctttatataaaattatcctttttttaaaattctttcaaatatcttattcccattctatctcattttaaattccccatttctctaaaacttattcttcaaacagattttttaaaattggcaacctgggtagaaggtccttgggagtttgagttctcaaagtccccaaagttctgccccataaggtggatgaaggaggatgtggacgtttgtctgtaggtttctctgggcccacccctggagctggatgggacagctttaacctccgtttttaacctgatagtttaacttctgcttttccccctgctcttgtgtcctcttactgaatctttcctcttcccttcactttgaagttaaaaaccatttctatcttctttggggtcatttttgctctttcatttgcagtgaatttgtaggtgctaatttatacttattgaaaattaatctttaagttatcaccagagaatggatgaatggaccagtttacattagtctctgaaataaccatgtatcttgtaccagtttacagatattttccttaattttttacagtaatcttgcactataggtattatttttcccattagagaaatgaagaaactgaggatataagaggctttttagtggctcttaactctggttttatattagaatcacctgggcgttttgtaaaactatagtc

SEQ ID NO: 73267 - DNA, 1088 bp, Homo sapiens
ggaaccactgtgtggtttctctaatatccaggaaacatgtctgtgcaggttgtggcagtatactacctaaattcactgaataaatagtaaaggttagtgggtgagactatccctccacgacatttaaaaaaatttgttatgattttttaagacagggtctcactgtgttactcaagctggtctcgaactcctaggctcaagacaccctcctgcctttgcctccgaaaatgttgggattacggacatgagccactgtgcccaacccttggtggtattttaagcccactttttacagtagtgtagaagacagtagttctgttgtggctgattcataaatgcagcattttcacattggctacattcagaattataagcagcattaggtaccatcccacatccctttgtgctgttgatgcttagtggtcagactttgtagctgtcttcgacctctagtgcaagcatcaacttggtcttgaagacaggccttagtgggcttccaaattctttgggatatattttctgcgtcacctaagaatctgactccaattaggccttgaccccatgaggcttttaatggacacattggggcttcctttgacttttctgagtgctcttggagattcctgacctctaacctctatgtagcagattggctacatgttcctggtaggtacagttcatggttgactattggaggttttcaaatggatccaaatttagggatattttagggctcttattagtattctctcaggttgagagaaatctaatttatgaagcatcaaaaaattaggaaatagatatttatttggttcaccagggaaatttttctacttaattttaaataggtaactttgatctcaaacttctgtaaggcatgagatccttagtttaacagacttgccttctttagatgaggggagttagaatagaaatgtactctgttgtctaaatgttcagtccttcatcttccttactgtttccagagaaaagatagagaagaagattaaaggcagcaactcagctgacagtggtagcctcctttcagcttagggctccttcctgcctatctgggcagctcagagtgc

SEQ ID NO: 73268 - DNA, 1474 bp, Homo sapiens
tccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcgttatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatgttgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttctaag

SEQ ID NO: 73269 - DNA, 1115 bp, Homo sapiens
ttactgatgtgctgcatttgtgaattgaaatgtcttgcccatgtttctaagatctctaaatcctgattcttttcatcttggttgatatgacagtgtcatatcaactgacactgtcaattgatagtgtcattttcaatgacagtgtctactctgcatatttaatgcactctacagtgttgatatgacatgtctactctgcatatttaattaatgtgttacttccactctttacatattaatggcagcatttagaagttaggctatgtttagaagctaggcagaatgtttagttttccttcacatttttgctgctcttttaatgtacagtgaaaatgttaaagtacaaggatgacaaccttgattttattataaaccttcctcatacttccttaatgttatgactatttgtaagcaaattaaacgaccttagagatatatttaatgttcctaatactgatgttcctgaatggtagataaatgtcttatcatctctttatcttctagggttatgatcatagctactacttcattgcaacctttattactgaccacatcagacatcatgctaaatacctgaatgcatgaaaaaactccaaataagagaatctcttcaggattataaaagttgtaaaatgcaactgtattgctgagcaaaaaaaaaaaaaattcaaaacattggattttatagtgctaaaagggctttattctatagttgaatcacctctgaataaagatataaaacctacttctgattttaaaagttattttacaagtgttcacataggaaatctttaatgctctatagctttttcagtgtcgtttggaaattcttgtattaatcccaggtcatagaatatgaatgtaatcctatttgaagtatagagtagcaactctggaacagaagacttaaaagtaatttagcccagactcctcacctttccagactttaagcctctgaagacattggactgtctttgtcatgttcattgttgtatctctagtgtctagcaagtgtctagaaagcaaatatccacttgatttctagtggatatttaataactgttagctacagaataaagaggtaggctcagaaaggttaaatgaattccccatcg

SEQ ID NO: 73270 - DNA, 1067 bp, Homo sapiens
cattgattatatttgtgcataatgttttctccctaaggacttttccttagaatatattccaaaaagtgaaattactaggtcaaaacttaaaagcattttaaaggttctttctgcatcaccttcctaaagtgttttctaagaagtctgtaccatatattttccagggatatattaataatcatggtctgcctgaggatttagttttgttttgttttcattgttactagttcaaaccattgtaagactatgatttggcagtattgattgtgtaattattttctgtaactttgaaatgtctgaacttattttctttgatatcttttgtcacactattaaattttttctagcttccccaactcataaatgccaattttccagtggatccccaaaggatgtctatttttggccactccatgggaggtcatggagctctgatctgtgctttgaaaaatcctggaaaatacaaagtaagattatctaaacttctagtgataaatatttctcttgaataacataatattaggaaccttcaaagagtaaaattacaatattgttagtattggaactaaacttttctagtgttgagaactttggggtgtttgaagggtgggtatttaatttgaccatagagtgtatgctgcagaatcagacgcataggaattcagcaagagtgctttcttattggcctactggaagtattataaaatgtagcttctcctttaattgtttttattccaactatagttttgaacacactttttttctgtaaaggttattattactgattaatgttatagtggcaggatctatcatttatattcttaccagggatgtctttgtaaagttgactttgattttctgaggtaaaagatatgatttgtagaagcttaagaattgtgttcttaatgcctctaatgaaaattgaaatgcagcttgattaaaaaacatcactctcagcctttcccagagtcaaatttgaataactaccatatgtagtatgtcatactgtgcagaacagcatgttacaagagttgaataaggaagtgttaaagcaactagcatcttaa

SEQ ID NO: 73271 - DNA, 1042 bp, Homo sapiens
cttgagttctcttcctattaaaaaaaagttctcaggaaagaatcagaaaaagccattcatatgaccttaaaaaacaggttgatttttttaatctttatttttattgtagtttaacaaattatagttgtatatatttatggagtacaatgtgatgctatgatttatgaatacagtgagaaataattaaatcaacctaattaacatagtcatgacctcaagtacttgtcatgttttgtggtgagaacacttgaaacttactctcagtgatttagaaatgtgcaatggattattatttactatatttgaaaattttagtggtgaaagttacctaatcagttgtcactactgtatctagaaaccaatcttgaaaatgtgtgatggcttttttggcgccatctactcatggagccaccgctgcaaccctgagtcactgcctgcacagctctggccgcctggctccccatactagctgccaatatttggagttcttacaacatggcagacattgacaacaaagaacagtctgaacttgatcaagatttggatgacgctgaaaaagtagaagaaggaactggtgaagaaacaaaaatcaaagcacatcagctaactgttcagatgatgcaaaatcctcagattcttgcagcccttcaagaaagacttgatggtctaatagaaacaccaacaggatacattgaaagcctgcctagggtagttaaaaaacaagtgaatgctctcaaacacctgtaagttaaatgtgcacagatagaagccaaattcaatgaggaagttcacaattttgaaaggaagtatgctgttctctgtcagcctctatttgataagcaatttgagattattaatgcaattatgaacctacagaagaagaatggaaaccagatgaagaagatgagatctcagaggagttgaaagaaaaggccatgattgaagatgagaaaaaagatgaagaaaaagaagattccaaaggaattcctgaatttcggttaactgtttttaagaatgttgacttgctcagtgatatgcttca

SEQ ID NO: 73272 - DNA, 1496 bp, Homo sapiens
caacaaagacactcactgtttctgtctttaagataaaatttagaataatatatatatatatacacacacacacacacacacacatacatacacacacattttatacacacatatataatcttatgtaatacatatgtgtaatcctagcaggtggtataacatcttaatcagaaagtatttaattgaagtttggactatgaggagtgtcagacttgattatcctttgagaatgtcatttgcttataagaacgtaatgtgatttatagcaatgtcagaatagtccagatgttttaaatggaaaaaattgagtgtacattaattttgcactgacctgtagttctgaatttacctttttgtgaaaattcttcgttcttttcttttaggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttcttttgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatgatttgggttcatggcttttgtttgcttgttttgaggtaaacacagtagaagttgatttgttcgttattgcagtatagaggtctaagcaccaattcttagatcatatacttgccatgacagtgatttgtttttttttttgagtcagggtctcactctgtcacccaagctggagtgcagtggtatgatcatgctcactgcaacctctgcctcctgggctcaagcagtcctcccacctgagcctcctaagtagcagggactacaggcacacaccacaaaaaaacatatgtgtttttttttgtttttgatttttgttttttttttggt

SEQ ID NO: 73273 - DNA, 1050 bp, Homo sapiens
cttaataacatatcctggggaactctttatgtatatggggtctttatatattagggatgtcaatcttttttctgacatttggtgtgaatctttttctgagattgtcctttattgtttaatgttatttgatttttggggaaatatttttgtttttgcatgtactcaaatctcattacttttttttttttttttttgagactgagtcttgctttgctttgtcgcccacactggagtgcaatggcgtgatctgggttcactgccatctccacctcttgggttcaagtaattcttctgcctcagcctcccaagtagcttggactacaggcatgcaccaccgcgcctggataattttttttgtgtttttagtagagatgaggtttcaccatgttggccacgctggtcttgacctcctgaccttaggtaatctgcctgcccctgcctcccaaagtgctgggattacaggcgtgagtcactgcgcccagccgagttccattacttttatgctgagagatttttttattctccatcttaagatcagtaaatattcatcctcaatgtgttctgtttttttcttttgggtcagtttagttagagatgttctattttttaaattgtttcatttttacttttaagtctttaatcaattaatattttactttagctttacttttagttttttagagtatcttattctacttttagtaatgctaaagtaaaggttctgcagtgagaactttattttctttttttaagctttctagtaaaactaaaattagattaaattgccttcactagatgttccttatgcccctcttcccccaactttttaaaaatttaatgggctacccaacatttagaaaaacacttttttaatccaaatactgatttaaaaaaccttaatactgagtcacaaattaaaaagtttcagcagatatccaagaatttataacacagataatgatctgtaaacacaaagcaataacattggaaattaatataaaatattatatttttaaattttttgagacacggtcttgctttgttgcccag

SEQ ID NO: 73274 - DNA, 1050 bp, Homo sapiens
gcctcaagtgatctggcccctcagtctttcaaattgcaggcattacaggtgtgagccactgtgcccggctcacattttatatatagttttaataaaatataaacctcttctttcagcttaggttggcagtaaagcttaggcagtatggacactatggaactggaatctaggccaatgaatggcaagttacttgatctctctgaatctctttcttatctataaaatgggcataatatctatcttttgaagattttgaataaaaagttttgtttaaccatttagtaatggtagctgctatttcagtaatgtttgactataaatgactcatgtttatcatttaagtgataaactacaaggctttttatttatagtaatgttgattagacatatgcaaactacctataataaaaagacatattgatttcagcttgcacagaagatgggatttccacctaatattgtggaatcagcagcagaaaacatggtcaagctttacagcctttttctgaaatacgatgcaaccatgatagaaataaatccaatggtggaagattcagatggagctggtaaagtatcttcttttgtctaacatgattatgcatttatttctctaatatgcttccctaaggaagttaaatcatagaagttaaagtagttaaacttctacctatgtagaagctttttaaaaaaaaatcagatagaatgaatatgaacaaatattaaacccattaaaacaaaacactattagacccattaaacaaacaaacaaaaaataaaacaaacaccttatagagacgtgcacagaggggtcggaactgtactgtccaatacagtgactatcagccacacgtagttattaaaattaattaaagttacataagatttaaaaattcatttactcagttgcactagtcatggttcaaatactcaatagccaaatgtggttaccatattaaaagagcacacacacagaacattcccatcattgcagaaggttttattgggcagtgctgggttagtgtatgcagtgtggtggtgattgagctgtaa

SEQ ID NO: 73275 - DNA, 1072 bp, Homo sapiens
ttcccacttacgagtgagaacatgtgatgtttggttttctgttcctgtgttagtttgttgagaatgatagtttccagcttcatccatgtccctgcaaaggacatgaacacattctttttttatggctgcatagtattccatggtatatgtgccgcattttctttatccagtgtatcattgatgggcatttgggttggttccaagttgttgctattgtggtataagtttttgtgtatattttaaatctattttccttgcaggcaagccattattttcttctttttttacttttttatccattgctttaattgaatatttataagagggcactgtgctggagatgtgaggataaattctcaagaaaattttaaaatgtgggtagagagtaatagatgcttacatctgatattatgcacgggtaggttttaaagtttcattgatgagtctaaaataaatctagagttttggttgtttacttcccttgccagggtcctgtattaataggaagttcacatggtggtgtcaacattgaagatgttgctgctgagtctcctgaagcaataattaaagaacctattgatattgaagaaggcatcaaaaaggaacaagctctccaggtatgttgtattcctgaaaaatttctagcttatgattagagaattatgatacttaaagataaccgtacaactgaagtaattgtcaaaacttatttaaacattttgagtgtcaggaaagttaataacttgtttgaaatagctcattttggaattatttacaattttttcatatctctataaatatttcaatgtggattcttttaaaagagtcactggccgggcacggtgtctcacgcctgtaatcccagcactttgggaggccaaagtgggcggatcatgaggtcaggagttcgagaccagcctggccaatatggtgaaacccccgtctctactaaaaatacaaaaaaaattagccgggcatggtggtgcgtgcctgtagtcccagctactcgggaggctgaggcagaagaatcgcttgaacccaggaggcggaggttgcagtgagccgagattgt

SEQ ID NO: 73276 - DNA, 1036 bp, Homo sapiens
ggaggccgaggtgggcagatcatgaggtcaggagatcgagaccatcctggctaacatggtgaaaccctgtctctactaaaaatacaaaaaaattagccaggcatggtggcgggcgcctgtagtcccagctactcgggaggctgaggcaggagaatggcgtgaacctgggaggcggagcttacagtgagccgagatcgcgccactgcactccagcctgggcgacagagcgagactctgtttcaaaaaaaaaaaaaaagaaatggtttaatgtaagtgacgaattttgaaaattgtgggccttttagacagtgattattttagtgttctaatctagaaaatctacataaagagaatgccttatttttggacattgtgaataaattagacttgatttaataacacctgtcaatatgtatgttaaataacaaaatactatgtctggcatgctgctccatgcttcatatttaatagaagtgtttttcttctaggttcaaaagatgtcgtgataaaggcacaggttttagctggtggtagaggaaaaggaacatttgaaagtggcctcaaaggaggagtgaagatagttttctcgtaagtcacattttttaaggaaaaatcatccttgttaaagactgattaaagattacttattgaattgatgaaaatactgaaatttaaatattagatgagataaaattttggctattatgtggatttgctttttctcaactggaggaaagaaaaatttgagttctttttcttattttagtccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaagtgagtaattgtagacatgatacatacgggataaatttatgacattcaatttcaaaagtccattattgtttctatttatgtgggaaagattttaaaagtacaaatta

SEQ ID NO: 73277 - DNA, 1073 bp, Homo sapiens
cagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgtatgctttttttttagtttaaatatactgtcagtgtaggtaggaaattatttctgtaaatccagttgcattttataatacttgagtgactaactgaattgaaacctattacaattaatagggttctcaaaggcctattcctattagaagaaataattttttttaataattgaaaaaatttaccacagccttgtctgattttaagaatagattgtgtgaagatttagaatggaaagcaaccatttcttcccttcaccttcctcttcttacagttccccaggagtcatttttaaccacttttaatttctgttggtaacctctgtgtttaggtaatatgct

SEQ ID NO: 73278 - DNA, 1371 bp, Homo sapiens
gacctcgtgatctgcccacctcggcctcccaaagtgctgggattacaggcatgagccactgcgcccagccaaatagctaatattcttttgagagttaggttaggcttctgtagcaagaaacaaatctctaggagagatggctgaggctggctgttgacttctagaccgttgtttgattctgtttttaatcttcaaaaactgtacacacatacactttgttacattgaaacagtatctaaagtttgtaaaatgaagtgtgtggttctcacttctcagaggtaactattaatgtttggtatatgtcctagattttttttttctagatctgtgagtatgtatgtaataaaaatacaaatacacatatgtacatacattttgaacagtcgggtcataccgtacatattatttagcagtttagtttttttttttacctaatgaatacattgtagacatctttctatttaggtctacttaagagccttagggcatattgatcgaacagagtggtgtgaactgtctgctctgatttcatagcttggatgtctttgagaaatgaaacactgttttctctattttatttgtgctcactatgctttcagaagaggaatggtatttaacggtagttaataattgagattattgagtgctatggtgctaatctccgaaatttgtttatgtcagctaatttttctggattagtgtcctgtttttggagatttaagtttatactaaacatgtaggtattgttaaggaaggcaggtgactgagattattttattttcagataatttaaaattaaatacgatgtgtaactgatagatacatttctaaacttgtatgtttgttagactacaggttatactgtcctcttaaaactctttcaggtgctatctcctctgaagaaataattaagtatgcacataggatcagtgcaagtaatgctgtatgtgctccactgacctgggttccaggtaaacatactcgtcttattatactagatatatgtggttttgaagattcttaggtgactatgtacagacatagatttaatttaaaatgtatttatccttagaaacctctgccacatattttcacatctttaatggtttataagtaatgatataggccatgggttttataaatttggttttctgtgaagccattgttgctagggactgtgtttctttcgtcttttgaaataataaattgataattttttaaagtacgagataataatgtgatgcttctaaagctttggatttatataccattttatcagggctggccagaagcaaactctttagagccattaggatttccacaaaggttccagcctgagaaagacaattccagttctcttagatgctaaag

SEQ ID NO: 73279 - DNA, 1049 bp, Homo sapiens
tctgcccgcatcagcctcccaaagttctgggattacaggcatgagtcactgtgcccagccataaggataaactttaaaatcgtgtcttccctaggaaatcactaaacttgctcatgttgccatattgctagttctgaaaggctagttttattttgttttgtatgaaagaatatctgaaaaagtagaaaagtttgatattaatgtttcccaaaataatcataggtaggctctttttattcttaacaagaattaggaataaaattttgaaggtgttgaaatttatagcctagccaattcagttacggattctttgtttcattggaatgcagcctttcagtagtctattgtctgatttaattgactgttatctgacaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggtaagttgacagaggttggttcttaaggttaaaaaggatgttgtttaatctgtttctgaaaaatctgttatcaatattttgaagagcagaaaactagactttccaagtctaaaggtgatatcttgtcactcaccattgccagtggttaaatgaaaggctattgtcattctcttttttacttactgttttcaaatagtctgcattacttgtgagccacattttcgatgcttaaagattttacagtattgaattatagaaatggaaagttttacttttatcctggtctgatataaattttaattatcagtagtctaaatctctctttttttttttttggtctctgatccttagcataaaaatcagggaaatttttcattttttatatattttgaaatcaataaaaatatatacacattttataaattgattaaaattgacattaatttagtcattcatcctcatctaggtaggatttggacatagatcaaggatcctagttttcc

SEQ ID NO: 73280 - DNA, 1077 bp, Homo sapiens
gaatgactaaattaatgtcaattttaatcaatttataaaatgtgtatatatttttattgatttcaaaatatataaaaaatgaaaaatttccctgatttttatgctaaggatcagagaccaaaaaaaaaaaaagagagatttagactactgataattaaaatttatatcagaccaggataaaagtaaaactttccatttctataattcaatactgtaaaatctttaagcatcgaaaatgtggctcacaagtaatgcagactatttgaaaacagtaagtaaaaaagagaatgacaatagcctttcatttaaccactggcaatggtgagtgacaagatatcacctttagacttggaaagtctagttttctgctcttcaaaatattgataacagatttttcagaaacagattaaacaacatcctttttaaccttaagaaccaacctctgtcaacttaccagtatttgttctgcttcctttagctgtttttgtagctgctgaatatcactgtctctcttctctacttctttttctaaaacttgcatttcatgatgaatttttccctgattaagtgccaatttcattagttcttgaaattccccatctcggtgaattaacaactccaggacctgtcagataacagtcaattaaatcagacaatagactactgaaaggctgcattccaatgaaacaaagaatccgtaactgaattggctaggctataaatttcaacaccttcaaaattttattcctaattcttgttaagaataaaaagagcctacctatgattattttgggaaacattaatatcaaacttttctactttttcagatattctttcatacaaaacaaaataaaactagcctttcagaactagcaatatggcaacatgagcaagtttagtgatttcctagggaagacacgattttaaagtttatccttatggctgggcacagtgactcatgcctgtaatcccagaactttgggaggctgatgcgggcagatcacttgaggtcacgagttctagactggcctggccaacatggtgaaaccccatctctactaaaaatacaaaaattag

SEQ ID NO: 73281 - DNA, 1021 bp, Homo sapiens
gggaggaatgaggattagaagtctgttaaataaatagaatatactttactttttacagaaaaagctttctgttgttatttaaaatactcttaatatttggcagtttgtagctcagtcttttgtctattgtattagaagaattcctataaaatgagaagaacttcatgtcaaaaggatcttgaagaggcatacctgtactttttagtcttcaacaaatctttttaaatagttttaaaattgattctgaattttgatagatattttctttctgaagtagtattctctacttagcacagtaaaggatatttagactagacttgcatcttaattctgtactggggtagtgatcgtaataactagcctttgctgaactcttcctgtatgtacttaaagtgcaatatatcatgaatcctcacaatagcttcatgtaatggctactattaatattatattccttttcctattaagaacacaggctcagagaggctggtaactttccctgtgtcacacagctagcagatggaggactagagatatgaaccaccagactttctattttatgtgttttagccttcatggtttttgccgtatctgcataccacttgtttgtttactgttttatgaaatcactgtatttttttttttttcctgagacgaagtcttgctctgtcacccaggctggagtgcagtggcgtgatctgggttcacagcaacctccgcctcctgggttcaagcaattcttctgcctcagcctcctgagtagctgggattacaggcatgtgccaccacccccggctaatttttatatttttagtagagacgaagtttcaccatgttggttaggctggtctcaaactcctgaccttgtgatccgcctacctcggcctcccaaagtgctgggattacaggcatgagccactgcgcctggccgaaatcaccgtatttttaagatcatcttcattgtaaacaatactgtgcataaactcagagtttcagtgtctcagttttttctaatatatat

SEQ ID NO: 73282 - DNA, 1208 bp, Homo sapiens
atattatgttatttttcaaggttctgtgatagttatggtatttgttagctttttaaaattagtaatttattgtgatttcattttattgtttacattagttatttggttttgtacctactttagatttgataatttgtattctttttgtttgtttgtttccaaggaacttacttaatcagaacttcagagggccctagaaagctgcatttttaaagaggacctcccctctggatgcccttccccacttcccctcattttaatgaggattctaggtgaattaaaagtatgttttgggaagtaattttaaccctcattgtgtgtcaggttatatatacagtaatattaagttgtaaatcatgtaatagaagaaaaatttttttatacaaagtgttaatagaggcctaaatataatatggtttttaaaataaaataaaatgaattcatgtgtatattgttataatcataaagataagaatgttaaattgaaagctacacaatgagaaacattaatggcaaatccaagtacaaacgaaaatgttctctgaattcccaggtttcactgggcatcaaaacccaccaatatttcagtccttttcttatatattattctgtaaccacattctccacatttgactggatccctggacttcatgtcattttctgtgtgacattctctacagttatatgccattggctgctgctttggggtttgaatgtccttctgggtgtccattgttagtccctacacagcatgatgaaatttctcactcttgtattatttttcttaatgaaggctcacaaaattataattgttcaggtatacaacctggatcagtatttgtaattacccaaatgcctcagaaaaatttcaaccgggggaatttatcttagagttgttcttgtacagttatgaaatggcatgtgtacaaggttagtcactgcaaaactgtaacagaaaaaggctgaactcagtggggatctggttaaacagatcatggtacatcctgcataatggaatactgtacagctctgaaaaatgaggacacagtctatattctgatatggaaagggctacaagatatattgcccaatgaagaaaaacaaagcttagaacaatgtgtacagtatgctacctttcattttaaaactaaagaaggaagaatagaaacattaacttttgtttatttttacataaataagttctggaa

SEQ ID NO: 73283 - DNA, 1068 bp, Homo sapiens
atgtttgtgctccactgagtcggttacctaataagtgagaaaatgaagatgtggatgcacaaaaattccatggcctttaggctcgcggtggggacagggtacagggaagcggcggtctggtgctgccaaaggttagtcccttgtacccggcgaactcaggaaagttcactcgatttcgctacaaacctgcagcactcggcctggaggtaacctggttgggagcgaattcagaactggaaattccaggcggcccagagggacacccatccctctccgaggcgcgccgggatccggcgcccagctgcggggcgagggcagggtcccgcgcagcaccccacccccggccgctggccccgcccccgcccccgccccgcctcccaggggatgtgcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggtccgagcccggggaggtcgaggaagcgggtgctgggcccggccggggagggctgcgcggactgcagcggcagtgcgccccgaggtggcgggcgcggggctcgcgccgcggggacaagtccccgagagagcccggcgctcccgtttcctgtgggtccgcagctcctttgtaaggaagtgcgtgtgctggaagcggtgcctgacgcggggtcgggggcttgggaggcctggagagggaacgattggctaattgtgccgaattcccggtcgtttgtgcagtccggggagcgtgcgtgcagccaggacttggcttgttcgatctggggaccggcagcgacaggcacaacaacaacaa

SEQ ID NO: 73284 - DNA, 1041 bp, Homo sapiens
ctccctttaatcctaggaaaattcatgaagtggggctgttactgtgttgacttttagtaggttacgatcatatttacttaaatatgagtgtaattgtctcataagttaaaaaagcccacagcctcttacccagaccctttttaggctgcaaaaattagaaattaactgtaaagttatgttgcttatcttattttttgttgttgttagcatttttcaagacctattatcagtagggtaaatttagttttaacttaaaaaaattggtgtgccacgtatgaataatgggagtttttatatggacgaatgaaaattattgctgaaaaacaggccactaatatactgtaaaaaattcacaatataatggtaatctagacatcatattataatttattatattctgaatataatctatcttcagaatataatggtaatcttactttctggaaatgttctgataaaaacagacacgtcagaggttgatttctaaatgacttgccttgccttgaaataggaacagtgaactgattccctaaaaggattaaaggttttggttttcgtattggtattgttttcctgaagccattgcaaacaatcttggtctttaaagaaaatgtttggaatgcacagatgaaaattgcagtagcaaattattatgttagctctttgtttatctaacattcgttgtacctaaaatagattgagagtcaagtatccagtcacaacagtctcaaatatatgtagtcttaatgctatcacatatatatatatacacacatacatttaaaaatcctattaacaaatataactgctcccatttagaaaggagagagtgagcgagcattggatgatgtcacttcagacagcttttctctgttccgctgtagtggagatttgaaactctggacaaacatcagaattacatttgctgagcaccattaaatctgacttctgacaatttttgtcatttctgaaatagtgactctgccagattctcaaaattgctcacgagttcaccatatttaaattttgtggtcattgcag

SEQ ID NO: 73285 - DNA, 1028 bp, Homo sapiens
ctaaccagactattccctttcttccttttggtgtttaacatgttacattcttccctcatatcaagtagcagtgggtcaaagagaaaggagatgggtagaggtattatgtaataaagcacattgtcacttctgtttacctcacagtgaacagtgaagttgtcagcacctctttgttgcaatgcctgcttatgaaaccccttttccagtatcaggccacagaatagcttaagcttgcttcatatgtatccctgcaagttgttttgctgacaaatagtgttgctttctctctaccccactttgtagatattctttaaaaggagagagaaaagtaaagtgctgatataggagagaaaatagtggcagggtgagtgcaagagagaaagtgaaggccgactcacccagtaaaagttttgagttacccatgacaaatggctgtttagaccctggttctttaccctttctggttttccctattcacacaatcaagactgaaggttttgataattaagcttttcgtttgtggtggtggttttgtttgtgtgttttttggggagtgaggagaagggacataaaatgcatggctggccatttactataatgttgatataatgctctcaagggattgagagcttggttctctttaaccaaagtgcatcttattacctagttatgtaattccgtgtttgcagatattggccagtgaaacttttacattacattttggttctccatgaggatattaatatctgaattgagggtttagtgctgggaaataaatgaattgcgtctgtgcatcccaaatgccttggcaggacctcctgtgtacacatccctgacaggacactgctgtagcatattgggtgtgcaaggttgcatattgcacaggattgtagtcttcccaactagacagaaatgagtataatatacttggcataataagcctgagtgacctcatggaattcaactctgacatataaaaggtttatgtgactggaagtattttttaagcagaaatatctcaaatacgt

SEQ ID NO: 73286 - DNA, 1077 bp, Homo sapiens
taaagactaaaggaaaagaaattaaggactttagaccgttactgaaacctgttaaaggatttgacaattctgaatttctgaatgaggtgatttttgcctaaatgatatacaaaatattaacactggagctgtgcttcacaatgaaagtcttttccaaagtagacagctgaaagttgaaaattggaaattataacactaaggacatcatttttgaaaaatttccacttaattgtgattatcccttttaattagtacttacaacacatatttttaatagctttaaggagatctacaatacaacctcattttataagtgttatcaacaattgaatgaacaagattattttaaattattgtgcattctttaagctcttttattagaggaaaaaactttttgcagtatttctataattgtacttggggaaaaatcaggtaagaatgaacgtagactttttattcttaaacagaaaagtttgaatcttgagttgtagcgatgaggaaattacccttgtttttatggtagagatatattctgatttttcacttaatgttttatctttcagtactgataagttaccagcaataattttatgatgttgaactaacataagtacgacaaaagagaaataaaattttcacagcttatatataataccacttctgagttaaatatcctggacgtttatttgggaaagtgatactaagtatggtggtggatattttgtactttgaaattttgaaatatttgcataaaccgtttttggcatagttgaatttcatactttaaaaaacaagtttggtggatttttgtgtttatttgaatgattaactttaaggctcaaattattatttttttttagtgaaagcaagtttattaagaaagtaaaggagtaaaagaatggtactgcataggcagagcagtcaagatgcaaattatttttaaaagttgtttgttttcagaatgagttaaggataaagcttaagtcttaactattttctctgcttatatatgattataatgttttaaattattttatataaaaattttaaaagatgcattgttaattaaatcacttg

SEQ ID NO: 73287 - DNA, 1087 bp, Homo sapiens
cctcagcttcccaagtagctgggattacaggcacctgccactatgcctggctaattttttgtatttttaatagagacggggtttcaccatgttggcccggttggtctcgaactcctgacctcttgatcaactactattattaaagtcccagttttctctcctcatcattcttgttttggaatattacttcttatattactgttactgcttatccctgcctcacatgtcagtaacaatattgttggtacttttttcacagcaaggcattctggtaaagattgattcctgcaacataaaaacccttaggattcagtagctgtaccgatttcatttaaaaatgttatttattcattacataataggtgttaatagaatttgagttttaccaaagtaatactaaattttaatatgcaaatatatagtcctgccctatgtcagaggaacatactttaaaaaaattgtagcatcattgtatacagtaaaatgcatagatcatgagtgtacagttagataattttaagtctgtatacctgggctctaactcccaatcaagctgaacattgttatcaactcagaaagttatcttgtgtccttttacaatttgttctccttagaggtaaccactattctaatttttctccccatagattaattcaaagcaatcatattcacttattagcttcttatggtcttttattaccatggtgaccactagaccctcttctgcctttgtgcaatttagaaaaagatcccctctctggtggtttggagaatagagcatcagttggtttctagacctactgattcccttggcctggcatccttgtactggaaacaacctgcccaaccatacatggcgatcttaactccatgtttctcactttttgccccagtagggcgtggtgcggcgggcagcagagtcttgctctgtcacccaggctcgagtgcagtggcatgatctcggctcactgcaacttccgcctcccaggttcaagtgattctcctgcctcagtctcccgagtagctgggattacaggtgcccaccaccactcccagctaatttttgtatttttagtaaagacggggt

SEQ ID NO: 73288 - DNA, 1051 bp, Homo sapiens
gtgatatggtgcttagcttctggaaaattgcactgtacaatttttattgtatataaacatagcgagagaatgaaagtgaaaatgacagttttattatttaaactaacacagtcttagttttattatgaaaaaagtttgaccttgtggaccccctgaacgggtgtgttcctggaccacatttgcagaacatctattctaaatatttgcttatactgctgtttcatggtttgttttcatttgttttattttttgcagttttagataatacctattgataatagctacatggaaggtgaatatttagctttttctgaatatttacacactgcacacatgatctcttctcctgttctagcaatttctggttaaattgatatttagtgttttttattataattaacataaacattagttacatttgagtattgtagtatacttttattttacttccattcttgtataacaactttttattttccctgaatttgatcatgcttcttggggcaggagagagggttccttaattttctacatacttactgctcattcattcctcagactctgacagcagtataattgtctttctgtgtcttcaaactcaccaggtaacttaccaagtttctttctttctttctttcttttttttttgatgatttcttgcccatcattcattagttttctattccagactggttgcactcatacaaatgtcctgagagtcataatcatcttggaagaattgcctttgtctttatcacatgctagatctacagtttcataaatctgaagaaaaagataaatttttaaaaaatcttacgtgtctcagaatcgttattccatcctcatatttgataatttatctgggtgtaaaattctaggttagcattcatttttctctcagcattttgatggcattgctccattatcttctaatgtgatgccattctgattccttgtttgtacatgactttttttccccctttggttgtctacaggctggtgattttctccttatatcttttttttcttttttcttttatgctttcagctt

SEQ ID NO: 73289 - DNA, 1050 bp, Homo sapiens
ctgccaaatggggtgggtgtgtgcgcacatttggctgtcccagcagctgataccaaatgttggaaataactatttccatctgtcattttcatcccccccactctccttccactctaaaattaattatgttaggaatgatttcttacctccttagatatttatgtcagacaagggctcaagcaaaagatgtatacttcgtcattaaagtttcataataccttatgactccatggaattcttgtagctttcttttcacagctgggatatcttacatggcttgctaaattcttcagacttattctcattacatacttttcttccttgcaatacgctcattgtctttcacacatagtatattgacaagtgctacagaaaccatgacattctcatagcaatgcactgattcttagaatacacattgtttgttgttcagtgttaaattctatgtttgaaatctcaacctaggaacacactgtatcgtatcacattgttcttggttgcttcaacatctgggattagacctttttcagttgtatcatgttaaagttcctcattttagaattaaaaacatataatcttaggtttcattcgtaactgaattcttgcttcaaccaaatctatgttctaataccggggtccccaaccgccaggccacagaccagtaccggaactggtcttggctaggaacttggctgcacagtgagcattgctgcctgagctccgcctcctctcagatcagcgggggcattagattctcttaggagcgcaaaccctattgtgaactgtgcatgttagggatctaggttgtgcgctccttatgagaatctaatgcctggtgatcttctgaggtggaacggtttcaccccgaaaccatatcccaacacccctcagtctgtctgtggaaaaattgtcttccacaaaactggtccctggtgccaaaaaaggttgtgtagtgctgttccaatgaccgatcctgtttttgtgcatcattcatagtttttctttctaattttatatcctattatataggtttaggtgaagtctgctttc

SEQ ID NO: 73290 - DNA, 1038 bp, Homo sapiens
ttaatatattctttcagaaaaacttgactagttttggaatgtattcttctataaaaactgcttacaggtagagtaggtctgttgtttctttatatttatttgttactggatagctaattatttttatgttctattttcacctaccaggaaaagtaaagggaaaaccagctgcctttcttctgaagctgttcttttacagtgcttcaaaacctgatcttaaagaatatgttaactctgtaattaaactgtctgacttgtcatctaaaagcaagagtttgcaagcaaaatgctatttagatagaggtggcagcttaagtaatgcttatttaaaaacctgtctcatgctgaattgctgaaatgagtctttaaactctctatagccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaaggtgagccaagtgtccagaattgtagaaagaatgcaggttctgtagtttatgctttttgtagttttaatttcaatatttgctaatttattatatttagagtttagtttaataaactgtcagcatttggtgggctctgctatgtctgaagcagaccctgctgatgcagccttctcatatcttatctctccttccccttgccttacctactcttaaagcccacctcatgactgttcctcctttgctggcaaactaatattttttatatgttcccacattttcttagataagaggtaatttatgttcctgtttcttggtagcattttcaaaatcaataattttgttaatctgtttttaagttctcattctatatttttccccagcttttgagcatttttatgtaatgcagaaaagttgaatacccaaaatcctccactttgttccaaatattgcc

SEQ ID NO: 73291 - DNA, 1768 bp, Homo sapiens
agttattcttaaaaaccgttctatgagacagtctttctcaaccagcgtttctcatttgaaccacagaacacaaaatcatttaaatgactgtttttctaatgttctaaggatggtagtattcaagatacatatgagaaaatttaatctttacaaacaatggacagataaccttagagggcatttgagcttataagtggggaagttaaattgcttaattatataataagtatttgcagttaatttgaataggtattattacttattatagaaatataccctcgatgagcattttatttactggtagcaatattttttcctctcccattcccacttccaactttatccagccaaattctgaatttgttgaaatgcaagtgatttatacattctaaagccaattcattttaatgatacaaattattcttaaaaatccagttgctgcctgtttttgcaagtattactgtaactacactgtatctttttcttcccagaaacttacagcctatttagatcttaacctggataagtgctatgtgatccctctgaacacttccattgttatgccacccagaaacctactggagttacttattaacatcaaggtataagaatgttgactgtttttgatgaatgatgccttcatagtgttctggaattccctgttgagaaattagccctataggagcccattttatcagactgtagttaagaattttacaaagaggaactaatactcatggtttttgtttttaatgttttatatcttgaaattgaaataaatttctcaaataatgttttaagttttcctaaagagccagggagtaaatattagccaactacttaattctggtgccatagacaatacgtaaaacagatgaacatgactatattccaaaaaaaattctacttataaaaacaagccgggggcggtggctcatgcctgtaatcccaggactttgggagacctaggtgggaggattgcttgaggccaggaatttgagaccagcctggacaacatagtgagaacataaacaaacagatggtgggtagtagtttggcaacctgttccataccataatgtgtaagaattttgtcttgtttctctagtctactcagtgtatgttctgagatagtcatgtcatgtattcttttctgaatgtaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtaatactttttaaatattaaagtgttgggcagaaaagttcattgcattaaactagatttaggtgaagcctagtcattgttaccaatatacctgccatgagtgaggtaatattgtgtcgttatataatatttccaggtttctatagaattatcttaattccatttagtaagtccactcttttcaggtggagagaaaaggtcaatgtgaaatgtcattgccttgagatgatggtacctcattttccatctagttagtcaccctgtccaacttcccatcctaccactttggttgagccatactgaaagggtttttattatccagagggtgtcttgggaccagctcttcagctgtgttttcagggatctggattctaagcaggctgtttgccttttggatcatattgggaataatcactgtcagggtagttggaaaggaatttgggtgaagaactaag

SEQ ID NO: 73292 - DNA, 1663 bp, Homo sapiens
ccagctgtatccatactgctgcaaaggacatgatttcttttttattgctgtgttgatttcttacattttaaaattctcttggttcataattttttttaaagtcagccttacacgtgccatgaaatttaccctttttagtgtgcaactctgagtttccacaaagatacacaaggtcttgcaagcaccaccatagtcaagatacagaacattttcaataccttcaagttcatgaatttgtaagcagtctggatagcattattaatgttgctgtgatctgtcaagatattaatacttggttcagaaaagggagaaaaattacttttcttcagtgtaaacattcaaactgtagaagtttttgtggaatatagagtgaaatacttctatatgtctaaataataactataaaaatgatgtgaatatttattattaaagaatcaaaattttaaaaaacttttttccctctccaacaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcctcaaccttgaatgatgttgtttaatataaaatgcttttatttttgatggaaaggcaatcaaagcctaaagtttccaaggaacgtaaaataactgtgcttctctgagaatgcccgcctcacaagtggaacattttgagttaataatgatgatttttatgtttctaaggttgcttcctctctgaaataattcagaatccacccccatttaataaaatacctatgattcatttcacctcaagttcct

SEQ ID NO: 73293 - DNA, 1046 bp, Homo sapiens
tagcacacatgtatgggttgtagattccacacttttaatcttccagccacctattgcagattggttctgagaagcaggatgagtgggagtgggcttaggggtcaaaattgagacctaagtggtataaaacaagataatcctagcttcctcccacttaaaataatttgatgggacttctgtatctgatttttaagcttgcatttgtgtttatattttcattgtaaaaatatcaaataatacagtttttgaaggtaaaaagtaaatgttcccgcccttctaccatcctccttcctcagtcccattccccaacagtttaacgtgcgatacaataatgtgtgacacaaaatgacctagttcttgccctagtgactaagcagatgcaaacgccttcttctttccaaacagtgtggtcttatccccgtcgcaaatggaggatatttaagaaacccaagccagaaaccccacagtcttcacagtcactgtgtcctccacctcctagcagcttcctgctgttctgctctagtggttctctctgcttccccacacccacccgtaagccacaacaatctttccaaaacacgaacttgatggtttcattgtcacaccccagcttaaaacactttcctggcttcccctggttcttaggataaagaccaaaatacttaatgctgcacagtccagtcccaacccactctccagcttcatcttaatcacacccctctttgctcctagtgtcctaccacattgcctgacttactgtttcttggtaaatgctattcttacttcctgaagattatttccatctcctcacccgacacccttcagttagcttccactcaaccttcagaatttagttcaggtgacccttcctcaagagaagattttcctgaaccattaggaaaggcttctcttgtttctcagtctcatagcatcatctgtctcttttttgtgacttgaatataattaatattttatattttgtccttgttgcttgtttggttaatagatttccaccactagactgctcaatacgttagtagggcacc

SEQ ID NO: 73294 - DNA, 1035 bp, Homo sapiens
attaaaaaccacgtctggggcatgttctgggaaaagacatggctttagtttctgattaaattctgatgtatccaattcttgcaaatttcccttgggaaaatgcagtaatggctactctaaagaattccatgttatgcacacagctttggaagcatactctaatgtagggtaaccaggaatattgacgttgtggccactgcttggaaaaaagaggactgtttctttcattttttaactcattttatatattttaagtaatggaactataaaaaattctcttataagtcaaaaccatacaagatacagtctgttcttgattatccatacccacaaagggtttcattaacatagacagttgaactctataaattaaccagcaagggtagaaccgctgccgtgcagtctgatactgagcatcttgcctggagatggaatcaaggctcagtccaactgcacctccagtgacagattccattcctgatttgagagtttagatcttatttctgttgccttatctctggcctaagtaatgtagctggaagggaaactgtcactaggaacagcataccacattcattgttgaaataatcaaaggttaatcatgtttcgagctgggtgtgatggcgcgtacctgtagtccatgctactcaggaggctgaggcaggaggatcacatgagcttgggagttggaggccagcctgggcaacaaagcaagaccccagtctttaaaaaaacaaaaaagctgaccaggcatgttggctcacgcctgtaatgccagcactttgggaggccaagatgggaagattgcttgaggccaggagtttgagaggagcctgggcaacaaaacaagaccctgtctctaaaacaaattttaaaaaattagccagtggctgtggcacacctgtaggctcatctactcaggaggctgaggtgggaggatcccttgagcccaggagtttgagactgcagtgagccatgatttcaccactgcaccccagcctggatgacagagtgaaaccctatttcaaaacaaga

SEQ ID NO: 73295 - DNA, 2125 bp, Homo sapiens
aaggacaagacttagggcttgactcttgactgctgggagctgggggtggagaaagttaaaagaaataccttgtagctattttctatatctaattatttatatcccaacttgtattagaaagatttctgaaatcttaaaaaaacaatgcggcgggggaaatggctgatgggaaggcgggagaggagaagccggaaaagtcgcaatgagctggagctgctggagtaatggagaggaaagttccagccgcagcgctgagaagcgatcagctgaagaagaagctgcagacctccaacaaagcctgcaaagatctccaactttggatttgccataggtagtcagacgacaaagaaagcatcacccatatccatcaaacttggatcaagtaagcctaaagaaactgttccaactcttgctccaaaaactctttcagtagcagcagcttttaatgaagatgaagatagtgaatcagaggaaaggcctccagaagcaaagatgaggatgaagaatattgcaagggatacaccaacatcagctggaccaaactccttcaataaaggaaagcatgggttttctgataaccagaagctatgggagtggaatataaaatctcatcttcgaaatgtctatgaccaagacaattaaatgatgttttgaaattggggtgtgggtgggtataaagttaaaaagaacagtttcctttttttaagaatggtataagactacctttggagccactttttttttctttttcatctttttaaaagattgagtggtacaccaataaatgagagtttgaaattagaggtaatttatgttttgtatacagatttcaagacatttgctaatttggtagttttgtgtgattagtttccaaagtttacagataataaagaaatcagaaatggtacctttttaagaattgcctatttttttagacacaactattagcacattaagagggaagcaaaaagttaattgtctatttaaaactgcaagcagttactctcttaactcccttattacctaaacttgtctggctcccaggaatagccttatagagagagggagtattgtattgggaggaaaatgttactgaactattgactgaaagtacatttagataaaattaaaatacagcttttttcttcatgggcatttgttttctttcaagtcatcataaactaggtgttgcattgctatcagtggatacagacgcttagctcttaaaataacttttttatatgtaaactgttgaatatttgaaatagcccacttcaccttaatgggtcttgtctatcttcattaatcttcaaagaaaaaccatttgctaccaaagtaaatcagtattttgaatgtgcttctcttgttttttgtttattagctagttcctgtaagcatttccaccagaacttgaagcgaatcataagaaaactgtttcttttaaaatacaaaccaccaccaaaaatttaaatgtacatattgcttaagtatttggctgcttttattttttaaaaggtataaacaccaaaaaaaaaaaatttaacattgtatgaagatggaaaacaagaagatgcactttctgtaactttgtccaaggatttaaattactaacttgtgaaatccaatttgaattgaacttaactactggctttcttactagtaaaattatatggtttattttaaatgtatacatattgaccaatggcctctcaaaaagcacattttagatactgaaatagaaggaaagaaaatgcatcttcaaacattttttggaatctcaccacacatactttgtgaatttgtgtattgtagggtgttttctttttgtatttttgtattgtatacgaactttttttttaatgtgacagttaaacacatctttaaaagcacagtcacagacaaaaaaaaatacagtataaaaatttccttgaaaactcctactacaatattgtatttggaggcagcttcagaccgttttattggtggtaactgctcgctgagctcttttagtcggtaataactcagagaagcaacctgtgtatattcctaactctttgttaactagtatttaagtttagaataagccccaggtaaaacaatggaaatgtatatagaactcttagtt

SEQ ID NO: 73296 - DNA, 1049 bp, Homo sapiens
tacaaagacagttaaggaactgaaacatgaaatacaaggttaaaaataattgaataaataaattgataaaaggaatgaatgaatagagcaaggaaagaataagcgaataagaacgtgggcttgtttttttcaaacaaattatatgttatggactctagatctcttaacttagcttcagtgacattggattattgaaaaatgaaactattttgaggaattgactgacccctaaagtttccacaataacttatttaattttttatctttctaatacttttttgccttataatataaaatttgaatgtttgttattagtgtgaaatgaaatcctttcaaatatatgccatcagaaggatgtgttacaaatatacagtattacaaacatttattttgtatgctgaataagaaaaaatcagttataatacagttttaacatagtatccagtgtgtgaattatttaatgaaatatttgatctttattttttgttcccagggaggttatattcaaaagaaaaaggaactgtggggaatctgtatctttattgcagcagttgacctagatgagatgtcgttcacttttactgagctacagaaaaacatagaaatcaggtaaagtttcttgtataaatataagcctctgccataaaaggaaacgaattctggattttcctctcaatagacttttgtgaattagtgagaaatgctaaaataaagtaaaacaaaaagaacttggaccaaatagtgaactgccattctctcatggagccgttatgaaagtgtatttatgctgtatttctttaagaggtagcagtttgtgtcctggaaaaattttcattgtgtctctcactattcatgtgtaagctttcttaattgtggctgttaataaagtgaacagaaaagcaaggatttgtaaataggcttgttttatattaaaacctttatataagtagtttgagtttatcttaaaggtatttaggtaagatttattaaagcctaagattgttttaactagaggatattataactaaatgctttttttcagattatat

SEQ ID NO: 73297 - DNA, 1027 bp, Homo sapiens
tacgagttgtatgtcaggatatggggtcaaagaccaaacatctatttcacaatatcacacaacacaatgtgtctggggaactattagcagctctgtattgattgactataaaatgagagtaggaagtcacaggagaggagagtgggtactagatatgaagggccttatatgccatactcacaaatttggagtgtagcatgtgcatgatatagcctgtgctataaatggatgttaagcaggggtaaggataaaatcagacataatttttgcaagttcacatggtaatagtcagtggggggatagactgaggagaataagaaaaagtgagaaatagacctgtcagtctgtctcagtggttcttaaccatgtgtgcaaattagaataacctgaggaattttgttttgttttttctttttaaaaattttgtgtcccattccactgaggaatatgcctaggccttactaccacagacatagtgtataaaaatctctgggcttgtctgttgtagcagtttacttgagagtttttaaagatctgaaccaacgatagtggtgggaatgaaggaacaataacagatttgataaatatttgatgaattcatacttagaatgttgttcttgaggcatttctgaagaagatatctagtaagcagtaggatagccttctatagatttgggaatcatcaggggagttaaacccataaaaaaaaatgagattgcttgaagggagggtgcataatggcaagagtgggtggctaagggctgaagcctaaaggatgctagcattaaggactagacagaaattgttaggttctagagcaggggtccccaattcccgggccagagactggtctgtgtcccattacgaactgggtgatacagcaggaggtgagtggtagacaggcaagtgagcattactgcctgagatctacctcctgtcagatcagcagtggaattagattctcataggtgcatgaaccttattgtgaactgcgcatgtgagggatctagattgtatgctccttatg

SEQ ID NO: 73298 - DNA, 1063 bp, Homo sapiens
gcaaaaattacctatatgacatataaatcaaatggtataattttttagtgctaagtcttaagtagtattcatttttatttaaataaattgcttctgttcgtaaagtactatatataaaacctttttaccttttttatatataaaacctatgattcataggttttatgtcctattaaaatatgagctaacaataattggtaaaattagttggaaaattatcagttttaaaagaaaattaaattgaaggttatgttgttagtaatttaaagatctcctgtgttttgatgtaaaaacactattttttagcagcagtcaaagggcttaagtagtatgactttttgtgtaacttggattgtgcaattgcttttaaaaatgaaactatttctcatttataatgagataatggaactcagtgtatcggaagagcagactgaacacacacttctacctcctttctccccgcaaaccctacagaagtgacaaaaaagacacatatcacaggggagtgaaacccagcagtactcagactgtgaagcagaaaaactgtggagggaagtggaggagttgattcatttttttagtataaaaaataaatgatgagtgtattgtggatacaataaagtagagaaaaccacagcacacaacacccccaggaaaggggactggtggaagtgggagtcttagagagcccccaagctcaaagtagcagatacagagagtggggcaataatcaggaaggttttctaaagtgctgtttggcaatggtcctcaaacttgagcatgcatcaaaattaccaggagggcttgttaaaacacatattacagattgctgggcccagtcacaaagtttccagtgtagggtccaagaatttgtatttctgatatgtttccaggtgatactgatgctgctggtctgggtactacactttgtgagcaacattttaagaacatgaaacacctggaccagtcccccatctaaggccatgccagcctatgagaataaaaaaaatgcacctctgtagtcccagctacttgggaggctgaggagggaggattgcttgag

SEQ ID NO: 73299 - DNA, 1803 bp, Homo sapiens
tttgagaattagagattttaggagttatgtacatgctgatctctggaaaatattgctaaataagtaatgctgttgatcattaagtactctggtcggtttagatattaatgtgtgttctacattcttaagtttgttcattagtcctttttaatttgtaatttatttcttagaagccatgttataaatgggtaattcagttttcaggaaagccccaaaaagctttttaaaaagtttgtttttggagtctttaagatttcatccctgcctaagcactgtttataaaattgtttctacacaaaaatttattcacaactaagaacatttgtgacatccagagttggactggcatttaggcacgaaaaaagtttaggtgctggaaggtagtgatgcttcttcttggaaatagtaatttaatatattgacaaaggacaaaatacttggttcatcaggtgtccaaaattgtaggaccaaaaagcaattgcttcagattcttgataactatgtaccattcatgaaccaaatgtttctcggatgggaatatgaagtttgctccattttctattttatatttctcaatttagtgactaatttctttaaataccaatatctataattaagatttctatttccaatttacttttcagcattttgaatgtagaatattaaggttcattgatagctccttaagtagtgtcttcagtttaattttctgtgaatataatatatataatacatatatttttatgctttttaaaataaactaggtacttgatattttctcagtaaagatgatttctaagttcagaaattattaggatgctggaaagccatttttccacacctgaaaaattttctcagcttactgtgttcctttgaagggagttaatgtgggaaggaagattagtcaaatcatctaccgttttatgaaaatgttaataacagtgggcacagtttttataggggggcttagtgctatcattttcaggtaatcaaaagtaaaatcatcagagttctaatattaatataggtttttctgaataaagggggaagggaagagaaaaccctcagaatatatgacttaccacaaagtacaacactagcaaaggaaaataaattttgttctggtacactttttttccatagttctagatgagaaaaccatgtttgttatctgttatgtattgctttatgaagaatcttacaaaacttttgattcatttatcttcctgttgacaagagacaccaaaaagtttctttatgaacatagtaataacaactatttaatgactgttttatttgcattttaaagttatattcatgttttatgatcttgccttaagttgagatctttaagctgaggagagttctgagaaatctcaaagttatacaattctccacccctttcccccagatcagtagattggtagttgcttctcaactcagtatgtttaagaaagagtgtatttttatttactgaagtgtaatatcaaataaaggaatttcaggtcaatggaagaaaacacatttatattatgtatatatttctcttgggatataaaggaccatggttagtatcttcactagttttttgggttttttttcttttctcttttttttttttttttgagataggatcttgctctgttgtccatgctggagtacagtggtgtgatcatatctcactctaacttggaactcctgggctgaaggcattaaagatgtattttgctttaggtttatctaaaggaaaccatggatccctaaagaaaaccccccactgttattttattgaaaatgggttta

SEQ ID NO: 73300 - DNA, 1034 bp, Homo sapiens
ttttttgagatggagtctcgctctgtcgcccggctggagtgcagtggcgagatcttggctcactgcaacctctgactcctgggttcaagcgattctcctgcctctgcctcccgagtagctgggactacaggcatgtgccaccacacccagctaatttttgtatttttagtagagacggggtttcaccatgttggccaggagggtcttgatctcttgaccttatgatccacccgcctcagccacccaaagtgctaggattacaggtgtgaaccaccgtgcccggcctgaatttttttaaaaaaggaatatgttggataataaaaaagttttagtgtacttggtactttttttctaaagtatacctcagagccagacctattttatgtttagtgaaatgaaaatatagttttgtttagttatttggccttgtagttttgttactttataatgtaaggaactgtgtccttaattaatcattttgacgtacaataacatcttgcctacttgaaataatgttttgaacttcccaatatttggcttaaaatggccagaagagtgaaggaaaagaaaatatttacagtcatgcatcacgtaatagcattttggtcaatgaccgcataaacgatggtggtctcataagattatcatactatatttttactgtaccttttctgtgttgagatgtatttagatacacaagtaccattattttacagttgcctacagtattctttgcagtagcatgctgtataggtttgtagcctagaagcagtagggtgtaccatataagcctaggtgtgtaatagtgtataccttctagagttgtgtaagtacacactgtgatgtttgcacgacataattacctaagcaagcatcataagcaacacgtgacagtatattactttctaaatgccaagtactatatttcactatctctgatgtttctccgacctaacatacttaaaacataagttcttgactgtgatgtaagtgcacctttaaaatgtacctctggtagtattttatttttttgc

SEQ ID NO: 73301 - DNA, 1024 bp, Homo sapiens
aaatgtaggtgttatttcctcaaagattgaggatatcacaacctctatggcacatgtttttcttgttttaaatatcattttcttcagaaaaggctagatctagttatgccttactgttattatttttttaatttggtctagtttaagctgaaactcttcctcttgggtattaagtaatttaagaacaatttatttttttctcataaattacttagctagcttaaaaataacttattacagtaaaatgttttgtgttgttttgcaccattctttcacactcagcaatttttgtcatttgttgatgaactataatctatttctactgtctggactagaaaattcatctattatcaaatgacaaaaaaagatgagtattacttataaccaatacttaaaattttgaagggttgaatatcttttatatcacatttggtatagaaaagatgtatgtgtgtgttcttattagaaggctggtagaagctgagtgagcattaatgaaaaaaggagtggttaataagcttgtattctcattggaaaaaattttctgttagtagttatgtcttactgttattttttttttatttggttcagtatgttttaaaaaaacaaaatcttagtaatcttctttcaaattgatagtctcctctttagtcatctttaattaatgaaatatatgcagttgtatatgctgatctcatcctacttttactttcattttgaatatggcggcattttctcattcaaataattaaaatttattaattctacttggaatatttttctacatattgtcattactcacttgacttgttattcacttaagtcattcatctatagttttttcttttcttttctttttctttttctttctttcttttttttttctcactctgccgcccaggctggagtgcagtggtgcgatcttgtcttactgcaacctctgcctcccaggttccagcaattttcccacctcagcctcccgagtagctgggattatgggcacccgccaccacacccagctaat

SEQ ID NO: 73302 - DNA, 1032 bp, Homo sapiens
cttatacatgtttgtataatgaaagaatacaacttagtgagtgcatgcataaaggataatagaaagcactgtgacctagagatccagaatccttgatttctaaattttgaccttaccttgggcaaactctgccctgaactttaagatggatatgacatgcccttttgaccttatgaagagttttcagaataaaatgaaatgaaaacatattctgaatgtaaacctctaaaaagatactattatagatgacatcacctataatatcttaactttatagaaataaaggttatgttgtgggaaatcatggaacaataagatttgttttgttttcttgaccagataggatgcctgtgctctgtcagataaagaagtgatcatgtgatgcatttggtatgccttttttagcactgctaatgtacagccaatttaaatcaaatagacataggctttgcttataaaaaccacatatatttctaagttagtttgcttggtggttaacacattgcatattgcattagtcttaatatcctctaatgttggagctagcactggatcctagaaattcagaataaaagtccaccttacccctgttacaactagccattcatcttctttggtatatagtttagctctccttccagtcactcaagtacaacttaggaaactaaaaccatagctgattattgctggagcaggaactcgaatcctagtttcttgacttctagtcaaatgttctcgtagtaacaggtagctttcaccctttttttcttactgatgttgtgctagttcgttcttgcattgctgtaaagaaatacctgagactgggtaatttgtaaagaaaagagtagggtttagttggctcacggttcttcaggctgtacaggaagcatggcatcagcttctcctcagcttctggtgagtcctgaggaagtttatattaatggcagaagtcggaggggaaacaggcatgtcacgtggtgacaataggagcaagaggaaggaggaggtcccatgccctttttaaacaagcag

SEQ ID NO: 73303 - DNA, 1111 bp, Homo sapiens
agatttggaatgggatactgctctttctttttatgtgctcttagataagaactctttctactgtgtcttataaactctgtcataccataagtttctcaaagtgattttaaccactgtacattttaaacaatatgagaaataaattaatttctgatatgaacatacatgtaagctactaaacctcagtattatgaaatatctaaaacgtgacttattagaaatagattcttttagacgttaatttttttttcaaaaagatacatatgtacttttctatttatgagtatacctgggtaaatatagaacataggaaaatgtactttgatgttttaaaacatttaaaattatttaaatataccactaactctaaattttaaaattatctttgattagaagcattaaaattcttatttaagatgtatactatttgaagaagagaattgggattctgttgccttgctttgtaacttaaaagagctttttcagggactccctcagagtacctgctggagatgaatctgtaaaaaatttttgttcagagaatttctgccactaaataagtcttaaataagtatgccacataggatagactgtatttaaatgaaaccattttttataacttacaccaaatattatgacaaaagcataattgtttcttgataaaactgttccactgttttatttgttttactgttaacaaaaatgcatttttttttttttacctttagtaggtatgcattgtattacaaaacaatgatatcttttggaaaactttcagttaaactagacaaataaggactttggcttattcagatttattccattcatcatctttgaattagtttcttcttgagaagaagcatatcttacaacttttgtctttattacctcaatatgttttatttatatgtatatacatatatactttttttcagatagggtcttgctatgttgcccaggctggtcttgaactcctggactcaagttattctcctgccttagcctcccaaagtgctgggattataggcatgagccactgtgcctggcctcaatatttatttaaaggttacaagaatatatgttcttaaaatgttgagaattaaaataaata

SEQ ID NO: 73304 - DNA, 1011 bp, Homo sapiens
tggtagaaaaatcttaaacatcaccactaaagaacttattcatgtaaccaaacaccacctgttcccccaaacacctattttttaaaaaaactcatgcctacataatgaagcctccataaaaactcaaaaggacctggttctgggagcttctggatatttgcccaactggaggttcctggagaatagcatgcctggggagggcaaggaaaatccatgccccttctcacatgccttgccctctgcatttcttcatctgtatcccttgtaatatgcctcataataaaccagtaaacatgtttctctgggggaaagaaaagagtggtagaaaagaggtttctgttaaaatgctacttaacagcattataattagagcgatttcatgatttgaaaaaaatctacttgtaattcaaaatgaacagtaaaaatgactaatttttcttattcccacagtgtatcggctagcctatctccggctaaatacactttgtgaacgccttctgtctgagcacccagaattagaacatatcatctggacccttttccagcacaccctgcagaatgagtatgaactcatgagagacaggcatttggaccaagtaagaaaatcaagcacttcaccttctctcctccctacttacttgttaactgattctttctttctttctttctttctttctttctttctttctttctttctttctttctttctttctttttctttctttctttctctctttctttcttttttttgagatagagtctcactctgttacccaggctagagtgcagtggcgcaatctcggctcactgcaacctccgcctcccaggttcaagtgattctcctgcctcagcctcccaggtagctaggattacaggcgtgtaccaccacaccttgttaatttttgtattttagtagagacaggttttcaccatgttggccaggctggtctcaaactcctgacctcaggtgatccgtctacctaaggcctcccaaagtgttgggattacagg

SEQ ID NO: 73305 - DNA, 1725 bp, Homo sapiens
gtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcacaccagcatggcacatgtatacatatgtaactaacctgcacaatgtgcacatgtaccctaaaacttagagtataataaaaaatataaataaaaaaaaaaaaaagaaaatctatttacttggatgggtttacagatttagttatcagctttcctgactgttaggtatcttcttttgagaacaatttgagaaccagtttggttatatgtttcaaaacacttttatattttttaaatagccaatctgctaaacaaagcaggttactttaggttgagtacttttagtttgcagtttattggatgtcctgtaagttttgcttcctgtggatttttttccttttgcttgttatattaaatgtagattactgtcaattaagtctttagaggtccatccctaatcctgctggcggcctctttaccacctcaccttgggcaggtctctatctgtacttcacaagggtgctgtggatcagggaaatgatgagtatgaagctgttttaaattctcagatgaaaggttgtatgcaactacaaatcattatattatcttccacatccaaccacaagtgctctctagctttgaagtgcttcagttgactaattatatgttatcatgggctatttgaaactgactttatttgtgtgaagtaggaggcagattagctagtatagttaatgtagtctcatctcagaaattatcagcccatatggttgtacctaatgggcaagaaaagggggcatatgttggcctttcagaaaatatttgcatggtatatttaattatttaagtagtacgtactcattataaaaatttcaaactctacagaaaaatatgaagtaagaaataattggcaatatgatacaaatgctctcatgtgtctctgtatcatcctttatttatttggtgttcttgtagttggatatctgtgtactgatatctactacttgttctaagctgctaagatgccacgtcatgtctatttaagaaaatttacattgttccatgccactatatgaaaatgtatacttaggtagttttttttaatagtgataattagtccatattatggtgataatgatggctacttgctgatccttagtgaaataaattctgtgttggtattcttcagcaaaaacgtcacattctgaacatcctaactaataaatcattgaccaggcattaggagagcatcttaacactctacccagtacatttaggtactctggttaatcaaatattatatgtagagtgatggccacttatcaaggaattggagggcaaaaaaatctctatattcactagttccatgttcatgttttcaaatctttgtcgagtcatgtcaggctaatgatgttcttcagctttattataaagaacataaattatatggttcaaataaagacagact

SEQ ID NO: 73306 - DNA, 1075 bp, Homo sapiens
cagtcatattggattagggcccaccctagtgaccttcttataacttgattacctctttaaaggctctctttcctagtaaggtcacattttgaggtattggccattaggacttcaacacaggaatttttagaggacatcattcaacccgtaatggagtgaggaaacagaattacttagattttataaaaataaacccactgatttctctaaatgctgacagtggttgtggtgtgagagagatgccagggagcccagctctgtccccattagcacggccattggggctgcttcccaggccacccctggcagcaggtttgtatatacagccttgctgaatagatgattgtttgaaaaccctggccagcaaagaaagtgaggagccacagcagggacgtgccagcgtgcaccttcgagagaagaacgtggtcctcacagaggccatctgtcctggctgggaagctaggacctgacatactgcttttttccttcagatgtgagcattttcgttcgtcattggaagataacgaggatgatattgtagaaatgagtgaattttcatatcctgtttaccgggccttcctggaatacctatacacagacagcatcagcctttctcctgaggaggcagtaggtaattgccaaagacttccaaaaacttggcaaaatgttgaggaactgacaaggtggtttctatagaacctaaaagaaagtcactgtgagggtaattacagaagtatttctttttgtgtgtgttgaatccaaacacgtttcccttgttactactttattacaaaggttgactggacagataagagagagaagaatcaaatcatcaccaccgtggagcattgcaggcagcagcatggaggaagggacagagactgagggccatgcagcagatccccgtgtctccaccagcagggcccaggaattccacttatttcagactgtgggcctgagtcagtcaagtctgtgcccagtggcttaggaggctgggaaaatgggcatttccagagggccgtagcttggctaaaaattctgtggtttcagtagaaaggaagaatggatgtgtgtg

SEQ ID NO: 73307 - DNA, 1131 bp, Homo sapiens
acacttttgccgtgtgtggctgaaaagactgaagttgtcaagctcagtaatcttttcaattaaataccgctttgctttgtactgaagatctgactcatcactcttgttgaaatttggaaaactttttaaaaaaacaaataattaaaatagcaacagggtttctgtattctacacaacagttttctgtttttcatgaacatatgacaataccatttcctttgaggttgtgtgctagttttagttatgcttttagtgttttagttttgtccgtcctgtttataattgttccattttaattagccatgtaggtattttactgttacttgtcattgattttagacatctcatttaagtggagctaatattacagctaacactatccctttttgcaagtgaaaactgggatcatgttttattgtatacgtatttatattatttataacttgaagatgacccttaaaaagctattaaagatactatctaatgactcacctaaggatatatttgggaaccatcattatcctattgaaatttatgtggtctgcagctcattaacacaccgatgctgtaaactgcatgctggtaccctaaaagatatcgatattatttaatttcctgtttcttttgattataaaagcatcatcaaatgtgttacccacccagatgggataattttaagcatagagttctatattgagagaattctaaaaatatcagtgtgtttctcaagcatagctttagagttgatctcattaagttgaattttaaaatatgtaatactgggacttctctgcaggaattgctattttttttcaccccttcttctgtaatcacttctaaagaagaattattagcatttagaagcccctgattaactgcaaaatgtcagcatttaaaacctaccattgggttggggtaatgtggacagaagtccctaagagagctggatattgttttgctctacgttattctgtttgctctcatgtatttgctttcaattcagtgcctactgcaggcactgaattaatatttgttgaatgaattaggcaaatgaacctatgtcccataatcagcttaactcattttttaggtcagaggtattaccgagtaatataacacattgtgtagcag

SEQ ID NO: 73308 - DNA, 1127 bp, Homo sapiens
accctgatgaatacaaatattatagtatcctagtaccagagcagtgagctccttgcaaactagagtcagaaggatgtgttgtcactggcagacatctccaggggtatcaagaatacccctgttagagaccagagatctagcaactgaagcagcacggccaagccatgtagggtgcgcctgagcgcaaacaggtggaggtcttccttccttttccaggaggctgaggaattcctctacagattcttgccacagaaaatcacatacctgaatcagctcttgcgagagggctccctcagtgtggctgacctgacttccctccgggccccactggacatccccaacccagaccctccacccaaggatgatgagatggaaacagataagtaggagaagaaagaagtccctaagtgtggatttctccctgggaataagaaagtcctgtccctgcttgccctggttaagccagaattctggactctcaaagagaaattcattctggtgattacatggatccagcacctaatccccaagattgaagatggaaatgattttggggtagcaatccaggagaaggtgctggagagggtgaatgctgtcaagaccaaagtggaagctttccagacaaccatttccaagtaattctcagaacgtggggatgctgcggccaaggcctccgaggagactcatgtaatggattaccgggccttggtgcatgagcgagatgaggcagcctatggggagctcagggccatggtgctggacctgagggccttctatgctgagctttatcatatcatcaacagcaacctggagaaaattgtcaacccaaagggtgaaaagaagccatctatgtactgaacccaggactagaaggaaaataaatgatctatatgttgtgtcagaaaaaaaaaaaaaagaatacccctgttagtgacaaggaattgttgattgggcagctacagaatgtagcaccctctggaagcctaggcccagatggaaagagcaggaggacaagcacactaaggaacaagacatattgagtttacaaatgagaacacatgaggcattgagccctgacagggaggcacttgtaaggtaaaaactgccacatgcattcaggtgggcgc

SEQ ID NO: 73309 - DNA, 1033 bp, Homo sapiens
gccatatgttaggcagaaacgaattgagttttgtggttctgatcttatgtttggataaatatttagtttttgcgtatttactaactcttgtcatcttgtgtcacccacaaatgttcaagtgagttgaatcccctgtcttttggatattttcttggttgaattaatttttcttaagtaatgagatgaagtactcactgagacagatggtggcccaacagaaaacagtgatgaaggatttttaccacatcttttatgaaatataacctgaaatgttgcttttagctttgtagcctactaatcttgctttctaatcacaccagttagtgggaagaagggatgatgacaggagaaacatcttgttaaaattttaatattaaatcttatatttaaattttttagcactactacattaaattttactatattgtcttgtttcatttcatagatcatctgttagttttctatgtgtaggttaactggaaaattttttatcccaggctggctaccgttagccacctgtatgcttctgaattaactccctctttttcccttttgtctgaatcctccaaatcattgaatgctccggaaaaataaaatcctggttaacactgtcaagcatagttataagggtaattaatttatcccaaattaataataagcattaaaaaaaacattctaggattatcttcttttggtgacgtctgtgtcttcacttcctctatctgtgtgagtaattgagacctgatttattttaacacacatgtaatgattactctttactagtcacatttctacaatataatagtaagcatattttattactaatttaaaaatttctccctcttccctgaccagccagacatagctaagggctgagacatccttaaccccccgaaaaaaagagggaatgcatgattcatattctcattgtcttttgtagttttaggcaaagagcatttaatttatactttatcaatttttagtaatatttgcgctgttttaaaacatttgcattttttaagatgttcatgac

SEQ ID NO: 73310 - DNA, 1056 bp, Homo sapiens
tagttgggggtactagactaatagtatcattagcaaaaattataatatggtattattaagttgtgtgacaccaactggaatttaaagggaagtgaagccagtgagagctagaacaatcctggaaggcatttggagggagtcagaggaaacttagaaatgatttagataacaaaaggaaaggcattccaaaagagattcacaggcagagttggaagtagtagtagaataagtagtccaagagcatccaaggacagaaattgggacgaagaaagaaagaaagttaggtcgagatgttagcttaagcaccagggcatcagaagaggaaaataggcagagctggacaagacagtttgtatcattaggaacctatcactgaaagaactatacctcagctttgacatattaatagcttaagctttatgtataatggatagcttatatgtgtttgtttgtatggcttaggtcaggggtcggccaactttttgtgtagagtgctagataattaaatattttaggttttgcaggccatttacagtctcggttgaatgttcttgtttgtttgttagttttttataatcttttaaaaacgtaaaaatttttacattgttgtctcaagagccaaacaaaaacaagccatctgtggactggatttggccaggggacctagtttgctgactgctaggtaataattggcaaagtaattgtccatatagcacatactgtgaaatttcttgcatcatcttgtctatatggtggtttgggcgttttatgactatcatgtatatatttttccttatgttatcctaaaaaaaaagtatgtagaaataagtgcttctgtaattgttattttgtggccagacttctaacaagagcctagaataggtctcagaattaggaagtgaaagacgaaaagcctttgagtcaggccttactacagtgaaaatagctacacagtggcttgatttagaatttgtataaggttaggtgtatcaactgcctgtgctggttttacatttttaaaaacagctggcaggttaaaaaccttgtctaggatgc

SEQ ID NO: 73311 - DNA, 1235 bp, Homo sapiens
atcatttcttacctctttacaactttgtgatatagtgtagagaacatatttctcattaggcagccacaggattgttagttgacttctcatactggctgtatagaaacatgagtgtgctactttacctgtatgagccttggttcgttcattttacagtgtagtaataatagtagctatctcctaatatagactgtacaagaattaaaagatcctatttaacatgacaagtaaaatgcttgccataggatatttatatctagaactttgacagacatacctaatcattgtcactcaggcatcctgcatatcattcatttattcatttgcctatcatttgttgaacatttaaaatgtcctagatacttagaatatgaatgttgaatgtcacaaaaatgaatgtcacactccctcccctttagaaatttacagaatgggatgagagataatgatatgtaaataaatacatatttttaaataattaaaatatcttgtgtcttttcacttgtgtgagtccttcctgtcttttaatatttaaatgcaaaatgtttccataatacccacagaatatctgggttgtatatatcatactgtaatgtatatatattttttacttgtctaaatcagctattcaactatgaactccttgagtttgaccagtactactggagtcagcaacttttttaatataagagaaggtagtaaatattttaggcattgtggaccatatgggctcagttgcaactacttaaactgtgctacaggagcacaaaaacagccatagataaattataaacaatgggcatgactgtgttcctattaaacttcatttacgaaactaggcagcagaccagatttggcccacaggctttagtttgccaacctctgcaatggtgcatgcatatacttttatttgtgcttgacaaataaaaggcacttagtaaataatatgattaataggcattaaacactttctgtattctgggtgctattgcaaaaaactttatatgtatcagtttacttaagccttaaaacatctctctgcggtagatactattatcaccaaatgtcatagagtaataatagaagcactttcattaatagataggaacacaacattggttcaaaagtcttaggcaatacattaagaacaagaaaaataattaacctgtaaataaaggggggaaatgtatcactattatttagagttgatatgactgcttacaaatacaaataaa

SEQ ID NO: 73312 - DNA, 1345 bp, Homo sapiens
tgaagaaaactgcaaaaagatgtgaatggatggaggagtattcatgaatgtgtcaacttaatgccataaaaatgacagcttttactaaattattctataaagtcaatgcagttctaatcagaaattcaacaggagttttaaaatggaatttgacaaactgatggttcaagttttgagaagggagcatgcacaagaatggccaagtaaatttcaaaaagaagtataataaatgggacccatcaaaggtcgaaacattataaaattacaattattaaaataagaatttggagtaggaataggcatattgatcaaaggaatagaataataaattcaggagaagatccatagataaacatggataaagaagaattgtatgataaatgaatgagtaatggaagaactggtctataaagggtgtgggacaatcaactgtttaattgaagtaaagatagttaggtacccacttcgtgacactctcaaaactaagttccaggtggactaaatggttttttatttttatttatttatttatttttgagatggagtctcgctctgtcaccaggctggagtgcagtggcgtgatctcggctcactgcaacctccgcctcccaggttcaagcgattctcctgcctcagcctcccaagtagctgggattacaggtgcccaccaccacgcccagctaatttttgtatttttagtagagacggggtttcaccatgttgtccagatggtctcgatctcttgagcttgtgatctgctcgcctcagcctcccagagtgctgtgattacaggcgtgagccactgtgcccagccccgagtggactaaatgttgataaataaaaaataaaatgacaaaacttttaaaagttaatttaaaaactcgttggagtagagaaggccttttaagtgagacatcaaacttagatgccatttaaaaaggaaggcaagcaatagactgggataaaatattcgacatgtaatagacaaaattaatattcaaggtatataaggtgtacctacaaatcaatatgaaaaagataacctgatagaaaatgggaaagaatgtaagcaggaaatttatagaggtagaaatataggtagcctgttaagttttgaaggaatactattgaaccgaatataaatagcttcatctttttaggagaaaagtttggcagtatctatccatttcaaatgtacgttctcctgagccagaagttttatttctatatgtctgtaatatagaaatgctatcattcattaatagagagtattgcatgattattccatgcagaggagaaaatgtatgatgggaaactggaagtaataagatcatcattagaacag

SEQ ID NO: 73313 - DNA, 1090 bp, Homo sapiens
atatataaacattatgtttaaagaatatgcattttcatgagataattaaataatataaaatggctcattttacattattgtggtattaactatgaaatcttcaagtagataccaatactgaataatttttaaaacatcatagtagttgttatatagctacatgaaaaattattttcaatctaaatcaacttgtgagattcagcagtcaagattttaaataaataacatgaatttaatctcttataaaagttaaccctcttgacactactgaattgcagaatgctgtaaacattccaaaatgtttattttatttttcaatatagattcagtgtatttatgattatactcaatttgcttatcttgaaatgtaatttgctgatgttttattggttaacattgtatatgatagactaatattgcttacatcatcttttacttttctttttgtatgtgatattgtgtgtacagttaaagatttgtaaatatatgtttttttgttgaaattattgatttattgtaaataggtatcacttagaaaagagtaatacaatcaaaataagtaagtaatataagagcttgaaacttcaaacttgaaggttcttaccctaatcctgagcaaatttttttaccattgtgttttgtctgaggaatcagtgaaaaatcataatttttcttgtgtagttcctagagacagatagggtgatgagggggattgagtcttcataattaccttgtctgcccatagaaaaaaattagtgacagttgcctcactcaatcactgtatcttagtgcctatcccagtgtttagattaagtagtggtggttaaattaaataaaatattatatagagatgaaaggggtggagagacagacatagaatttaaatagagcctgctgatattcgctttaatatatcatataaacttactgactactttgacaaacaaagtaatttgaattgtaagaaatgtatttccttaaatggcttattgattggaaaaaaaagcagtcaacagagtattctagaatttcctttgacaagaatatctctttaggttaaagaatgaaacatcttgaatgtacaatgttt

SEQ ID NO: 73314 - DNA, 1609 bp, Homo sapiens
ataaatagagatagttataataagcagtggatcagaaaacgtggagatagttatgaaggatgcatatgaagtgtaaagagtgaaccaatagctatgatagaatgtaagggactatatacaaagcagataataattagaggtgggagcgcaataaacttgacagcagacatttctttgtcttaacacaagaacttattgatacgccaagttatagcttacctatggagatatgacacaacttggttgatgcctgtttaaccacagactaaaaaactgttcctgacagatggaagtgtgcacaagcatgatgttaaaaattcaagacgacatattttgtcccttgtcttgacttttcttcagaatattatgctatatgaaatgatttctcttctactcttgggatcaaattaattttcttatagttggctattaagattatctgtctcctcattaatattttctggtttagtacagtaaacatttcctactgtatcatattacacgcagtgggtctttggcttgtgaatcataatagagggaattgctcctgatatcactgctagtgttgcctttagggaggctgtaatagtcatttattattcattttgacaagcagcttatgaacctttttttgtggttatggaatctgcctccctttttcattattaaaatagattttatttttagagcagttttaggcttataagaaaaattgagcagacagtacaaagttctcacataccacctcttctccacagtttcttcatttattagtgtgatatatttgttacaattaatgaaccagtattgatgcgttattattaagtaaggtccatagggttcactcttagtgttgtacaacagttcttcaggtcttaacagatgggtaatgtcatatatcattacagtatcatacagaataatttcaccgccctaaaaatcccgtgcttcaccttttcattcttcctttactccccccaaatccttggcaaccactgatctttttactatctctctactatagttttgtatttttaagaatgcaatacagtatgtagccctttcagactggcttctcccacttagcagtatggtgtaggtaatttctttccacggcttaatagctcatttctttttcattattgaataatacttcattgtatagatggaccagtttgtttattcattcatctgttgaaggacatcttggtcacttccagctttaggctgttataaataaagctgctttaaacattcatgtgcagatttttgagtgtacataagttttaattcacgtggataaatacctaggaacatgattgctagattgtgcggtagggctgtgtttagttttgtgagaaactaccaaactgtcttctaaggtggctgtaccattgtacattctttgtcacatgattgacttgagatatcttttcctgatagcagaaggaaagcctgcatgaatgtgtgtgccctgttagaacctccaaaccagttttatagaacataagcttcaagcaaaagtggaatgctcagttctgttctctagtgccaccatctaaagaagatttcagatgttttagtttcttgtgtggtttagcagtttact

SEQ ID NO: 73315 - DNA, 1039 bp, Homo sapiens
gacaaaccagaaaaagcagagctaggtagtagagtaaaggtgcttccccctttttacattacctaaaacaaacctaaaaacaaagctctacatgtttgtttctgagattagcttttacataatgttactttgggttaaacttttatctccatggaagttgtgtttggtttaaatggaaataagaaggaaaactttcaccaatagccaaaaatctaatgtaaaaactttaaaaagtgctcacatttttaagttcaaaaagttacaaatttgtaaatatatgcatttaaaaatctgatagcttccatgctaagctataaacataaaccttaggaatgaggctactgagactgaaataaagcttatacttttgtgacaataattttgtgcctcagaattctaatacaaaccattaatcatagatttcatggcccaaattagtcatcttctaactgctatgcagctttgcctggcaaataaatagtggtttgctaaatttctcattcttagaagctttggaaaggctagaatttaaacattactctcctttttcaattagtttttttctcccacacgtctgcaccatgccactttctgtgacatttccttagaaaatcaaatatttttgaaaaattctagtgctattaccgttaacttttctttagacataaaaagccttatgctcaaggttcagatctgaaaatttgcttagttatcacatttttgtaagcacacattttaaaaaatttatgataaatattaagctaggttgtcctggaaaaaaattaacttcacacatattcaggttctgtctgtgtataaaatattgcactggttcttgttttaagagatgataaaatcagatttacaaattgggtgtaaattttaagatagtctaaagggaagaaaggttcataaaatatcagtcaggaacagagttacaaagaatgcagactggaatttagtttttatatttggcacaaaataataaaattgtattcttattgaatgacttgagaccaataccatttcatctgttcat

SEQ ID NO: 73316 - DNA, 1129 bp, Homo sapiens
ttttactctatttcatttacattgtgtatttccatgactgtatcccagttttataacttaatacatagtaaaatatgagaatcattctttatttgtaaaaaaattattttcttagacatttataagaaatactaaaattagagtacaaggccaagcagcttgtaaaaatgatttaaagttgtctggtcagtatgatagagttcttaaaaacattcaagtttatgctaaatgaatgttattcatttacttattctcctactcaacaaagattttttgagtatataataagtactatagtacattgttttgggtatctcagtgacaagattctttgtcttccagagttctattagttcaattggcagacctggttggatgaataggaaaatgccaaattataaaatacctttgaaaattcttaaaaaactgtattcctgtattcgttttggttattaaaatagtcatttggagccaagcatagtaaagattttgagtcagagacaaaagaataaaatagtaagactttttcatttgtgacttctgaactaactctcaaggcaatctagaaaaaagtagttttagttcttctgagttctctagagtagatctctcacccttatagttcattgctagataacctaaagagtatctggcatttatggtgcccaagaaacacttattgaagatatatgtaataggcttcacttactgctgcttactgtgtatgtcacactgtgctgtatgttttacatgtatattatctgttaatccttcaacagccctgtggcaaaatcattatagatctcagttttcagactaggcaacaaagacttaagtaacatacccaaagttacaaatagctattaagtggtgaagcatattgaaagtcaagatcagagatacttcaaagcttatattctttttttttttaacaacattcttttttttttaatatatactttaagttctgggatacatgtgcagaacatgcaggtttgttacataggtatacacgtgccatggtggtttgctgcacccatcaactggtcatctgcattaggtatttctcctaatactttcccctcactgccctcaaagcttatattcttaatgactattcctttttgcc

SEQ ID NO: 73317 - DNA, 1007 bp, Homo sapiens
gctgttctctgacagccactatactaataaaatctctatattaaaacctaatgaattgagataagagctgtgtaaattaataagcatttgaattaaagtccattcttttaaaagtagctttattacttgttcagaatatttagaaatgaaaactaggttgagaatcacagagaactttagacatctaaataattaccttactttattggaggctcagattttgtgagttacagctagttatgggcagagttcaatacagtagtttttctactgtatagcatacattctggaaagacaaattgctaattatttttttctatgaattttctaagtatctactgaggtatactgtgctagttgctggacattcaaacaaaatctgaaaactaagttcctgacattcaagaacagtgtcatgggggaaaaaaagggaaaattaacagttgtattacagtataaaaagagatacacatagggtgttatgggagcatagaaggagggttactataacattcagtggtatgtaaagaaaaaattattccaggagaaaatgacacatgagcctcctcgaagaacagtggcagttggtcagatggacaaagggtctcaaggcactttagacagagggaaagtgttcaaaagcaacagaaggaaagaatgacttgacttatttgaataaccacaaagagattggaattgctaaaaagttgtgtaaatatgtggtacctgttgaaccaaaagtcttcctactacaaacatcattggaaatgttcaataaaataataacatgtaatctttcaaatacactcctgagcttctctctcttcccttcaccctataaaaaggaaaaaaaaggtggggactggggaagaatcactgtgggccagaaacaaggacttttccacatttatttgtcttctattttaagagacagggtctctttgtcacccaggctggagtgtagtagcacagtcatagctcattgcagcctcaaactcctgggctca

SEQ ID NO: 73318 - DNA, 1050 bp, Homo sapiens
tccacacagaggtggtctaattaggaagtcatcatcaatgctgtgattataccccttcccctcctccactaagaactcagtattacttgcttctagcacagataccacttctgcaacaggaattttgtagccacccaccactgcctgccaaattatcagcacctgtaggagtgatggtctttatctcacaccaaggagactcctcaaacacacaaagggacttcagattctatgcactaaaacaaatgacagcgtccactgcagtgcaagagaagacaactttatgaatagaacttgcttattttagcggaactagaactaaatatgagtcatctattgaatcccatttgcaaaagggaaaacaaatgaaatcttggacttcaaaaatagaaatgcaagttcaaaacagatggtggtgtatgctggttagacggtattcttttaacatgtttaaaagaagtattgacaaactgggattgtcccaaggaagataaccaggagatcatagaagcgtgaaatcacctttataaaacactatagaaatgcgtgaaggatgtttaacctagaaaagagggcagtgacttggtctcaagctcttgacctcgtgatccacccgcctcggcctcccaaagtgctgggattacggttgcattcaccaccatgcccggctaaggaagcagattttgacacggggaagaacagctatggctgtataaaaatggagttgtttgttataacagtgtcccatcttcatatgtgttcataccctggttgggtgatattataaaagtaattccagcatagaaagataattgtgattaggtgaattccagcagttattgtaactaaagatgctttgattccagaataatctgtttattaaactgagttctctttagttacttctgggaatgaggactctgaatgagcgtgttaaatttaacaagtctatctgtgcacaggcacataaggtaattgagctagtgaatggttattgctcatggtagacctataaatagtatatcaactagttaatttattaatacccac

SEQ ID NO: 73319 - DNA, 2087 bp, Homo sapiens
tgtgagatggggcctttgaacatagtttacactttttgaaaagtatagccttattattagataatcctgcctttgcctcgctttgtgcccttggcatgttactctgcttcagttttcttacctggaaatgatgctcacttcacttgttaggattaagtgagttaacgcaagtaaaacactccaaatgatgcctagtatgtactctgcactatgtggttatttttgaaaacatggtgatcatacttttacatattataactatttactgagtatcatcaaccaatatacttgatactttaaatttatttaatttcattctcacaacaatgctatgatgttgattaaccttgtcactgaaataagctaagacttcagagaagagcagtaaattgccttgctaataaatactgaagctgttattaaaatatatcttttaataccaaaattcactttctttccactgtacaacttgttacaaaccactgtcattatcattacctgtatatttttgttagctgttaataaatttcctctgaagttacatagcaccataaagtaatgaaagatctccaaaagttcttattctttcctgttgtaactggacatctttggtctcctttctggtctctacttgttcttggatagagaactctgaacctgcacctgaggctgtcttttcagattcgtggatatgagtaagaatgccatctactgagcacctgcactttaatttaaatcttaaatttaaaaaaatcagaaagaaaataaaaccaataatgaaagtggtagtctttattctcttaagaggcaaataacagcctgaaacataaatcccacctttgagacacatgtctatcaaacctatattctatacacaattatttgtgtattgtggatattccttaaggattgagtatggagaattacgttatacaatgacatttcagactgaatcttttaaattaatattatctcaaatgttctaaatgaaaattagcggcaggctgcatgagtaaaaaattagaagatagcacctgtggtgttattgaacacaaagagaatcattgtacatcaaatatatatttctgaaaagtatactttgatgagcttttgaattggttcataaggaagtctgaaagatggtcaaattcagggcagcagcagtagaaatcatttaatcttttttttcccctatatcagaaatgctgcaagcgggaacgtttgcttttttttcccccttgccctttcctgggtcactgcaggtcacgtgatgactgtcacgtgactcggtcaaaggatcttttcctcttacagccttgcaaaaaaaaaaaaagccgttctccaattaaagctgttaacgtgtactacgctgtttccttgttggattttcttgttctctgctgctactgtaaaaacgaaatgagtggtaagatttgctgttttcgaacattctgcttttattttaagacagaaagcattgtattaatctaaagtcatgccgtgtgtttttaaaaatagatgctaaatatcatcgccataaaatattttaaattgttgccatgtaaatacaaaaaggttagactatgtagagttattttgtaattttgtattccacggaatattccattctaggatctttattttactaggtttttcttctagagctaaaatctgaaaattggcatcagattatttggaagccattgtgaacgctggcttatagagaatgtgtagcacagcggcagcacgttgcattttaagaattaaaactcctggacaaatttgtaattttatttaaaaaaaacctcttaaatatgaatgtatattaacaaggaaagataaagaagaatttaagttatactagttgaaatatcttctttaagtcagtgatggcactttttaagaagcaggggtggggagcttctcaaatttcttaagacaattggttagaattgtttactcttctgcaggtttttgaaataggaaatgtatccttaatagctccatgattggggtaaatcatgctcaaatcacatagattataaaggagctgctaagtgtatgcacagttgttgtcaggtattgct

SEQ ID NO: 73320 - DNA, 1049 bp, Homo sapiens
aattggaaaacctaacactataaaagtgaaaggaagtgtagagtgagagaagctgaattttcttttttagaactttttagtgtgagaaacaaaaaaaaatttttttttcctttgggtaagtacacgtgtggcatttctctttgttcttaagcccccatagacatgagtcacacattacacaagtattttaaccctaacaaagcaagttccaaatttctaactattcttcctcttgctgcttttcactcttgcttttttattttgtccctgtaacttttgaaaattttgccttttgtatttttcattgattttatatgcagagtttagtttgatttttctctaggtcagtgtttctaaacttacactattataagagtcacctgggatatttgtaaagtgaatataatgattcaagaccccattgactaagaatctctaggagagcctgttaatatgttttaaaaagccctccaacctccccgccccccaccacccctaccccagcaactttaaaaaacacaaatgtaggtaaagggtaatttgtgcactttacaagataaatttttataacaagtcaatcatctgaatttctttttataaaaatgtagttactgttggcttgagtgtttagatgaagtattcaaaatgtaattcaaattgttttcaactttagcctgataagcaatcatgggttaatacatcatttatgtgacccattcaggtcctgctcaggttccaatgatgtccccaaatggttctgtgcctcctatctatgtgcctcctggatatgccccacaggtatgtttttatgctatttttcttttcatatttgtataatagtgataatgttattctctttgactttgattttgatttaaaaaaaccatttaattactgaggcttaccaagtgttgtgtatctatcataaatctatttcaagtattttagtacatttggaaaggaagaaaaatttttattggcagcactcatcatttgtccttgtctttgggtgttaagtcacaaaagaaaattcattctagagttttgtc

SEQ ID NO: 73321 - DNA, 1093 bp, Homo sapiens
aatttgcttagatgtaacccaagacaatgcttccaactttattcatacaatgaatctcagacactgttgataattgcatggcatattgtgttcaatagaaaagagtttagcaaccctgagggatgagggggggggggaaataaaaaaaaaaaatcagtatctccatacacctgtaaccttttatgcataatgactgggaagctctgaccttaagtatagtaatttatgaacacaggcaaactgaattaaactgtaaaatctgcaggtgttcaatatcttccactactgagatttcgtatggtctgcacgctttgcctcaatctattttgggaaataatcattttctctccctagcattgaatttacacttgaagtttttcttcaggccctctgttacttcctccctgattatgccagaatattggtggtgggatattggggtggattttctgcacactctgtgaagcacaccatcatatgaaccacagcaaaagaagagcgtgctgggaaggagagaatggaatgagatttagaatggattcagaaaagctgaatccatatcttatttcaaacctttgctggctgcatggtcttgggcaaatcaacttccttcagtctcagtgccttcattatgagatgagatcacgtactgaaattaccttgtaagcttttcagagtagtctctactaactatctctacttttgtttagcacactgactccttaatatagtctgcattctgtctatattactctactaaaactgctttccgctatgtaccaaatccaaagtcctgctttccagcctggtcctctttgacctctaaaaatttggtaccactgataagatttactacagatttccttgacatcatgctgccctgatttttgttttctacttctttgttgcaccttctcagatcttccttctcttacatgaagactgttctctagcatagttcagttcatgatttattgagtggcaccacgtactgagctctgtattgggagctagtgataaaaagatgattaagacaagttctttcagtgcacttaggttatctgctgttctctcatcttacagtaccttttcg

SEQ ID NO: 73322 - DNA, 1032 bp, Homo sapiens
gccataaaaaaggatgaattcatgtcctttgcagggacatggatgaagctggaaaccatcattctcagcagattaacacaggaacagaaaaccaaacaccacatgttctcacttataaatgggagttgaacaatgagaacacatagacacagggaggggaacatcacacactggggcctgtgaagggatggggagctaggggagggatagcattaggagaaatacctaatatagatgatgggttgatgggtgcagcaaaccaccatggcacgtgtatacctatgtaacaaacctacatgtttggcacatgtatcccagaactttaattaaaaaaaaaaaagtagagaaaaaaagcttcagaagaagcaaactatttgaaaagatgatacatagtccacataccaagattatgtactttacacataaataacctccatagccatttctggggcctgcttggtccttattttaggcagaaccttaatgagctttattgttgcagtttaataaataaggatacttttaagaaattggtgtactgcacagaggcagaaatatgtgccagtggaattaagttatcaaatgaggaaatgaacaaaacatagaactataaaacttaaatacaaagcaagtgatgccaggagtagaaggaacttaattcactggcaaatagtactaacttagagtccctaagagcattgtattgcaggacaggataacacttccgctatttcagtgataaagttaataacttatcaagagaagtttatgaactacctgaatgggactcctgaaaggcaatatcagaagttctgcctttctggtaatggctcccttaactgtttttttatagaatgtgggctgttatggtaatgagagggtgcctaacaaggaaggaattgtagatcgcatagcgtggggaaagaaactatatcgactttgggaaaagtttcaggttactcctttgagctgtgcttgctgtttcattttgcttttatgatggcacgcaggagtgaggtcagtgtgtttttc

SEQ ID NO: 73323 - DNA, 1124 bp, Homo sapiens
ataatcataagttaccaccaagctgtttctatggagattaataattagttgagaacagaaggaaataaatctctctgtaaatttacttgagagagagatatatataattagaataaatcacaaagcttggttctgatagtttatggagacacaaaggttgctttgttatgcaaaattcttttaaatattttataaaagttttatatgatagatttattttctgttcttttttcatggcataaacttatttggagaaagtgatcttcttaacattttgtttttattgcctcctagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaaggtaactgtttgaagtactgaactgttctcattgatgctattctcgtgatttaacctactaaaagtatattctaacctttcagtcattttgtcatggtccaaatagactgttacaggctgctgctttcgacagtttggaaagcctcaattagtaatttcatctatatcgtaaattttactgactgaaatttctatttgataggaaaactcagagaacattaatccagattcctttcttctgattctgggcgtttgataaggctatgctgctggtttttaatcaaaactttttttttttgagacagggtcttgctttgtcacccaggctggagtggcacgatcatagataactgcagctggaaactacaggcatacaccaccacacccagctaattttttaatttttagtagagacagggtctcgctgttttgcccatgctggtctcgatctcctgggctcaagcagtcctcccatcttggcctctcaaagtgctgcaattataggcctgagccactgtccccaacctatcaaaactttttatttctcccaccttctttttg

SEQ ID NO: 73324 - DNA, 1800 bp, Homo sapiens
caccacgcccaactactttttgtatttttagtagagacagggtttcaccatcttggccaggctggtctccaactcctaggctcaagcagtccacccaccttgaccttccagtgtgctaagattacaggcatgagcctactatatggactttgagcactattatttgtatatacttgaatcaatctctataaggtaaaatatagctgggttaacagcctgtctttcatatgcctacagttgtggagttagtacccagtacttttgattgtaatgttaagcttgtaactactgcttactttgattaatgtagtttctatatgtatgttcttttaggtttccttaatactgactattatctgtttgacgtagatatgcgtatgtagaaatacatagatatgcatggtagaccatgtcaggttctaaaggtttcatcagaaatgactatgaaccataccaacatgtcatttcacaagcaccaataaccacaactctatcagtccttgaatatgcttatctaaattgatatttactatcaaatagtgtaggtaattaatatatgactaggaactaaaatgcttccaactttgagggaaatatcaaaatgtaagccatgtgaactcttcctaccttccttttccttaaaatttccatgcctcactaacaaatttcaaataatgtcttaactgttcatgacttatatattaacaacatttacataaatgttctcccatttatttgagacctgatcatcgttttcagcactgatgtttcagaagaaattaagttaaagttttttgcctatcagtggtggctataagttacagtcaagccaattatatttctaatttgggaaaccataactaaggcatgtcatgaaaaaatagttaactttattaagaggtatgagattgacaaatgagaactttccagagagaatattcttacaaccatgaataaaaatatacttgatataagaaaaatttggttcagatagatatagctatgtctaaatatatatagatatatctgtatatagtggtgttataattagtagtcacagttaagatagaaataaaaactaaagtagataaatgctgaagggccacaaactgctgagtatgaacaaaggaataaaaactagaaaataaaagtctcaaataccaacctagtttcagaatacatatttagggagaagaagggattgtatctaagttcttttttttaaatattcaaatgttttatttttttaagaaaaagatgaagaaactaaagcatttgaagcacttctttccaacattgtcaaaccagtggtaagtatcttatgtattttattgatgtttatatttaatatattagcataagatgttcatccatcaaaatgtagtttttttcttttaactttttatgaaaataggatcatactgtattctgtgacaagctttttcactcactatggtatgctttagctatctttctatgtcattacctgattctttgaagagctacatagttttgtcattcattcatcaaatatttattgatcccttactatatgccaataaataaaaaacaaatgcacaaacagaattctgtgtgatagtaaagattgctattatagaaataggaatgatatgatgagattaataggagaggttgttaggttaaatagagcaatcagggaagctttctctgacaagtgagaaaaagtgcaaaagtggaaggaatgggagagggagaacaggtgtaagtaagcatggggagttggacagagggaaagaaccattatcactggagtatagt

SEQ ID NO: 73325 - DNA, 1118 bp, Homo sapiens
agcatttacttgttgtagtatatattaaaagtataattttcaggccaggtgcagtggctcacactttcccagtcctttggaaaaccaagacaagaagatcacttgaggccaggagtttgagaccagcctgagtaatatattgagacctcgtctctacaaaaaacaaatacagatactacagaccaagggggcacacacctgtagtcccagatacttgggatgctgaggtgggaggatcccttgagcctaggagttcaatgctgcagtgaactaagattgtgccttttcactccagcctgggtgacagagcaagaacctgtctcataaataaataaatatatatataatttacagacaggaaaagtaaatcttaaagccaattcaaagactttcttactcaacattaggaagaacatgtagtttaataagatagtgagccctgtatcataaagtaatgctgatggttttatttgctttgttttagtttatagtttgaatgccgattcctctttgattaaattaattgtgagctacaaagtgcaggtcagggtttttgcttgcttgtttttgtgtgtgtggttgtttttgcatgctctagttcatttagagcactaaattaaatgtgttcattcactttttcattccataaatattttaccgcttacaaagtgacagatgttgtgctaaagctggagatagaatggaaagcaaaggatagacacgggctctgccacaaggcttagttcagtaaactaagcatcacacaatgaatgttaaattgtaacggtgaagtgccaggacaaaaagatagagagcagtcagagtgtgtaataggaggactaaaccttgacaaggaatcagggaagttttcctaaggaaggattattgtactgacatttgaaggaaaagtagtggttgggcattgaggacaggggtggaaagtgtgggaacagtattgcaaactgagcagcatttgaaaagcactggacatggcacatttgaggaacaacaaaaaaaaaggaaagcagagaaaagctcactcatgtgaccagagtgcagtgtataggggagaatgtggtacatgcacaagtctcatagtctcaactgtgtacttagga

SEQ ID NO: 73326 - DNA, 1056 bp, Homo sapiens
ctcattttgttgatgaggcctagaaccctaagagggtgagacttcagtatcaccaggcaaattagtgacacatcttgtgcttccctatttaatattttctctactgtctgtactccccacagatcctgataaagcaagcttcataaagtaggtgccaggctgggcatagtgactcacacctgtaattccaacactttgggaggctgaggcgggagggtggcttgaggccaggagctcgagaccatcctgggcaacatagcaagaccccatctttactactactactactactactactactactactgctactactactactactactaataataataataataataaagtagatgccagttaatgcttttgactgacccaccttcatagtcctattcacgttctcaaagtttaacacaactattatcatcccataaaatcaagagacacttatgggtatacatacatgtatagtagcagtttgttttaaaaaagaaaaaaaaacctgctcagtttcaagttaatagccagctgtatactggatcatacaaagaatcatttttaagttcattgtaaatgaaacacagtaccaagactttaagacagtattagagtgaatacagtattacatttcctgtgatttaacagaagcaaaataaatatagtaatagttttttttattcagacttcgagaactttgaaaaggacagaatgttacaattttatggagattacttaattttactttaattcaagataggagtaattgtcatcctagtggttattagtttggttttagaaatgctaaggtagttgttaaacatatataattttaaagcaagcttttatataaatgcctacatataatctggtacctttctcaccaatctgtaaaccttatctaatctctagatttttttcgctttaacaaaagtaacttgtactcataaaattattccagtagtataaaaatatataaaacataattgaaaccacatgtttttttctgtcacaactttctctgcgtctcaccacacttacacaaaatccccaaag

SEQ ID NO: 73327 - DNA, 1023 bp, Homo sapiens
tttgttttttggtgttggttttaggcacctagtgacaatggttctaaaatccaaaactttgtattagaatgggatgaagtaagtaaattgaatctttttaaatggttaacattatgtgcatatgttcaggcaaaattaacttttttgtttgttttaatcatcaagtatattcttctgtcaaaaaaagtatgaatgattttgtgtggtgcatgagtggattgatggtgttttcagaaaacattcctgacttaacttccctattttcaataaatcaccatcaaaattattatttaggtaactaccttgataaaggaacttttttttcacatcagccttaaagacaagtgtattcctttcctatggctgctataacaaattaccccaaacctgacattaaaacagcacattattctcttacttttctggaggccagaaatccaaaatgagtttctctgggacaaaatcaaggtgtcagcatggccaggccctctccagggactttagaggagaatctgtttccttgccttgaccagcttctgtaggctgtcctcattacttggttcatggccacatcacattgcgttttctccccttgtttccatcatcacatcaccttcctcctctgtcttcaaatctgtcttccttttttaggaacacttatgattccatgtagggtctattcagataatccaggataagctcctatctcgagattcttagtcacattgtacagtcccacctaccatataaggttatattcacaggttcaggggattgggacctggatattcatggtggccatgactcagccaaccacagcaagcatactggacttcattgtttagtacaggggtgtccagtcttttggcttccttgggccacacaaaatactacatttgtgcaaaggtagttgctgtttttgccattaaaagtaatggtaaaaacagcagttacttttgcaccaacctacattaacactaacaatagctaatgagcttttaaaaaaatgacaaaaatatctca

SEQ ID NO: 73328 - DNA, 1082 bp, Homo sapiens
tacagtatatgaattatatctcaatttttttaattcaaaaaatgataacgttcggaaaatttgtaaagcattgtcactagtgctggaaatagccatcccaaacctaagtgacatcctcacctgccagcacaattaacccttcaattatttacttagacaaccatgtgttaaaggcaagttaaatatgttaactacttacagttctattcagctcttgcacgatgtctctgggaaatctctgttcttgggatagcttactgatggtgaagttaccattggctccaactctataaactcttccctcaacacaaagatcgtcttctcttggctactatatttactgagactaagtggcctgcttcatcttctaccaaatgttcaataagcatttccgggtctacccactgaagacagaagcatcgaggtgaggattccactcaacagagcattagtcatattgcacatagtagaagatgaagagaaacccgggtcttttcacatattcattattgcccatatttctattgttagacatcgaatgaagactttgttttttccttttccagggatatggttttaagcctaaatatgatggagaagatcttgcttacacagtgaaaaatctcagacgtagtactaagtataaatttaaggtaagctttgaaaacccttaaacgatttgttccttgttcctattcttactggtgtggtggggttctttgttttctgtttgtttgtttgtttgttttttgagacgggctcttactctgtcacccaagctgctgcagtggcacaatcatggctcactgcagccacaacctcctgggctcaagtcatcctcccacctcagcttcccaagcagctgagaccacaggtgcatgccaccacacctggctaacttattttgtagagacgaggtttcaccatcttgcccaggctgatctcacactcctcggttcaagtgatcttcctgcctcggcctcccagagttctgggattacagacacaagccactgcacccaacctctattcttactgttttaaagacaagtatatacttcactcctttggttttagatctt

SEQ ID NO: 73329 - DNA, 1082 bp, Homo sapiens
aagtctagtcctaattaaaagacatcttttttttctttttggcaggaaataggtcatttcatagaaataaacactgctaaatgtgtgattcaagaataaagttcactagtcataaaacttactactaaaactagtatgatgtgagttaaattttagaagttaatccttctctgatatatctgtatataaatctaactgaataaactaaccttcagaagattcatagtatctaatgacttggtctaggtgtatagaggctgagcaatgtaaataaatgagaacaaaaagaacatgtaaatgcaacgatacagttgttcagcactcttacatttgattcactgtatttctggaaatcacaatttaaagtggatcataacaggcaaaatcctaactgctacaaacaaagaaaaaaaaaatccaggaaaaaaaaaaggtcttggtgaggtgccgccatttcatccgtcctcggtttctgtgcctttcgcagagcttccagcagcgctacgttgggccagagcatccggaggttcacaacctctgtggtccgtaggagccactgtgaggagggccctgggaagaatttgccattttcagtggaaaacaagtggtcgttactagctaagatgtgtttgtactttggatctgcatttgctacaccctttcttgtagtaagacaacaactacttaaaacataaggatgtttcagttcatccattaacagatatgaagagcattttaagaggtacagcctctggaagtggatcaaacttgaactcatatggcatactagatatgtttgtcaataaacttatgacattaaaaaaaaaaaatccaggacaacccaaagtgaagtgaacatctttttatggtgtaccttatgaaaagcaagaagaaagaaaagatatgacataaaatgtaaagccataaagaatagaaagagactggctggaataaatctatcagtgtttaatatccattcataccgttagaaccttctgccatctccactacatatttattgatggttgctccgccattgtcttttggtggatctatccaaagaagcaaagtagtattaggca

SEQ ID NO: 73330 - DNA, 1470 bp, Homo sapiens
cttctaaaatttaactcacatcatactagttttagtagtaagttttatgactagtgaactttattcttgaatcacacatttagcagtgtttatttctatgaaatgacctatttcctgccaaaaagaaaaaaaagatgtcttttaattaggactagacttcctctgatactggttttttgtactctttgtatgctataacgttattactggaccagtaaacacatttaaaatgcttaattaaaagtaaattatcaatctaggccaaagtctgtacagagttacagagatatttcacttccacaaagccatgcagacttgtctaggaagctgcacacataaagaaaattagatcatttccaggaaaccgaaacaaacctaaattgtttctgacaaattacacaaatacttactttgtgaagctaggatacctgatgtgtccatgataccagaacgttaaacattacctagtatctgattgaacacaattcctcaccttacaggaaacaaatgggaaatgatatacagtggtgctaccagggaacatctttgtgatcgactgaatccaggctgtttctatcgtttacgagtttactgcatcagtgatggaggacagagtgcggtaatacttatatgtagattcttttgtgttgttattaagtttggccaaatggggtaggatcaccaggtgccacttcaaatattgaaacatatccacaaatggagaaaagtaacttctgtaacctgttgggttaatttgatagtgaccaaaatattctaatgtggtacttagctcacagtaagtattcagtgtgtgtctgttgtctggttggtattcagctttggaaaaacaaatacatgaaaacattggagaaaattttataaagataaatttgagaatgatgctcaataaccatactaagcagagatagaaataaaataattatagaccgatttactgctccataaattatgtgtgtgaggacacatcataaaatagtatctgctgtttaatctactttctaatatttacttacttcaaaaaagttggccattattttattattagagactcaataaccaaaatgaacttaaaatgtaccattgatataaagacataatgttctagggatgtatgtttattaatgagtgattttttttttttttgggaaacagtctcactctgtcgcccaggctggagtgcagtggcacgattggggctcactgcaacctctgcctcctgggttctgcaacctctgcctcctgggttcaagaattctcctgcttcagcctccctagtagctgggactacaggcgccccccaccacaactggctaatttttgtatttttagtagagacggggttttaccatgttggccaggctggcctcgaactcctgacttcgtgatccaccggcctcagcctcccacagtgctgggattacaggcatgagccaccgcacccggccaagt

SEQ ID NO: 73331 - DNA, 1025 bp, Homo sapiens
gcaagccccctcaagtgacatgtagatctgcaacttgtgcacaagtgaattgggaggtattgtaatttccattgacttgtatctactttcttaagtgaatagaatagtttatataaaagaataaagatactgttcatttttaccgcctatattatacagagtaagccctagtttaattcacatgaaaaacagtgacttctttttcctctttgaagaatttgagtaaggtatatttgcattacaaatatttagattcctgttcattatgtgctttgtatttttatgaatggctttgtctcagtactgagatatttcagccactgtaagtttaatgttcagaatagacatacacaggaattagtaaattctatttctcttatatttatccagtacacatctccagtgtacttattgtggatagtaataatcagtgatgataattattatattttcagttccctttgaaatttaacaaaatgtgtgtatgcttttaacatttcatattaatagaattatcttgaaacatatttaccttaaaacactctttctaaagtgacttagtcatatttctacttctaattcaaaacagttatatatttgaccaatcttaaattcagataatcttaatgaataaaaaatgtaaaattgaacagttttgattgtgcttaaaagttttaaagaaactcaaaagcaatctagttttacatgtgctcaggtaaagagcatttttggccaaaagctatttaatcaacatcaagactaagacctttatccttttcttaatttaaaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggtaaagatgatcagtaccttgtcacttaactctatccagagttttatatttcattggcattttcatggtcatgactttgttaact

SEQ ID NO: 73332 - DNA, 2879 bp, Homo sapiens
ttgagaaaagcaagaaaatgcttgaggaccgattttgcttgttctctagctgccctggggcacatctgcactccttaattcatctgtgaaccgtataagggtagatcctcgcttttgaaatttctcttgcccctatgcaacaaacagataagtactttaatggacaggtatttttaacatgtcatttaaaagataaaatcaatggcattcactggctttcacatgaaaaacaattctaacactagccagttttaacacattttctgtccagccttcacacgtaattcttccttctaatattttattaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtg

SEQ ID NO: 73333 - DNA, 2035 bp, Homo sapiens
aacattactaacctttcctctgtcacactgattgaaaaatgatctatttagtttgttgttttgtctttaattttgtaagctttaaaaagttaatattgcccttcagacaccatcccaacatcacataagaattttttcatgttataaattctttgtggacatatttgataactgttttattatgaggaggaccataattaattcaaccattcccctattttggtcatttaggtttttgggtttgggttttttgtttgtttaacgtctttgcttgctattttaaagaatgctgcactaaatgtgcatgcatgagatttcttctctgtatttagaatattttcctagaatggattctcagaagaattctcagtctgtggagaggaacatttttaatgcatggaagaggtatttattccagatagaaaactaggcaatattagttgttccctgtaagattttaaaaaacagccatggcaccatggaggactcttcgagtatatagttttagcgctgggctttgggatcacacttcacaacaccagtaactccacaaatgcattcctagaggctctgtgagaggctgggtaactttttcttgaaaaggccagataataaatattttagactttgcaggccgtgtggtgtctgtcacagctactcaactctgccacacgaaagcacccaaagactatataagtgaatgggtgtgtctgtgtttcaataaaggtttatttatggatactgaaatttgaatttctgacagttcgatgtgtcacaaaatgttcttttgatttgtccaactattttaaaatgtaaaacccattcttaacctgtgagctgtacaaagactggcagtggactggatttggcctgtgggtggtagtttgccaaccctcaggctatataataggtgacttggtaatagacatttattatattgagggttctagatatactgcaatgatagggtggattttataatgaaaaccctaaattcagcatgtatctcataattacctttcgtattttgtatttcagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactggtgagttacatagatcgtaaattggggctgattggttgggttgtatttgtctctgaagtgttcgtctcatttatggtagagttcatttactcatagttacttaagttttgctgttcatacaatatagagaagttagtgagacccttgagtagacaactctttctcccagcagttttgggattccttgtagccttatattcagtaccacatttctacatcaggccctcattaatctaggcccttctttctgcttcttgcttttatgatttcactgttccttgagccctccactaaaggtaggacaagaagagaaaggagaggcccagtgcagtggttcatgcctgtaattgcaacactttagaaggctgagacaggaggatcgcttgagctcaggagttcaagaccagcgtgggcaacatagcaagac

SEQ ID NO: 73334 - DNA, 1005 bp, Homo sapiens
taaagcaggaagattgcttgagcccagtagtttggggctgcagtgagctacaatagcaccactgtactccagctccagagacacagcaagactctatctccaaaaaaagaaaaaggagaaaaccaaaattattcatttttgttaactcttcaatattttgatgtactgaatatttaacaatttttaaaaaatctttacaataacattaattcaaaataactaatagaatcaaggtaaaggaatggtgattattgcagattcttccagttgctggtatgtcttcaatcagcaagttgagaaacatttttactgtattgtattaagttgtatatttggaaaaggaaaatattacttgggatttttctttgttatgataaaagatggcatctgtatttccaaacatggaacaatattatcacatcttacctgatgtaagatttctcaaagtagaatcatgatcactttttaaaatgcatctttgtgataaaggggaaaaaacatagacaggaggagcagtagagtaagatttgtttggggagtgtactgtagtaggatttaaaaattatcccaagaaagaagagaaagtcatcagaaaaggtctctacagatgctgctggtctgcagtagtcaacagaagggaggttctcagctggcagcaaatagaatcgccattgaaacttttataaaaagtacagatgctatactttttacttttataaaaagtacagatgctatactttttacttttataaaaagtacagatgctatactttttacttttataaaaagtacaaaccccaacccagacctattaaaccaagtccctaacaaaatatggccaagttctatgtttttaaaagttccacaaggtgttctgatgttcgcagagttaataattgctcaattcttcttaaagattttgattctgtaggcacacattatatgaccccaaacaattgcattgtgtaaaagtctggtttcatgtaattatattctattgtgggt

SEQ ID NO: 73335 - DNA, 1044 bp, Homo sapiens
acctcttacttagaatcaataaattatttttagttataataattgtcatgttcaggttgtatcataacacttttgtgggtttacatactttgaacattcagtaattcagcaagtctaaggcttgatgatcattattaataatgtcataaatctgtttttaaaacagctcaattttagtgtttaaagatttttctaaaaaataacttaccctttcagaaacgacctttctgatattttataattttttttgtaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacggtaagtagatacacatttttttcaggtgtattttgtattatgttgttaggtaccctgctgcaatattgtaagttagtgattcccacccttttaaagagtttcaacaaattattattattattattattattattattttattattattatttgagacagagtctctctctgttgcctaggctggagtgccagtggctcgatctcggctcactgcagactccgcctcctgggttcaagtgattctcctgtctcagccccccgagtagctgggattacaggcgccggccaccacgcctggctaatttttgtatttttagtagagacggggtttcgccatgttgtccgggctggtctcaaactcctgagctcaggtgatccgcccgcctccgtctcccaaagtgctgggattacaggcgtaagccaccgcgcccggccgagtttcaacaaattattattattattgagtttatttatatgtgcaaacccttacctaactgcaactgttcagctaaggattcctgccttatgaatttacatctctgtagagaattgagccagtggatcttttggtgccatctggtggctgataaaagaaaaatct

SEQ ID NO: 73336 - DNA, 1061 bp, Homo sapiens
caccctttatttcctcaaatgagaaataaccacataattacaaccataaaaatcaggaaattaacattgatacattactgccactaatccacagattccagtcaaggttcattagctgcccaagaaatgtcttatatagcaggtttccccaacccctgggtaccagttaagaagcttcttctgtatttatggtcactccccattgctcacattactgcttaagctctgcctccggccagatcagcagcggcattagattctcatgtgagtgtgaaccctattgtgaactgcccatgcaagggatctaggttgtgcactccttatgagaatctaaagcctgatgatcccccattcctcaccatctggtctgtggaaaaacttccatgaaaccggtacctggtccctggtgccacaaaggttggggactgcttttatatagcaaaaggatcctgtccagaatcatacattgtttctatgacatccaatgatttaatcctggcattgaatgagttaatgtaacatttaactactagaatttgcagtgggaagaaaaatgatataaaagaaccgtttatatatttcagctttacattcctgccatatacatcagtttgagtccaggatacctggaacatacatatatatgattaacttggacatataacatataattatatatgtatataattttaaatatagaaacatactatccagtgtctgtcatgtgtatatgaagtatcataagtttttaccatttgtaatattgtcatttttttctaattgtcttatttaaagtttatcacatttttaaatgagggggtgttgacatggcactgaaagaaggcagagatgggaaagataccttttttgtaaaactcaataaaagcttatatccaactagtcagagaaatctctacttccgtgtttttgttttctgtctcttcattcctcctgaagagtgtgaataaataggtttttcaagttctcctcataaagattaagtgacttaatcataaagattaaggactatgagtgatgggttatggagaattctgaaatat

SEQ ID NO: 73337 - DNA, 1186 bp, Homo sapiens
cactcaggcacatgttccaaaggctgttgttcatggttgttctctgttctacctccagtgaagatgagctgtccatcttctcatccttctcatctggcctggctgcaaatattatgtagatggttagctagatacctagttttgtaaatgcaagtaattaacatgaactagaatttgttctaaatctgaatttcagtaccaagattatcaaaaatagtgtgtgtcaataaatttggtatttgtttttaagattaaagcaaattgaaattactttgaaagattttttgctttcctttttgataagttaccatagaccttgagataagtagttctattctgtggtgttgtcacaaaccaggctaggactgggcaacactgtttccaagaatagattttatcaatctatatccatgtccacatactcagttctttgttttctctttaatatgtgtggatttttctctattaggttatattacttatttttattatgaaagtagtatatgctcattgtagaagactaggaaaataaaaaagaacgtgtattatctcacaactcatagataccacaattaacatgttgctgtattttctgccactaaaagttctttaaaaaatattttaaataatttaacacaatattccaacccataggcctaacttatttaaccattcccatgttgttggacacctggattgtttctaagtttttacagttataagaagcctttttatgaatgtccttaaacataaattcaggattacttgtttttactttgtctgcccaaattaataggttttagtggtttgacgtctttcaaaaaatgcctaattttaaacatttttttggtaatttctcatgtagcttcctaccctttctaagtcttctctctttcttggtgctagcctaaaccatcccattcgtttaaataaccaaccatttctagatgtcctccctttccagggacttttaatacatggtaaaatgtttgtcctgtatctcatcccccctcaaggctcgtgatgttaactagttaatctgatgagtgaactgatgcttatggaagaggctcccgggtaatccatatttgtgtcctgagatggtgccctagcagggccttttggttaagtcattagtgattctgatagagattctatccagctgagaaaagaagggctgtgctat

SEQ ID NO: 73338 - DNA, 1031 bp, Homo sapiens
gtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccacacacttcttggttggtttcattccattgcatgtgtgtggctgtgtttgttcttgccaccgttccaggcagggaaagccttatgctgccccagggccccagcacaccttcctgtatgccccaccaaccagtgaccctgcacccgtcccatcgtcaaggctgtgaactagggatggtccagggcatcagaaaccatgtggaactctcccccactgctgcctgggaggttccccagctggaagcgtcctagcgttaggccagtagggactgagatcataatgttcttggacgaggctcttggccagagccaggcatctgcccagaagttaggattgctcctggagaaaacactcaggagcaccctccccttggaaatgtcccagaccctcagcctcataggcggacctcctttgatggctctgggggagcaatgtggctgtccaaggaggggc

SEQ ID NO: 73339 - DNA, 1034 bp, Homo sapiens
gcagtaggtttgtttacaccagcatcaccacagacacatgagtaaatgcactgacctacgatatcacaaggcaatgggaatttttcagctccattatggtgctatgggattacagtcgtatacatggtctgttgttgactgaaatgtcgttatgtggtgtgtgactgtattgatcaccctcactgagaattagagtcaggggcttctacgcattaataatatcagtcacgcatgaaacgcgagtagtgtgggtgaggtccctggcctgcactgctgtagcgtgggtgaggtccctggcttgcactcctaagtatttgtttctttttgtttcaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacct

SEQ ID NO: 73340 - DNA, 1048 bp, Homo sapiens
aattcaggataatggtcatctcaggagaagaagtagggaagagaataagcgatatcatacaggagtgtccaatagccttcaactatatctgtaatattttattaaaaaaaaaatctgaaggcaagtatggcaaaagatattagattttgatagagccaatggtgggaatatgaagtctgatatgttactcttgtactcttccatgtgttagaattatttcataaaaagtttcaaaaaaaagaatgaaacaaaaatagagtgctgtaggcctggaaaatgcctacacattataaaatgataggccctctcaagacccttggaccgaaggaattgtagaaggctgtgtatcatatcattcagctcccacagaactttaaatgagaataaacttcatataattttgttcaaaaatgcagtattatatatagaaggaaacagtgggttgcaaaataaaaataacctatttccatcctctgagaagatcagaatttgggtcacctaatcattggacagggtaggtacatttaaaaatagttgaccgcttgtttacttgtatgtgtgtaacttggcctgccccgtaccccggctatgttccttccactgaagtatgaactacattgtttacttgccaaaaatattttgttatttagaaaaaagtaacagctaagtcctaggattgttttcacatcgtttaattaataggtttttttccccagagcaccttccgtagggtgcaaagaatgtggaacccagtcctgaaaatgtctttgctggattgttaatggctgactctcattagcctgctaataggctcagcacgtgcttcctactattggtgagcaggatagtgtggtgggaaagccccgatggaggtcaagagagcaaggtctttgttctgtctcagttgccagcagccactttgggcaaatccacctggatgcattttttcacttgcaaaatgaaagtgctgaagtgtaattctaagatactaggtcaggagacttttgtctctggtcctgactctcccagagatgtgcccaatatggat

SEQ ID NO: 73341 - DNA, 1025 bp, Homo sapiens
tgacctcgtgatccgccctcctcggcctcccaaagagctgggattacaggcatgagccactgtgcctggccctacaatagatttttttaacaggtggggtaggtgggagaattctatttgtaattctgtattcccagcctaactattgtaaatagtttagtacattttatttttcagtgcacacattccagagttttttctacagctgtattcacagtgtaccaacaactgatatcctaattttattacttaatgctataccataagtaaccattttcattattgctataaatagtttttagagccagtatatttctcaccatcatagtgtatcattgggtatatttcttctagtttaatagtcctatgtcattgatatttaggttactttcattttttcctactctaagtaatgctacaatgtgcattttatgcatccagctaatttttttaatatttaagattcttatcttctgatagatacctagagtggaaataagcattcagagagttccagatttttttggttcttttttctaataaataaaaaataaataataaatttataataaataaaaaaataaatatttttctaaataaaaaataaattttatttattttttaaattcagagacagggtctcgctctgttgcccaggctagagtgcagtggtgtgatcatggcttactgcagcctcaaattcctaggctcaagcaattctcccacctcagccttctaagtagctgggactatagacacgtgccacctcgcccagctaagttttttattttttgaagaaacagggtcttgctgtgttgcccaggctggtctcaaaatcttaggctcaagtgatcttcctgcctcagcctctaagtgctgggattgtaaatgaacacaagttggattgctcaccacacgcagagtccagttaacaagaggcaggtctggtaaaaagaaagttactttattagccaaaagtaataataggaaagtggccagattcccatccaacgcaactactttga

SEQ ID NO: 73342 - DNA, 1009 bp, Homo sapiens
ccatttctttccaattcaaaagtaatacatggttattatttaaaaactaaaacattttagaaatgtagaacagaaaaagaaagtacatcccataatctctccaaacgaaatcattagtgacaatttggggactacacctctggttttaattctctattgcaatgattattcttctgtttttcaacccaaacttttaactcattccttcacatcctgttttgtataaaccatttactcattgtttgctatgtgccagctgttgtaatgtctttacttatgttatgttgtttactttccaatactatgaggactacatattatttttttaccattttacagatgaggaaactgaaactcagagagagtaaggatattgctcaaggttatatggctaatacatgacagagcctagttttccatgcagatctgacactaaatcccatgttccttaccattaatatacctttaagaagattcgaggactgttcaaatgtgaagggagcgggaattgttgatgctcctgaggacagggtagtggaacagttgtaccataatcagttttacctgttaccattttctttttttttttttttgagatggagtctcgctctgtcgcccaggctggagtgcagtggcgtgatctcggctcactgcaacctctccctcccaggttcaagcgattctcctgcctcagcctcctgagtagctgggactacaggcccatgccaccacgcctcactaattttttctatttttagtagagacgaggtttcaccatgttagccagatggtcttgtgatctgcctgcctcggcctcccaaaatgctggaattacaggcatgagctaccgcacccagcccctgttaccattttctaatttagcactgaatgctagagatttagcccttcttaaaagtcaggatttttaccgaattatccttgtgaagtcactttaaaacctagggcataacttgattggtacatttacacatcaaacaataatataaat

SEQ ID NO: 73343 - DNA, 1026 bp, Homo sapiens
cgtctccaccaaaaccagtcaggcgtggcggcgcgtgcctgcaatggcaggcactgggcaggctgaggcaggagaatcaggcagggaggttgcagtgagccgagatggcagcagtacagtccagcttcggctccgcatgagagggagaccgtggggagagggagacagagggagagggagagggagagggagagccgaaaaagtttcttgtatagccccggctcttagagccaggctggcaacctttgatatgtaaatgcaagccattagaaactaggtccacccaaacatggtgattcccctcactgtttttgtttgtttgtaactgtgccattcattataaataaacagagcccaagaccaagaagtggttttttggattatttgtttgtttgtttatggcctaaacatttttattcttttaaccgttagcatacgttttggtcactaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgaggtaagccagctgtaaaaggatgtcagtggtgcttttcaattttaatatctatctatctatctatctatctatctactattcaacttttgcttttcattatggctttccatgtgttattttttaaagttttttctaaaatgtctacaattaatctattttttacaaaagcaaaaagccaaactatagttaagttttatgcagctaggtagcaaagataacggttaatagaagtaataataagaagtaacatttgttgaatgcttgctatatgccaggtacagtttcaagcattcaactcgttgaattcttaaaactacctttgtgtttaatactgtattattagccccatgttatagatgaagaacctaaagttcaaagatattaagtaatttgcccaaagtcactcactt

SEQ ID NO: 73344 - DNA, 1083 bp, Homo sapiens
attagcattttgcagttatagttatatattttatcaatgtattagagacagctaattgccttccaatatctgttctccacttcttccctaacaaaacgctgtttatttcatcactttgccaaacagtataaaagctcaattttccaggctgtcgcctcagcttcccaagtagctggaatgtcagctaaaggagtcagtgtgacttagtcctggacaataaaatgcaagtaggggcttctgggtagacatatttttctttattcttctaagtaaaaccaaaagccatgtacattatgtttattatataaaatgtgtttgctttattgagatagaattaatgtatcctagaattctagaacacccattattctaactttattagaaatgctaagcatcagtattactgttggaattacgagaatttgaaagatagctgcatataaggtcaagaatcagtaagtagaactacaaagcagaaaaaaaattattacatttaatataacagtaaattctaagggacttagaaataaatttagcaagcgaagaacacatctgcatgaagaaaaaaataataatcatatctaagggcaaagaataagatctgaactagtgagcaaaatatctgtacattatatttcaactaaaaccaaaaggattctgaaaggtggagagacgacaaactggctagggacctcaggacccaggagaaaacatggtaatgatatcctgaattttcttatttttgctttctatatcccactctggatactggtgaagccagcaacccaggaacaccaagtgcaaagaaactgcctcccctctctgcccgcccctggaaaaagactgctttctctagccaaaggaacatgaaaggggcagcaagacagaaaacttaaaggcaataaataactccagacaaacaccacagaaaaaagtgaaactccacccgacccccaccagcaaaaaccaagtggaaagcctagacttccatccctgtctggctgtaagaggaggcaccccaagctctttccctaaatggggaacaaggggaaagttgggacattcatcccccttgagcatgat

SEQ ID NO: 73345 - DNA, 1014 bp, Homo sapiens
gtctccttgtgcacagaagttgttaactggatctattagtttcatttatcagaaagtttggttacctcttttcttattactgtggttaagggcttccatagcaagaagacaaagaaaaatgatcaagaaggaagacatgaggaacaagtgccattttaatgaaaattaaacctagcaatatgagataataaggaagtcataaggaacaacatatttatttaaaacccagaacaaataaatatgaattgcttagttacattcatttattgtagaagcagattcagtattttctttgattggctttgtgtttttaaattatattaccagtgtccttttttttttcaaaatcatttccaagattgatcatttactctgtttactttttaaataactcattttaagtagttcctaccagaataatttagtagcatgtattggcatttctaagactttttttttttttttgaaagagtctcgctctgtgttttattaatcggttccaagattgagcatttactctgtttactttttaaatgactcattttaagtatttcctaccagaataatttagtagcatgtgttggcatttctaagactttttttttttaataactcattttaagtatttcctaccaaataatttagtagcatgtattggcatttctaagacttttttttttttttttttgaaagagtcttgctctgttacccaggctggagtgcagtggcgcaatctcaacccactgtaacctccgcctcctaggttcaagcaattctcatgcctcagcctcccgagtagctgggaccacatgcgtgtgccaccacgcccagctaacttttttgtgtttttggtagagatggggtttcaccgtgttggccaggcatgtctcaaactcctggcctcaagtgatctgcctgcctcagcctcccatgaggtgtggtggcaccacacctagcctctaaaacaattttaaatgataaaaaaaacaaaaattcattgagtcttgattgttg

SEQ ID NO: 73346 - DNA, 1030 bp, Homo sapiens
tgctacaaattagaggttcccacaaccccctcctcagattccatgatttgctataatggcttatagaactcacagaagtatttactattaccagtttattataaaggatattataaaggatacaaatgaatagccagatgaagaggtacaaagggcaaagttgggaagggcctgagaacaggagcttctgtccctgtggagttttggggtgtaccaccctcccagtatgtagatacattcaccagtctgaaagctctctgaaccctgttgttcaggggttttgtggaggtctcattacataggcatgattcagtcatcagcccattggtgatttgcttaatctgcctctttctcttccctggatatgggggtggaaagagtagggatgaaagtgcgaactcattaaccatgcctttgtcagaagtgccttggtctttctgacaaccagcccccattctgaagctgtctagggatagctcacctctcaacagtcatctcattagcatacaaaagacactcttatcactactggagattccaagggtctcagaagttcttatgtcaggaactggggattaagacaaatattataacagaaggtgctcctctcatacctgttacttgaaattagaagggttttaggaattaggtcaggagccagggcagaaaccaaatatgtatttcttatgatgttacatgtactaagactttaaaaagaaaaactgagaagttattttaacaggatcaatcaccattccataaatcttagtctgtcacatttgctgaagttttaaggaagtacaatatttactaggtttgtattaatgctgttagatgttgtcaataaatgtcaataatttttgtcttttataatttggagccttaaggcttttaaatctctgaaaatatagtctagcatcaccagtctattttaagtaaaccatttggtattcaaagtatcctcaatttcagtgctacagtatagctttagaagagtagtttcttgaagaaaacagtcttcctttcacag

SEQ ID NO: 73347 - DNA, 1001 bp, Homo sapiens
ctttataaatcacttgacattagaatagatgaaatatacaaaaaaatttttcccattaaagctttaaaagttgtatattttagtattttatgtaagatagaatttcatgagtctctgaataggttattgaatattcctagttaatcaagtctttttataaagtttagcttaagatgtctttgtgtattttattaatacactgaaatctaccaagtagtgtgtttttgttttgttttgttttttgttttactgcttagattatctggagaatttaaaagtgtcaaaatgtttctttcagtatcagttgagttttcaaaatgcgtaacagctcttaagtagtgtctaaaagtttatgggaatagactaaatttttctgaccttccctttctcattttatcattactttccataaagattctttggcataaaggagatgtgcggaagagtgaatctagatactctgacacgtagtctttatttttagtaggtaatacctgggcctaacccttcaagtactaattacagggaagtttctgaaagttctctagagtagagaacatagtttcaaaaaacaaagaagtatctttagaaagaaacttctttgttaccctaatttcatttgttctttcagcttaatattaaattgactaagaaaaactatataattatttttttgattttcatgcctgtgagagttgtagatagacactgtttcatataatttggatttacaaatattagagatgtcattgcagtttgagtgggtctcaaaaggcccataaaattactttaaaatgctcacagagaaagctaagttcacactttagctccttaattggccatttcagtggctcacaaaacatttttttttctagaaattctgacctttgaatatacagtgtaaaattttgtaagtttttaggaacaaattcactcagtctaaatctaaattaaattttcatgtaaattaccaccaaacaagctctctaccaaacagttat

SEQ ID NO: 73348 - DNA, 1078 bp, Homo sapiens
ttcaccatagtacttccagcctgggcaatagagcaagactctctctcaaaaaaaacagcacacacacacacacacgaaaacaattctgaactatgaaatctgaaacagccccttggtatctcctgggcatgatttgcaaatcttttttttttacagaaaaaaggcaaagagtaagcactttgccataggttacttggccgtgatcatctatctagtggaaaaggggactgggaagcccaagcagactgggaaaccagacagctaggaaaaggagcaaaacatagcccagcaacctacagatgaagaaagttgagaaatccatttattcaccatagagacgcaggaatttcaggcaatgcactaaaatgaaatgggggaaaaaagcttgatcagtatgggaaccatttttgtgcaaaagggaatattatggatcagccagtatttctttgagctctgcctgtggagtccatttgacctttagaaatatgaggtattctgtcagttttatcttcttggagaaatttctcctaaaatcttgatttgctttagtctggactggttcatagccatcatcttccatcagtaccccagagattcactttgtctcttatgtgggatctgtttccagttagatgccattattttccttttccttggtttactcttccacatattggtaaagctcttccaatagcttttggaaaggaaaaatgaaaagtaaatgttttgaatctctgtgtgtttgacaatgtctttattttacccttatacctgattgctgttttggttggcaaggtataggattctttagtggtctccatgcccagttttgaagacatctgctagctttcagtgctgttgctgtggagtctgaaaatctgtcttctggcttccagggtgactactggaaattgaatgccattctgttccttctcttttgcatatataatccatttttatctctcttgaagcttataggtttatctttgtctcaatgttctgtccctgttaagagtccattttcatcctttgtactaggtgcctggtgggatcattccgtctgaaactaatgatttcc

SEQ ID NO: 73349 - DNA, 1013 bp, Homo sapiens
tcgttcacattataggctttcctcagagttaatggtcttggtagtctactcatatttaagtgtggaacaccaaaaagcttactataagctgagagtgtggtaaagggctctttgttttactatgacctacctgagctatcttgctggggaacaccctaatgtcagtctctttataaagggcctttcattttggcctggcaagaaatactctttcatcctcctgcatggagggcaaaaaaaaatttaaaaattggctgctagggtctgtctgctcacttccctgttttgcagaccccacactcttctgcaattcatttcatagttgtcaagactatacaaattgtcctttttaatgttctctcttctgctatccctagttggcagtcttcctctttacaacctgctgaaagtggaagacctccagttttcctttaattcctcagcaaaccaccaactattatatgtcttttttccagaacaacttattttttaactataattatatgcatttatgttagattcactgaaaacctcatcttgtatggtgctctgtaccctatgggtgctaaataaaggcttgctactggcaactggatttaggatcggctaattctgcgtccttttaagatatgcttatttaagccaaactcggtatgataatttttttttttttttttttttttttgagagggagtctggctctgtcgcctaggcaggagtgcagtggcgcgatcttggctcactgcaacccccgcctcccgggttcaagcgattctcctgcctcagactcccgagtagctgggattacaggcgcccgccaccaagcccggctaatttttgtatttttagtagagacggggtttcaccatgttgaccaggctggtctcgaactcctgacctcgtgattcgcccacctcggcctcccaaagtcctggaactacaggcgtgagccaccgcgcccacccggccagtatgatagtttttaggaggaaccctcaggagagtgattgttt

SEQ ID NO: 73350 - DNA, 1050 bp, Homo sapiens
gccagcctaaacataaaagagggtttatgataaggttttgggggcatttcatgtttcctaaaggcaggcatgcaggtgggtgtaagaaacagctagaaagccattgggaacctagaatgtcctctttctagcccttgtttttctttctttgcagactgacttgctctaaccacgtggcttcagctattgctcaaagcccattccacacttttaggataggggatcagactgacccagcttggcatcagggttccacccaggtcaatgagttattagaggtcaggattacaaagtataaaacatgcccggaaaccagggtcattcccagagaaatgggatggcttatggtctgctcatccacccccaaagttgccactgttttacccccagtccatttcccactcctggtttgattttccacttttggtatgattttctgacatgtagctttcaatattactttgtgcatactctggatttttttttccaatctgcagctgtattcttcaggacttgtggaatgtgaggatcaggatccacttaatcctgatagaagttttgatgtggaatcagtaaagaaagaaatccagagaggaaggaagttggtaagtgtaaatgatgttatttcttatactggatgaacagaccctcaaggaatgcattccaaaggagtctatttgactgatacaccagggatagagaagcatcttggagagctggaagaagtaggaactgtattggaaacctcaattcaacttaacatttaatttttttttttttttttttgagacggagttttgctcttgttgcccaggctagagtgcagtgacacggtctcagctcactgcaacctccgcctcctgggttcaagcgattctcctgcctcagcctcccgagtagctaggattacaggcacgggccaccatgctcggcaaatttttgtatttttagtagagacagggtttcaccatgttggccaggctggtcgcgaactcctgacctcaggtgatctgcctgccttggcttcccaaagtgctgggattacaggtg

SEQ ID NO: 73351 - DNA, 1045 bp, Homo sapiens
tgcctagccatcatgacaccactgtcacatataaaataccagatagataaatacaagccagggatcaaataaattgaaccaagaaaaaactgttaatagagttgtagaatttttaaaaatttttggccctactacctagattcccttactttatctcacattatcctcaatggcaactctgtaagacagatattatcacccacagcaggttctgagtccgaaagagaaatcacaccactctccgtggcacagccagcgaccaatctcgcctgtctcaaagggccccctagtggggccccttgcctggagctggacaagtttgcccactctgctttttagaaaattctttttaaaagacagagactgtttttttgaaacaaaaagcatttttctgcttttaatcagatcattacaaaactgtctgtccaagcattccggttagctgaggtttcgctgaaattcccaaatgagcagccaaatataagtactgtaccctaatgtttgtaacgggatggaatcttgctgatgatgcccaggataaaatgcagggcttctggaacttaaataacatttaatgatatctttgaattttaacaaataacaacaaacaggtacttactcagtaaaatctattcttctgtagaaatgcaaattttgtcataaaagaggagccaccgtgggatgtgatttaaaaaactgtaacaagaattaccactttttctgtgccaagaaggacgacgcagttccacagtctgatggagttcgaggaatttataagtatttaataaaacatttttaaaaccacatttgggggattgggataaggaatggttggattaagacaaggagactttgaagactaattttatgtaaatggttttcaaatgagaacaaagccagtttgggggatgcacaggggttatgtgaattttgaatttcagtgaaaaatctatatatatatatatattattttagtcacaatatcttgaataatgagatcaatgttaggacagcatgtttttttaaatatgatttttgtgagcta

SEQ ID NO: 73352 - DNA, 1086 bp, Homo sapiens
aagagggcaagcctaccattgaaagaagcttgctaaataatttttttttttttttttttgagacagagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcaatctcctgacctcgtgatccgcccgcctcggcctcccaaagtgctgggattacaggcgtgagccaccgcgcccgggctaaataattttaaatctgatttcgagcaagttccgtaagtattttgttgctaatcagacatgaaatgtgtaaatatgtaaatttcgtactgcacttctttttatatttgattcactaagaaactcacaggttgttatagtctcagagtttcatttttattatttaccttaccaaagagctcgttttagtatgacctttacaatgaccttaaacacaagatcaaatgaaaaggaatgtccctgctatagcttaaagtttgaaaaaatatactgatcacacccattagaagaactaacaaatagggactcaataaaacagtcttcttgcattgttttatcaaggaacaggtgaatttttacgcatttttaaactgaatttaaaccttcatgcctatcatacatgaggcaccttgctaggtgctacgagatacaaagaataaaatatagattgaacctcagagaagttatcacctggtgggaaggccagaagaagggtcaatgcaaacagaagcacatgggataacgagagcaggaggggttacatgaaaggagcttggccttgagaattgttgacactgtggaatggatggggacatgggggttcatcctgatattttcaacactgttttatatgtttgaaaaaatttaagtacttgggaagtgaaagtgctcagagataccagaatcaaagtgggatgagattaactttgtttgggtgttgctgggaagactgcatggaggaggtgg

SEQ ID NO: 73353 - DNA, 2005 bp, Homo sapiens
aaggggtgcttgtcaaacacctcttaatgttttataatacaaaacaaaaatatatttgatgtttacatctaaatatgaatatggggtttttttgtttttttttttttttgagacagagtctctctctgtcacccaggatggagtgcaatggtgtgatctaagctcactgcaacctctgcctcctggattcaagtgattctcctgccccagcctcctgagtagctgggattacaggcatgcaccaccacgcctggctaatttttgtatttttagtagcaacaaggtttcaccctgttgtccaggctggtctcgaactcctgaccttgtgatctgcccatcttgccctcccaaagtgctgagattacaggcgtgagacaccgcgcccagccagggcatgatttttactgtaggcatatcatttagttatgcacagcaaaagactggttttcattttatgcaatattaaaatcaatgtaatgcaatcttgattttctctcctagccacccgaaacaatgaaatgtaatacattcataagacaagtgaaagaagagcatggcagacacacaggtttgcgctaagtgttgtctgtaacaaatatggcctacaatacttataaaaatgtcaacccacctgtttcaaacttggtatcccgcctaaatctttattcttctaggcttgtggtaattaatgagtataaatctttatcgcaactgtccactctattgtaatcccagcatatcaagataacttaggttggaatggtccattgcattcagtattaagaaaagatagacttctattaataaagacacagacaggcttgcctgagctcagaatccagcaatgtgtcacccctcacactgtgacccctgtaactgtagttctctgttctttaaagaaatagacattccactaacaacacatacaaactgtgacaagaagtgacaggggctgttatgtcaaagacttaagggtaatttttaaaaatcctcttaattcaactacatatcgggtacagtgtacactgctcaggtgacaggtgcaccaacatctcagaaatcaccactgaagaacttatccatgtaacctgaaaccacctgttccccaaaaggtattgaaatttaaaaagttacagttttatatgtttaaaaaagcctcttaattcatatagttattgtaagcagagaaattttcatttttactttttgtaacattttattcattgtttcagctggccaaaaaaaatgaggtatgatgaaattataattaataaaaagggtgaaggtgctgtattattttactaagtatgtgcatccaccactaggcaaggtctgaagaaataagcataaagtaatttatgattagctgccctaagactatttccttctcaaatgtttgtcttattcttagatgcaactgtgaaagttccttttcttaagaaatgcaaggaagcaggacttcttaattacttacttgaagaaatattagacaaagttcattcaattccagaaaaactcatggatgagactacttcagaatcaggtactgatgaagagcaatatttcgaagtatagagacttctcccagatctagatttaaaacaaaacaaacccaagaaaaaaaaaaaggcccattttcttcctatactacttttttcttctatcagcttttggaaatgcttactatttatttcactttttggttttgccctatagaaaataatcccattcaaataaacattttttatattgttgcctacaatataagctgtccagcttgtcattctttacctttacctcattcttttttttttttttaagacggagtttcgcccttgttgcccaggctagagtgcagtggtgcgatcttgcctcactgcagcctctgcctcccaagttcaagcgattttcctgtctcagcctcctgagtagctgggatttcaggcacacgccactacgcctggctaattttctgtatttttagtagagacaaggtttcaccatg

SEQ ID NO: 73354 - DNA, 1050 bp, Homo sapiens
caagaattgggggccaggcgcggtggctcacgcctgtaatcccagcactttgggagcccgaggtgagtggatcatctgtggtcagcagttcgagaccagcctggccaacatggcaaaaccctgtctctactaaaaatacaaaaattagccgggcgtggcggtgcgcgcctgcaatcccaactacttgggaggctgagacatgagaatcgcttgaacccaggaggcagaggttgcagtgagccaagatcgcaccactgcactccagtctgggcaacagggtgagattctgtctcaaaaaaaaaaaaaaaaaaaaaagaaaaaagagaaatgccaagaattacatttctgacagcttccctgtagtgctgctgctgctgttgccatctaacattaaagttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatactgtacaggtgataaaaatattttagaagaatgttcattgttttcttaaatgagaaaagccaattacaaaaacagtatgaccccgcccacctgcccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttcctgcggcttctctgctcttgggtggcgaggctatgata

SEQ ID NO: 73355 - DNA, 1886 bp, Homo sapiens
tagccaagaaatgtttgcagtagaaaatctcgtttggtttggaggagggagatttaaccttcctattaaatatcaaccatttattgagtgagtcctcctttcagcattaagatgccctcaagacaggctacacctccacttgtttatgagtctggtctgacttctctatcaaggctgccacacacagctgggcaggccgggcacagagtcaaacagcattggtggatggctccccctgaagttgcacaacagagtgagtgccctccacactctgcatttccacagatgcatctgtctctccagcatatggtaggaagacaataagatttccctgtgaagaaatcattagttcatatccctgtctcaacatacacaacctttctcattttggcttctatattatacatttctatttgaattttttactacatttataaccagcaggaaaaatactttgaaaaatctaccaaaaagagtgtctgtcttaatagtcttttgaggatgtctgctaatatatagcagtatccatatttttttaaagcagccttaaaaatttttttctaaaaagagttattttgtaggggacttccatgtgtgtttttctttcatgtaagggaacatgtcacacatcactacttggatggattaggtgggagtacatatattatagtgtagtatggcgggggtgccactacttagaactgcatgagattcaacttaaaaggcttaagttgggtttcactaccctggttgataaaaacttgcttaatttagccttactcatattttaagttaactatacgtatgcagttattctgaataaagtttgtatatgtgtgtaactgttcgattttgaggcttttaaaaattacattgccattgactactatttgttatttataaagcctaagtatcttcctcctaagcttttctaagtttccacaattaaaagccttcctatttctaaatgaaaccaaaagcctttatgtaacattaaaaattggacacatttttaggaaggatttgtccttaaccttggtattctagccacattctccaattatcatctctcaataaatggatatagtatagcatgaaggttatacagtcactgttttcaagttctcaaagatatacaaagggacttgttctgctataaatgtgcacaaaatcttaagggtttactgaacagctttgtgtatgataaatgttagaattctgtcctgaattagaaggaggaagtgaaggcataaagaaaccagctcctgcccataaggctctggatccttttcaccagaggcacgaggattgtgtatctgtacctgcaagtgaaaggggctagaaatggtacattatttctaataaaactactgaataagctgaaataattttatttcttcttttcatagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatactactttacttgta

SEQ ID NO: 73356 - DNA, 1022 bp, Homo sapiens
atggtggtgcgcgcctgtagtcccagctacttgggaggctgaggcaggagaatcgcttgaacctaggaggcagaggttgcagtgagccgagatcacaccactgcactccagcctggcaacaaagtgagactccgtcttaaacaaaacaaaacaacaaccaaaaactttgctaagacttaatatcaggataggaagctgaagctacagtaatcaataatcatctagactagcggaaatctgttcagagggtgttggatggggtcttcacttctgtagtttttaaagtgccccacatgattctgatgtgcggccggatttgaaatccactggtttagattttgtccctaagatataagaacttaggctagggctgccattacaactggaatggactgttctttttcatctcctgcaaatatttttccagtacttatttattacatgtcagacaccatgcttggagactcagttaaaacccattttgagacgcagcattattgaaaatcagagtaccatggtaaaaaatgagaactgtgaatgttaagttttcaggggtcagacgtgatagtgtgggcataaaaaccagaatcgtatattagattgagaaaaatgtaactgtcaattttttttttcattcttgcatactcccgataatgttcttattcagagtccaatttaaaatttaggtgtctgttttgaagatgatgaatctccacgtgataactgtggctgaaaagagacttttcaaaagcagactttgtgacacgaaaacaggcaaatttggtacaagtaaagtagtataatccaaatttattatatctaagaggctatcatgggctgtaagtagaatcaaaggttaagaacattttatgcacttattccacaaacatttactgagcatactaggtgctgggaatgtgacagtgagcaaaaaacacaagagtgtgcaaagagtgatcaaaatgtcaaccagtaagaacagggaagagctgctgaggccaagaggagacgactagttctaa

SEQ ID NO: 73357 - DNA, 1996 bp, Homo sapiens
cagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactcttgccttcctaaattatgactgctgaatcatcatatctactatatatgactggaagaagtggttcttcaagtcaaccctcttacaagacttagtggaatttgctttatctactttaggccaaatccatcacacattggcttatgtgaaactttatcatctttcacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttctataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacaggcacatagagttgtttttttccttcaaaatcagtagtctgcagccttaaaaaggaaagaaattctgacacatggtgcacagaggtgaacttgaggatattatgctgggtgaaataagccactcacagaaaaatactatgtgatgccatttgtgtgatatacttagtcaaattcattgagacatagtagaatgg

SEQ ID NO: 73358 - DNA, 1046 bp, Homo sapiens
acgcccggctaatttttgtagttttactagagacggggtttccctatgttggccaggctggtctcgaactcctgacctcaagtgatccgcccgcctcggcctcccaaagtgctgggattacaggcgtgagccaccgtgcccggctgggattttctttttaatgtgccactttaggttgaccatatctcttcattacctttctgtttcttaaactaacccacatcttaattcttttctctgatgtcttgaacgtgacaaaacacattctgcagactaaagtggcattctgccttttacaacaatgtctttgagcataactagattatgtgataatcgtgcaggaaattctttcccttgtagatcttgcgtgtgtgtgtgtgtgcgcgcgcgtgtgtgttttgaagagtcgtactttgagttagaggaccattgcttttactgcgttgaataaatagtatgtgtttttctcacacctacctgtggtcacctttttgcctagttttaggtatctggcctctcaaatatcttttctgggggagggtgagagatttggggtaaagggctcagagagaagtaattcaatcaaagttgcctaaaaaagccatttttgtttttatttttgttgtgtgtccaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagt

SEQ ID NO: 73359 - DNA, 1059 bp, Homo sapiens
aaagttgaccacgatgttttcaaaatgtatcttatttttgtttgaggctatattctgattataaatatttgataaggtcaaatgtagctgactttgtctgcagcccgacaacagatggaatgatgatcaaagtaaatcatttctaatagaaaatggggtatgatttttttcctgtccttcctgtgacaccctgaacctctttattagaaaagctgtttctttagattttatttccacccggtgatataattttaaattgggttagtgccttttctgtccatttggtgacggatgttagaatcctctctgggcctctccacgctcctcctccttgttaacgagttccatactcaggatcagaccttgctgactaacaccagtgagaacaacctgggcagaggcagatgtctcggctcaagttgctggaaacttcttcctcacttttagctaagatctgtcctaggaagtttacagaaaaagcctctgctgctgcttcctgtgccagcaggtcatttcctttactagttttcatttttctcatattaagtataaacatgataaaaacttcctttagaaagactccaaataagtgtgattccccagagtctgtcacagtgtgggcatggagctggcgctcaaaaatgcatgttgaattaaataaatgagtgaaaacatttgaaatacctcaccatgaaggtgtgcttaaaaaaaaaaaaatggccaggcttggagatcacgcctgtaatcccggcactttgggaggccaaggtgggccacttgagatcaggagtttgagaccagcctggccaacatggtgaaaccctgtctctactaaaaatacaaaaattagctgggtgtggtggtgcgtacctgtaatcccagctattcgggaggctgaggcaggagaattgcttgaatctgggagggagaagttgtaccactgcactccagcctgggcaacagagcaagactctgtctcaaaaaaaaaaaaaaagttaaaaaaaacttaaaatcctacaaatattacagattcaacgtagaaaaattagagaatagaaa

SEQ ID NO: 73360 - DNA, 1405 bp, Homo sapiens
ggttaatagttttggacctagtttatgaccataggcttttttgttctaatgttactgaaggacttttttttttttaatttatttttaagttctggggtacacgtgcaggatgtgtaggcttgttacataggtaaacgtgtgccatggtggtttgctgtacctgtcaacccatcacctaggtattaagctatgggcttattttaattttctagtagtgaagtataagttgctaatgcatttagcgttttagaaacaaaatgaggattgaaattgcattttttgctctttctttgcactattgaagaaattgtataaagtaaatataggagaggtgtggaagtggaggaggcagacagtaaaaaagagaatttatttactcaaattcagaatcttatccactaagaaacttctaatttacctgtacacctctgttcaccaaaacaaaatctctgtgtattggaaattattatacatttgattaaacctttcacatattttacttttaggtcttctggatttggcgacatcttactgtgaaaacagactgaaaaaactttgtcagcacattatcaagagaggaattactgtggagaatgccttttcgctattctctgctgcagtcagatatgatgcagaggtaacttaaacaacaaacagaaaccagaccacctttaactccctttgtgctcgtctcccccgcttcttgcgtgaggcatggaaaacgatgagtcactccacttctgtttagggaatcagtgaacccattgaaaactgaaatctgcccttgcttcttaattccctgttcattgtttcaaaagtcgttgttcctctactttcatttctaagtaagacaggaaacgaaccaaggtcctagcagctgtgctgcaggttggaacataaggtgccacaactaattggactaacaaacagcatattttagtttcaagtctttcttaatgtcagcatatgtgtttatttcgagacttaccttgctgtctttccacctctgccctgtcataagctggggatgtgtatgatttgtatctgtgtacgctctgcaattctattagtgtctaattacagctcacagttatttacctgttaagaacttgctgtggactccttttgtttttgcactgggttgagttcttaatctgagattcacagatctgttgagcctgtgaattaatgggctttggggagtctgaaagtttgtgtgcatttttttgaagaaccaaagcatcagactgtaagctcctcgtgagcaggaactgtctcattcgtctgtataccctatagtgcctggcacatattaggcacctgataaatgttgaactggatgaagatagtaccttaaaggaagcattaaggatgatcagtgagctgaaggcgggtatggttggtt

SEQ ID NO: 73361 - DNA, 1051 bp, Homo sapiens
ttctaggctcagcatggtggctcatgcctgtaatcctaggactttgggaggccaaggcgggaatatcacttgatcctaggagtctgagaccagcctaggcaatatagcgagacactgtctctacaaaaaatagaaaaaattagccaggtgtggtggtgcattcctgtagttccagctgctctggaggctgaggtggaaggattgcttgagcccagtagatcaaggctgtggtgagctgtgatcatcctgggagacagagtgagatcttatctcaaaaatgaaaaaaaaagtttttaagatatagttccttgtataaatgtgagggacctatgcgtttattagtaactgtttgccacaaaggttgccattgcagaaaaaggcacataagctaagaccattaaagtggccatttacaagtctttttggaaatttaggtaaaaacctattggcaaagaaatacatttgaaaggaacagaaaagccctatgtcattccttacctaagggagtaaatatctgaaccacagtattaattgaaaagatgaactggaactgtttctgtctgtgcacctgtggtcaaccagtctattcctttcatgtacagttttctgaccatgaaatccatgattctttcttagacaactatttcttttttatttctcaggtaattttttatgtaagtgaaactatttttttagtattctgaatggattctttttcttttttttttgagacagagactcattctgtcacccaggctagagtgcagtggcgtaataccagctcactgcaacctccacctcctgtgttcaagcgatcttccagcttcagcctcccaagtagctgggattacaatcgtgcactaaccacgcccagctaatttttgtattttaagtagagacaaagtttcgccatgttggccaggccggtctcaaactcctgacctcaggtgattgaggctgacctgcctcggcctcccaaagtgctggaattacaggcttgagccactgcacctcagaatactttttctctttgtgccgtatctcactttaa

SEQ ID NO: 73362 - DNA, 1061 bp, Homo sapiens
aatctagactcctggactcttggcccatcttagtcatttgtattcttttacccaccagtgatccaggttgcaaggtcaggggaagcctgacttttgagaggttttctacctttcctctgtagccaggagagctctgcattgcatggggtggagggagggctgtcagttaaggtcacagggcttaggtgaaaggtaatgccttgggggagagtctgatgataaagcttgcagataagctcatttgttgagtttcagcctaggttttagctgttgtccctcctctaggagttgctctggtaacagcacgctaccaagggaaaatggttcatcccaggcttggaagccgaggtctttgattaagacactgattattaactcagctgtgggcagttgaaacctgcttcgtgtatccatagcagcttgattcgatgcctggtcaggatctctggaatttaaaaaaatttccccattagcccttttctgcttcttttcttctttcatacatataaaacacaagaaagcattccgggaatttgtacaagtgcctttacttttccttgtagtaacacagttctacttaacatataaccacaacagcaattcttcttatcaggtaaggtgatcctgtgttcttataaaactgttcccttcatgtaggtgttgtttctaagtgaatttgctctgtgtttagacagtgagtaaggattatgcatatagtgatttttagggttaacagagatgtttagattccagatacttaggaaagagtttctctgcttgagaacatgaccgcttagcattaccatttaagtggtaagtttgtttcttgcacctccttgagttgggtatgctgaccccttgaaagtaccccaaagcagaaaaaagatattcttagtgtttcagtcaagggaaacaaattcttagtcttagaagagaaccactcgttttgagagggggttattatattatcatgaagtacctataatttttttctttaaaaatatacatttctaatgtataactaggcatataagatggtatttagcctttctaaataccat

SEQ ID NO: 73363 - DNA, 3831 bp, Homo sapiens
ctgtatagcatcctgtgtttatctgtgtctgtgatcagaccatttatgcggctttccatcattatggctgctgactttggcttctgtgaatgacccacatacagagctctactgatgaacatgtcagttttctaattttttgctgttatagacagagttgtggtgattttctatgttactctgtgtatgtgtatctttgtacacttatacaagtatttctatagaataaatttccaaagaatttctgggtcaagaagtatgccatttgaaatactgatagccattgccaaatttctctccagaaagttcatgtctgttacacttctggcactgggtgaaagtgcctttaaccatctctccccaggcccttaaagtccattccccctttccgctccatcatgttaccctgaaaagccccagtctatgtctgccgccctacattgctgtggggctcgatgccaccacaaatcttgggtttgtaatttgagcaaggcctttatttgttcctggtcagtactttttcctatggctatttggaacctttaacactcctgtcaaacctatgcctagctctgttactttcagcagatgggcctcctctcactctatatccaagggactgtcacgttctgggaagtcttctatttttaatcctctttcctctgctttccctctcatgatccccctatcactccttagtttagagcctcatcagagctcacctatttgctaacgagggaagaaatgacctcctaaaggttcttcctgcctctagccttatatgctccatcatctttcatactgtggccagcattatctttcaaaaatacaaattaaattaatatttcaatgagaaatttatagatgtattgcactttccctggtaggttttttgtcactttccctctgagctcttgcctttccttctagtctttttgttgttgttgttgccaggctggagtacggtagcacgatcttggctcactgcaacctctgcctcccaggttcaagtgattctcctgtctcagcctcctgagtagctggggttacaggcacgcgccaccacgcccagctaatttttgtatttttagtagagatggggtttcactgtgttggccaggatggtctcgatctcctgacctggtgatctgcccacgctggccttccaaagtgctgggattacaggcgtgagctaccccacccagccttcttctagtctttctactaccactaccgcagttgtgtccagccaagcccacctacttatcttctaaactagcttctaacacagtcaataccttctgcttggaatgtttttgctctccttcatccttcagctctgctccaatctccactttttgaaaagtcttccttaatctttcttcctagagctaaagccttcctccttgctgttctgcagcgccttgattatacctattgtagcacttgctacccatcagcaaaaaatttgcatgtatctatttcgcctgttaaactgtgaccaaaaactagtacctttcagagtgttctgacatacagtaggtacttaataattgttagtgaggctcaacttcctcatgtattaaacaggaaagagtgacttgccccagactatctaactagtaagtcatggagtagaaactgatgccaattctgtcatccccttctccaaaatagcttctgtttggagatcagttgcaggagcatagagtagaatataggtgttggaagtatctgatttgtttagatgggctggtttttttgtctcttccttcttaccagcagtttaaaaatctcactctctcccttctgtcctctctaaggtatatggctggggttacaatggcaacggtcagctgggcctgggaaacaatggcaaccagctgacccctgtgagagtggcagctttgcacagcgtgtgtgtgaaccaggtacgtgtggtgcactctcagttagtggcttcccatctaccttccttgctctaacttggagaaatattggaggtttactcttcagtcagtcttttctggcaatactctgtgccttcatcttccatatttaatattatatcttccctaatttcccacgaggagaagcaagactatggtgttggcaaaacaggctcgacaagttaaaaaaaaaaaaaaaaatggaaaaattcagtagcctaaggtttaggcttttctaatgcttttttttttttttttttgagacggagtctccctctgtcacccaggctggagtgcaatggcacgatctcagctctctgcaagctccgcctcccgagttcacgccattctcctgcctcatcctcccgagtagctgggactacagatggccgccaccacacctggctaattttttgtatttttagtagagacggggtttcaccgtgttagccaggatggtctcaatctcctgaccttgtgatctgcctgcctcggcctcccaaagcgctgggattacaggcatgagccaccacgcccggccttctaatgcttttttaatgttccagcaaatgtcagtccacccctgatgatgatttggcattctgcagaagctggctatagcctttaagtagatgttctccctgcccttcctgttttcctgctaatggtaaccgtttcaatttacttgcagattgtctgcggttacgcacatactctagcactaacagatgagggcttgctgtatgcctggggagctaacacatatgggcagctgggaactggcaataaaaataacctgctaagcccagcacacatcatggtggagaaagaaaggtaacttggctgtgccacgtcttgggactgtgtgtgcgatgtggccttggggctgtgtgtggcagagctgtggtgtttggctttgtgattcttctgtttattaacattctcattttggacaaaagagataaccttcccttctcccttcccccttcctccttctccctccctgcttcccccttcccccttctccctccccccttcccttcccttcccttcccttttttgagacagagtctctgtcacccagactggagtgcaatggcacgatctcggctcactgcaaccttcacttcgtgggttcaagtgattcttctgcctcagcctcctgagtagctgggattacaggtgtgtaccaccatgcccagctaatttttgtattttttagtagagacagggtttcgccatgttggccaggctggtcttgaactcctggcctcaagtgatctacccacctcggcctcccaaagtgctgggattataggcatgagccccaccgtgcctggcctatgcaaaagtgttttgagtagtagccagaatgaacatgaggttgatatgattcttatgtagctctctgaaataaccacctgtgattgataggtgtgaatgcatcttggtataattactgcagtcttgctgttgcccttttagtatggaagacaagtaaggtctatggccatgttgatgtttatggtgtaatataaacttttactttgagccaagtaaaacaacttttaaataaatctgctcttgaaaggacattatctgtttaaatattgatttgatataatatgtgttactggaatagatgcttgatgttgttcagcctaattgtaaggtcttacctcctatgtcctggagtgctgacttctgattatgagaccttacccaagaagcatactactgagaaatatagtaagtttggcttgttttccttttggattggaacgttcagagtccgtgacccccagccaatgcttatcagcccaatgagtgttctgagctctggtaggagatgagagaaaaagttacatttataaagaaatgg

SEQ ID NO: 73364 - DNA, 1048 bp, Homo sapiens
agttttttctttaaagattttgcatctgtctatcccgttctgtcacccatctctctctcctttactctgtccatggttacttaatagagaggagggggcaatgggagagaaatgaaggttggagaaggagctgtacgaagttctggggaagaaagtacagggttactatttctttttggagctgattttttgtgtgctttgtgtgcacagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtaagtatgctgcttttattctttattctttttttttttcatcatagtaaatacacttaacataaaatttaccagcttcaccagttttaagtgtatagttcagtggtgttaagtatgttcaccttgtcatacaactgtcaccagcatgcacccacagaactgtttcatcctgcaaaactgaaacgctgtccctggtaaacattcactcccattctgtcctcccccagcccctgacaacaactttctttttttttttttttttgagatggagtctcgctctgtcgcccaggctggagtacagtggcacgatctctgctcactgcaagctccgcctcccgggtttacgccattttcctgcctcagcctcccaagtagctgggactacaggcacccaccaccacacccgcctaattttttgtatttttagtagagacagggtttcaccgtgttagccaggatggtctcgatctcctgacctcgtgatctgcccgccttggcctccaaaagtgctgggattacaggcgtgagccaccgtgcccagccaacaactttctactctgtttctttgagtttgattactctaggtacctcacgtaagtggaatcatacaatgtttgtccttttgtaactggtttatctcacttagcataatatcctcaaggttcatccac

SEQ ID NO: 73365 - DNA, 1307 bp, Homo sapiens
gaaggagtctcgctctgtctccaggctggagtgcagtggcatgatctcggcccactcaacctccatctcctgggttcaagcgattcttctgcctcaacctcccgagtagctgagaccacagacgcgtgccaccacgccccggctaatttttgtacttttagtagagactgggtttcatcatattggccaggttggtctggaactcctgacctcgtgatccgcccaccttggcttcccaaagtgctgggattacaggcatgagccactgtgcccggccggtacatttttctaaacatagatgctacctggctttcctttctttgtgcattgcttgcatcttgaatcgggaaatcttcatctgttctctggcattcatgtagttgccatattgaaagaaccggggatgcaggttgataggttcttgtccttttttactctgcctcttcaagatcactaagggagagtggacattttgtatgtgtgtgtaatcgatctgtactgtgggcacccaacactctctgaaaattcattatctatttaaatgcttccttttatactttagatacattaactcttgctctctttctctgaggtcctcagctttttgttggataattgtctagggtggcatttgggagatgatttgcatcccggcctttctttgtctagactgaggaatcacagcttcctagaatgctgtcacaggttttagtatctagccttctaagtgcctgtaactcctaactgaatctacttcaagttctctgcatctttctcaagagagctgtgaaatccaaatctgagcatcatcatgtggtatgaatataactggagttgagcataatgaggtgattatctcacttttgccttgcgtaatcatgccttctggcatcacactggttctttctttccttttttttcttttgagacagtctcgctctatcgcctaggctggagtgcagtggcacgatctcagctcactgtaacatcagcctcctgggttcaagcaattctcatgcctcagcctccgaagtacaattagaggcatatgctaccatgcctggctaatttttgtgtttttagtagagacagggtttctccatgttgaccaggctgatcttgaactcccgacctcaggtgatccacccatctcagcctcccaaagtgctgggattataagcataagccactgtgcctggcctttttttttttttttttttttttttgaggcagggtctctctctctctgtcacccaggcaggagtacagtggagtgattatggctcattgcaaccttgacctcctgg

SEQ ID NO: 73366 - DNA, 1028 bp, Homo sapiens
tcggaaagtggcccatcttcactctactctcccctcaagagatcgcgtctattcggaaggcgtgtgtcttcggcacctcagccagtgaagcactgtacgttactgacaatgatgaggtaagagtctcttgaaacctagtttcgttttaggacttatttggcaattggtcttcaaagtgtccagttcaaagatggagaaaaggcggggtataaataaagagatcctgaagttcaggaagactatggctttgatagtttctcttttttcagtttcttgatttaatacccgtctactccatagcactctgagtttcataatatagacaaacattctgaaacgtaagcaatgtccacagaggttgaatttttcttaacaaccatatcagtctcttttcacctcctgagctctgtagttgaaatgtcttattttcagaggagagaagggagcttttaatacagctttcggtcaaaagactcagaaaaaaaactatctattttctaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaaggtaaggagggaacccatctaacttttcagtttgtaagaaattgaccggttaattctaagcttaggggagatagggctataccagataactgattttggattgtttgcttcttaatttctgagaggaagtacataaagcaggtgaaagttaaacacttcgggctaactctggaaaagctataggatgtcttgcaaattaggcaaacttctgaggttttcgactgcctccataaagctgtggatgattagatatagcaaatgatggtccttccagcctaatttttcagtggatttgtgttgcaatgcaacttttttatttatttatttatttatttatttatttattttattttatttttttattgatcattcttggg

SEQ ID NO: 73367 - DNA, 1068 bp, Homo sapiens
catgttggtcaggctggtctcgaactccccacctcaggtggtccgcccgcctcggcctctcaaagtgctgggattacaggtgtgagctaccccgcccggcctggatactttttatattggtaacagtttaaagacagatgctgctgtacatttacaaggcaagataaagtcagaaagaagtgactttaggaagttcactgaagttgttgaggaagttcagcccttcaagggccaggactgatattctccataagaaaaattagaggggtctgctgtgtgaccttggcgtcatttcacctttgagcctcagtcctcatctgtcagaaatggtttacagtctcctcctcacaagagtattacgaagattaaatgaaataatgtatggaagctacctaattaacagtgtctacgacaaggcaggttcaggatagttattcgtttcttctttcctgctgttagctttgcttgattgtcttgctagggataattacttgcttggccaatattactgcctctgttgttcttatctgttcaagaaatcccccagcttcttcattatatcttgaacataaaatgacaaatttctaggtttgggggaaacccaggctcaaaacagcaaacagctgtcatactgactgattttaaaagcaaacctgggacacaggcctcagcactctgttgttaccaccctaccaagcctgttggggatgcctttttcttttatgatgggtatggacatgtaagatacatgacctatttcttgaattgactcttaaatgacaagtctttggagaaataccttgtaaaataaagcttcatgtgatttagcactgggtgaagtcagtgcgtataataatgccccatcattatgaaggttagcttgatcttgcagtagattaccaaacccttagggcagagttgcccatatttgtttaatgattttagaataattgtgctgctgtcaggaagttgtgtggttttgaatgtcttaccttttgtgttgtaattttaaaggtggtgagtcatatttttggctaattctgtgtcatgtaaaattaaacattttga

SEQ ID NO: 73368 - DNA, 1003 bp, Homo sapiens
tgttccttggggaaagtaaaataaatgtgctcttaggggaattaaaagattagttgctacattactccttcagccttccagttctaaatgtagatttctaaaattggaaggcctgtgtttgtcctgactgaatttgctttcagagtataaagtaaaataaccttttcttcctcatgccacaagttctctgagggacagtgccaatagctaggataagccatcccagggaatgggatattgatctgtaggactaatggacgtaggataagtgcagtggggatacaggatgtattttcaagtgccagagaaaatacgaagagccaagtgggttggcatattatctttaaggacgttacactctttctacctctgcttgcatttttgcgttcctcttttctttccttgcacccttgttttatctttatacagttaaaaaaaaaagtcattgattcacctaataataactcataaagagtggtaattcaggctgcaacacattaatattgtttttcagaaagtatttcctaaataaaacatggaaggcttgcaaaaaaattactatcttagtgaggtacttcagaagtaactatttaaagatgactgacattctaattacagctcatcatttttataattatcaagatgacaagccctggaaggacctgtcatcttagcaatttgtttggtctggtttaaattgctgtatgcactggaaaattctaagaaggctatatttcttttataaatgctccgttgagaatttccctaatctgaacttatattctcaagacatgattaaaacagtatgattttacttttccaaacacattttttaggactgaaacctttctatatttaattttagaaatgtatctttgagtttattaatgcagtcttgataaaagcccacaggatgattatttgattttaaaaaattggggtaaaaggtatatagtgtaaaatttaccattttaatgatttttaattacacattttagtcaca

SEQ ID NO: 73369 - DNA, 1050 bp, Homo sapiens
gagaaggctacattctcagactccttagtcaagcattcagggcattcttcctttccctttcattctttttttttttttttctgagacaagtctcgatctgtcacccaaactggagtgcagtggcaccatctcggttcactgcaagctgtgcctcctgggctcacgccattctcctgcctcagcctccagagtagctgggactacaggcgcccactaccaggcccggctaatttttttgtatttttagtagagacggggtttcgctgtgttagccaggatggtcttgatctcctgacctcgtgatccgcctgcctcggcctcccaaagtgctgggattacaggtgtgagccaccacgcccggcctccctttcattcttgtagtactgtgtgtttgcagaagagagacgtggatgacagctgttctagcagctggggcaataacatattagtgtctcagcacatcttcgaaactttgcctgtgatttgcagcccttataccatagagtgggtgaaatggttttaagttttatttttatttaaaaatgtttgaggctgattcttagaggcttatctggacctgggaaatacatttggtatctcaatgagacagcatttgctcagtctcaaaaagcccatcagaattatatgtaagaaattggtaagagtaacatttggctgtttgtaccttgagagggtttttgaattgcttttgctgtagcatagatggaagacattaagttgtaatgttgtataccaaagtttaccccaaaccgtagagctctcttatttgaatgtttttctggaattaaatggattcagaaataaagattgtcatacccttcaatcttttgtgctcaaatggaacatttattgctaaaaaaggaagaaggctatgaagaacactttgttcttctaggaaactggatgatcttcactgaggaaaggctcacattttatcatctgctggaatatggagaatttggtttctgggatttcgtgtaattgttttctgttatatacaatttttatatagttgtcactagtttgcac

SEQ ID NO: 73370 - DNA, 1068 bp, Homo sapiens
tttattattttaaacatttgtgatatttgcattattgagccttttacttgcccatcgcttggccctttatcctcatatctcatttagtctgcactacactgtttgaggaaggggttattactcactctccccttttataatggctcatggtgagattcagagtcaggcctctctgtgttaagtcaggtgtgatctcaccaaatttccccaagaatgggtcaggatccctgagggtccttacttaactctgagaataatctagaaagggcagtgttgctcctctaaggaaagaatgagccttcattaattagattgacttgcccccatcaaaatagcaccacccaacatctgaggcccaacttaggacggttttcatagcgaagactgttgatgccgccattacagacaagatgtcatgactctgatgccaaactgtgccaagctggtggttcatcccgggcttctttctctccaacaggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattatacattttatggctggcattaattgttccacattagtaaaaccaattatcttagaatactgcagtgttatattaattttttattccaaaggaaatgttcttgcctcatctt

SEQ ID NO: 73371 - DNA, 3236 bp, Homo sapiens
gggagaatggcatgaacccaggaggcggagcttgcagtgagccgagatcacacctctgcactctgcactccagcctgggtgacagagcgagactccgtctcaaaaaaaaaatagattagtaaatttatattaaagcactgtgggggagttggttctagtactgtcacaaacttgccatataacttgaaataagtctctttacatatttatgccacagcttccctctgtcaaatggattgtttgggtgtttttttagactgtctgcctcagggatccgggtacctcaagggcttctaagaaggaaaaaattagtgggattctggtcctccaactagaagcagccccgtgttttgtctgttttttagacaaaccactatcttagatgggggagcagtgtgttctgagttccttaggatttctccatgattaaaatgagtgtggttttgattagtatctccttatcaattaaccagttattttgattattttatttttaccaggtttggagaaaattgaagttttacagcaacatgaaaatgaagacatatataaattagcatttgaaatcatagatcagtatttctctggtgatgatgtaagtagatattaaaatagcgtgtatcttcatgtaaatgaaaacctatacatgatgtaaatttactaagagttttccttttattattaggatgacataagtttgtactgtatttctattagacattccatcagtcactttctcttaaatactttgaaacttcattataaggtaaagttgtaaaaacagttcttgtttcatttctaatctattaactaggaagaaatagtaattatataagtgatatatgttcagataggttaaataaatctaggtcccagatacagaaacttaacaatgcagtttcgaaacgtgttaaattttaaattgttaaatttcttaataaaattattgatttactcgaatatttttagttggttaaagcattcacatagaattatttgctaagaggtaaaaagtcaattccacttacatcataatgtatagtatcataacctaataaggatttttttcttgttttttacagattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagtttaaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagt

SEQ ID NO: 73372 - DNA, 1950 bp, Homo sapiens
gaaattcagttgtatagtggctgggcgcggtggctcatgcctgtaatctcagcactttgggaggcctaggcgggtggatcacgaggtcaggagatcgagaccatcctggctaacacggtgaaaccccgtctctactaaaaatagaagaaaattagctgggcgtggtgacaggtgcctgtagtcccagctactcgggagactgaggcaggagaatggcgtgaacccgggaggcggagcttgcagtgagccgagatcacgccactgcactccaacctgggcgacagagcaagactccgtctcaaaaaaaaaaagaaaagaaaaaagaaattcagttgtatatttatttctgtcttttagaggaagctaatgcacagacatgtaagctccatgaataaagatttctgttttgttcatttctataaaatcaccatttcctagaataatgcctagcttatagtaggcctatatattaatgaatggataaatgccaggttattggagcccaaatataattaatggaaatttccttataacttgtttaaaatggaagattttgtatacctaatcactttttaggtgcagtctctttaacgtaattcaggtgattttgttattgtctatataaaatatattagaaagacattaaaggtattatttttcaaataaaggtgccctatattttgttcaattataggaagcagtgtggttcctttccaacataacagcaggcaaccagcaacaagttcaagctgtaatagatgctggattaattcctatgataattcatcagcttgctaaggttggtcatattatgagttcaccgtgtctgttaatctgttaataaccaagactttttggataaagagtccattttatgatctcatttttaaccttcagggggactttggaacacaaaaagaagctgcttgggcaatcagcaacttaacaataagtggcagaaaagatcaggtgagtttgaaaacctgtaactgtcatgattgttaatactggaaagcatgctgctctcttatgtttcgtagttgctgactgtattgtgttctttttggggaaaagataattattattattttaagagatggagtctcactatgttgcccaggctagagtgcagttgctattcacaggcatgaccataacgcactacagcctccaactcctgggctcaagatagcctcctgcctcagccttccatgtagcacgacaccctactgggaaatagataattatataaataaaaatatttcttctcttttgttgtctaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtaagagtggattgatggaagaagagtatttgagcactggaactctgaaacataagttctttaaagtcaacttactagacagaaaattactaggatacgttgtttttaaatgatcacagtatgttgcttttctttattcactatatttgcattccaagaggattttccagaagacagtagtccatactttgcaaaatcaggttgtgaaagtcactgtatagccttctagagattgacaacatagcttttttttttttttttggagacagaatcttgctctgtcgcccaggctggagtgcagtggcacaatctcagctcattgcaacctctgcctcccgagttcaagcaattctcacacctcagcctcccaggtagccgggattacaggcgcacaccaccacacccagtggatttttgtgtttttaatagagacgaggtttcaccatgttggccaggctggtctcgaactcctgacctcaagtgatccacctgcctcagcgtccc

SEQ ID NO: 73373 - DNA, 1711 bp, Homo sapiens
aatcataccataagcacataaacataaaacatggtatgaaagccaacaagaaaaaaggtaagatagagcagtgaccaaagtgctttattatggaagcacagataattttgctagcgaagcagaaagcttcgttgacaaagtaacatttgagacgagcattataaggagacagaagtggggacagagtcaaagattatagtgttcatagttaccatttattgagtttaaaatctgccaggcactgttttaagcacttttgctatgttaacccatttaattcttacaaaattcttgtgagattggtactctcattatctccatcatctacaaacgttgtaaaagaagcagaggtacttaagtaatttgtctcatgtcatataactaggatgaataggattttcacaggttgagagaaagtcatttcaagaacacgggggaagatattaagaactcaagaatacatggaggtttaagagaatacatgtagataataacctaatacgttcgctaaggagttaatttgcagagtctttgattcttttttttttttttttcttttttttccgagatggagtcttgctctgtcacccaggctggagtgcagtggcgcgatctaggctcactgcaacctccgcctcccgagttgaaggaattctcctgcctcagcctctccagtagctgggattacagtgcatgccaccactccctgctaattttttatatgagtttttgattctatattaaagagttttaagtttatcttgtaatgactgcagagtcattgtagattttttaaatcgagaaatgatatttgttttatacagataaaattatctgtaacagacaaataacacaaatatggaaggtttgaagtagggaaagtttgactgtaggtagatgtattttgctatcataataggtttagggaagttgatgaaggcatggactattactaaattgcaataataggaatcgttaagggagaaaaaactttgagtgttaggaaataaagtgagtagaacttggaacttgttgttcctcagtggcggtattttccaaaagcaaaagacaatacagattttggattcgtcagtatttaagggattgatgaaaacctgggcattgaatgagatcacctggaggaggctgtatttcggaaggagggctaaaaatgtaacttaggaattcctggcgtttcaggaatggcagcaagggaagaagaaccaacaaaggagtttttaaaagtagtatgatgatggctgggcacggtggctcatatttgtaatcctagcactttggaaggctgaggacagtggatcacttgaggtcaggagttgagaccagcctggccaacatagcaaaaccccgtctctactaaaaatacaaaaattagctgggcatcatgatgcgtgcctgtaatcccagctacttgggaggctggggcaggagaatcgcttgagtcggggaggtggaggttgcaatgaaccgagatcacgccactgcactcccacgtgggcaacagagcgagatgctgtgttaaaaaaaaataattaaataaaattaaagtgtgatagaagcataaaatgtggaacaaatagtggggaaaaaataaggcagagatttaataggttctagatcatatagtcttgtctaaagaactacataccctttttatgtagtagataaggagccagagaataaatggtcaaat

SEQ ID NO: 73374 - DNA, 1032 bp, Homo sapiens
ccaggctggagtgcagtggcacaatctttgcccactgcagcctccacatccggggttcaagcgattctcatgtctcaggcatgtgccaccatgccaggctaatttttgtatttttagtagaaatgggttttcaccatgttggccagctggtcttgaactcctggcatcaagcagtccacccacctcaccctcccaaagtggtgggattacaagcatgagccaccacacttggccaactgtgtatctttataatggacatctttctctagtacctgctactttttgttgctatgcaaaggtattttgtgtgatttcctacaaccccctgctccctttctcccatattttaaaaagagatctctggggcctgaatttaacaagcaaagctttgtactttgtactggttcgaattttcttgactaaaggtgaagttgaaaactttaatttgacttaagtagcttattaagtaaaatcgtatttttacgttaagcaggtaagtgagacaattacggcagttttaagtgtagcttttcttaaatagctgtaactgtatatttgcatctccattttttccacttgacattttatgccataaagaaggttattaaaaacaaatgtttttattttaaggtacattaacttctgccagatttatttggatattttaacttgttaattgaacatatttcagtttaacatttgagatatgtttttggtttttttagattgaatttatcaggttttcattttcctaaaagatattcagacaaatttaacattgtctttctcgccctacaaaccatatttaccgctttttatgtcaaagttgttcatttttacagacatattaattaactaatgttaagtattgtttattttctttcctcagattttgccagctttatgtgtcctcatataccatacagatataaacgtaagttaagaagcagcttaaatgtgggattttgctcttgatgggacagaaagggtttttatgtaagtgtcagcatacattttatcaacttgtcaagt

SEQ ID NO: 73375 - DNA, 2624 bp, Homo sapiens
caaaaacaaaggctgggtgcagtggctcaagcctgtaatcccagcactttgggaggccgaggcgggtggatcacgaggtcaggagatcaagaccatccttgctaacatggtgaaaccctgtctctactaaaaatacaaaaacaaaattagccgggcatggtggcgggcgcctgtagtcccagctgcttgggaggctgaggcgggagaatggcgtgaacccgggaggcggagcttgcagtgagccgagatcgtgccgctgcactccagcctgggtgacaaagcgagactccacctcaaaaaaaaaaaaaaagttatcatgtgacccagcagttctactcctaggtgaaaccaagagatatgaaaacatattcatacaaacacttgtacataaatattcacagcaatgttattcataactaacccaaatgttcattaaccgaggagtggataaagtgaatgtggtgtatacaatggaatacaattcagcagtaaaaaagaatgaagtaccaatacctgttaccacatggatgaacctgaagaatgttaagtgaagtcagaccccccaaaaaacacagtatgatttcatttgtatgaaatgtccagaataggcaaatctgtaaagacagaaagcagatatttaatggttgcctgccgcttggggaatgtgtggcagaggaacaaatgtggaatgactgccttaagtatgagatttcttttttcttttttcttttcttttttttttttttttaagacggagtctcgctctgtcgccaggctggagtgcagtggcgtgatctcagctcactgcaacttccgtctcctgggttcaagcaattctcctgcctcaccctcccaagtagctgggactacaggcacacaccaccatgtccagctaatttttgtatttttagtagagacggggtttcactatgttggccaggatggtctcaacctcttgacctcgtgatctgcccgcctcgcttcccaaagtgctgagattataggtgtgagccactgtgcccggctgagtatgatattttttttttttgagacagagtcttgctctgtcacccaggctggagtgcagtggcacgatcttggctcactgcaacctccgtctccctggttcaagcagttctctgcctcagcctccaaagtagctgggattacaggcgcccaccaccacgcccggctaatttttatatttttagtagagacagggtttcaccatcttggccaggctggtcttgaactcctgacctggtgatccatctgcctcggcctcccagagtgttaggattacaggcatgagccatcatacccagccaagatttcttttgaggtcctggaaatgttataaaattagattgtggcgatgtcctcacaactctgtataaatatgaaatgtcattgaattacacacttaaatgtaaatttattgtaattatatctccgtaaagttgttaaaactgaattaatttaaattttaagtaaataatacaagtaatacacagatacagcaaaaaaaaaaaaatgaggtagtgcacagttgattgaaatttttaaaaagtgatctagcttatgctggaaatgggtataatgtatacattctgtaaagagtaaggattatgagaaattattttaaagtataagatagacctgatatgagattaatcagttctttggttaatccccgtatcaggaattgagattttgtagactaaagcattacattttaaggttacatgtttggggtaggaactcttttttttttttttttttttttaatggattataggaaggatttcatgctgttgctttcttttagttaatggtatgatagcaacctttagatactgccagttggttacggtacttgactattactaggggaaaatactgaaattgattctttttagggtaaagatatttgccacatttgttcttccagctacaatatgccaggctgtgtatttgatcaatttctttgatctgaaatctgtaaactcttcaacatgttgctagtataaatattagtttttctttattacagatgcagtacctctttttctgagacttcttcgttcaccacatcagaatgtttgtgaacaagcagtatgggctttgggaaacattataggtaagtggtttgaaaggaatcctcttaagaatctaaattaacttttttcctacattggcatagccattacatactatgtttcctctgaatttaatgtgtgttgactctcttcttgcctcataagtactgacttaagatgatgctctttgaaaaggatatacagtttgctgttagcattggtaggttaaatttacgttccccagatcaaaatctggagaaacaacacttgatgcctttgactaatggtgaggaaacatagaacgtcagtgttcccacatgagccattgcatacatttcagactttctcatcctgaatgtaagttttttttaaatataattttcatttctgtaggtgatggtcctcaatgtagagattatgtcatatcactgggagttgtcaaacctcttctgtccttcatcagtccctccatccccatcaccttccttcggaacgtcacatgggtcattgtcaatctctgcagga

SEQ ID NO: 73376 - DNA, 1047 bp, Homo sapiens
agattttttaagtagagatggctgctgggtgcagtggctcatgcctataatcccagcactttgggaagccgaggtgggcagatcacctgaagtcaggggttcaggaccagcctggccaacatagtgaaaccctatctctactaaaagtacaaaaatgagccaggtgtggtgatgtgcacctgtaatcccagctacttgggaggtggagacgagaatcacttgaaccccagaggcagagattgcaatgagtcaagatggcgccactgcactcccgcctgggtgatggagggagactccatctcaaaaaaaaaaaaaaagtagggttggctagcaggcaattggattataacaaggtgaaattcaaggacaaggcaaagaatagccatatcttatcagtcttaagattcattaatttaagtggtagttatgtgtctaaaaagatgtgttattgtttttttacagtccttcattacagtttgaagctgcttgggcattaactaacatagcatcaggaacttctgcacagactcaagctgttgtgcagtctagtaagtaaattccttactgtctgaactttttgtgttttaatgatggcaaggaagtagagttttgtaataaagaaattttatcttgtaacattttttaaatgatgacttttataagttacttttgatgaccgatatctttttcatagccgtcattaatttatcatgaaaaatttttaattgtggttattaaaagaagagtagagttttatcttttggagtagacatcatgctgtgataacaggattttaaattccgtttctgatatcttcaagatgctgaatggcttctgccttttagcttatgacatattttaaattttactttcctcaagatgggctaataattattgttaaatgacactgacacaagctctttagaaaagtactagatatcaccacgtacgttattatagtatgggacacttagctaattttaggtgtggtaatcaaggtgattttaagtagcatgtgatatggcagtaagttacattgaatcatgt

SEQ ID NO: 73377 - DNA, 1046 bp, Homo sapiens
aagcactctacacaatgtcaaacttatgataaatgtccatttattttttatttttatttatttatttttttgagaccgagtctcgctctgttgcccaggctggagtgcagtggcacaatcttggctcactgcaagctccgcttcctgggttcacgccattctcctgcctcagcctcccgagtagctggggctacaggcgcctgccaccacgcccagctaatttttttatttctagtagagatggggtttcaccattcacaggatggtctcgatctcctgaccttgtgatccacccacctcggcctctcaaagtgctgggattacaggcgtgagccaccgcactcggccataaatgtccatttgttattgcactcgttttttctatatcttttctcatttttttttatttttccacatgacatcttgaaagactttctttggctttataattttattttttacatttatccattttctcatttaagtcccccattcccagtattttgccaaaccacctaaccagcttaataactttctccttccagtctgaggcaacatatactgtcttactgtttttgatcttactgttttttttacttcttccctgcctctgatataccatcttatttcctgccttctgctagaattcatcatatacaggggaaattttaaaagtttgtggaaaagtggaatcaaaagacaataaaatatatgaaagataataaatatataaacttgatttctcaacataagctccatcaaggtcaagacacttttgtaagtgatactaccagccattgtctatccctaaagaactgagggtcctgggaatttaaccatgtcagcgcagtctttttcatgatattaactgaagaaaactagatgccctttacaggttgtttttttaagattaggaaacaaaaagaagtcacaagatggccaaatcagaactgtaaggtggatacctaatgatttcctattgattctcttgcaaaattgctcttgtttgatgagcagaatgaacagaaacattgtggtggagaaag

SEQ ID NO: 73378 - DNA, 2152 bp, Homo sapiens
gaggccgcggcaagcggatcacttgaggccaggagtttgagatcagcctggccaacacggcaaaaacacatctctactaaaaatataaaaattagccaggtgtggtggcgcacgactgtaatcccagctactcaggagtttgaggcacgagaatcacctgaacccaggaagcagaggttggaagtgagctgagattgtgccactgcactccagactgggtgacagagcaagactcttgtctccaaaaaaaaaaaaaaaaaaaaacaccacagtgggtgcttaatgaagtgtgtgtgtgtaaaagccagccaggaaattttgttaccgaagccagaatgtgacccttgtcattggtttgcagtatgcacatttaattcatattatccttatgtgttcagtatttgtttcataattgcctaataaagttgaagtagttttaatggatttttcattaacagtagtccttatgacttcttaagcatttattggttgcctttcagaacaaaagagatgaacacttattgaaaaagagaaatgttccccaagaagaaagtctagaagattcagatgttgatgctgattttaaagcagtaagttaccatgttttaatagtgattttaaaataatttttatagtaactgtgagaacttcatttttaatataagaccaactttataatgataatgaaagtatattaactcaggtacactgtttaatgaatgtaattttgttaataaactctgctgaactattttttttttctttttaagcaaaatgtaaccctagaagctatattgcaggtatgttactaaattaatactctcgttttgaagtattttgaaattgattttttttttttcatttctgaaatttacatttggtattgcagaatgccacaagtgataacccagtggtccaattgagtgctgtccaggcagcaaggtaaatactaatttgtctagagagagaattatgtcattcctcagttgtgttacctggtagtctagaagttaatatgttgttatttcttttcacagtttgaaaattatagcaattaatttctcatatttattttcctagaaaactgttatccagtgacagaaatccaccgattgatgacttaataaaatctgggattttaccaattctagtcaaatgtctagaaagggatgataagtaagtatggattttactccctattcagtttttttcagttaacttaaaagtttggattattacttaaccagtgagttcagtttggttttgtacttatgatgtttttcaatcgtcatatattttaatttaattttcttattctgtgatcatatttagcagacccagagtgcttctcgttttcatttctgaaggatgtgtatgttttctaggaaatttttatctcctgtttattgcctgttttaacttatctcaaatatttatagtctttattaggattttttattactaatattttaaaacaacccaaataatgtttgagtcactctttgcttatgagcctatatatagattaacctcatgactaagtcaacatggatggtttccagaactaagtggctctttcttaccctgggaatcttccagctgattactgatcctctgtgttgtctttaacagaacttcatccatgataagttgtccaatgtcagactttttgtttgctgcaaattaagaataaggggacaggttatatttacccaggagagaaggagtaaaactccactggatatcttttgaggaactggccctatttccatttttgtttagtgatatctcagtgctgtgccttaaactttgttaatttggattaactggggagaatataagtttgaactccaaaacatattaaaacaaatgctttttttttgcatttaagagcatctagactgaaacttgggatattttgctaaatgttgtccaaggaattttcagttggctagataagaatagtggtatataaatgttgccactaagggtttttagtatttaaaaataccatttgctttcgttgtgtgccacaacctctcccactttccacccccaggcctgtaacactttttaaaatactatcatgtttgttttctgtaacagtgttacttaagtaaaggtaagttttattttagctgttgaaaaaata

SEQ ID NO: 73379 - DNA, 1056 bp, Homo sapiens
aggctgatctcgaactcctggccccaagtgatcctccagccttctaaagtgctgggattacaggtgtgagccactgcacccagccaatattaaatgacttctaactcaaatacctgagtttttttttttcttcttcttcttttttttgagatgcagtctcgctctgtcgcccaggcctggagtgcactggcgccacctcggcttgctgcatccccccgcctcccgggttcaagcagttctcctgcctcagtctcccatgtagctgagattacaggtgcctgccaccaagcccggctaattttttttgtatttttagtagagactaggtttcgccatgttggccaagctggttttgaactcctgacctcaagtgatctgcccgcctcggcctcccaaagtgctaggattataggcatgagccactgcacccagctgagatctttatatactagcagtgtccgtattttgatacatctgtaatctttgtttttcttttctagacaatgcgaagacatagaaatgaagtgacagtggaactgcggaaggtaaggttgatttacatttaaagaaaagtaattagatttttctgatgttaaaattctgtgtatcttgaataatgaaaatactgtggcaaattagtggtcatccctaaaaccacacatcactggatactttatcatggtacttattcataatagctttcatttactgagggtactaggccctgtgtgaagcactttaccatcactgaaattctcataacatctgatgaagttagatacattttctttgacatcctctttctgtgggcttcctctccctttgcttatgtaaaagttacacatccttgttaaagatactttacagaagtaaataaaagtagaaaagtagaaaaaccttgtgttttcccaactgaaagcaactgctattaaaatttattgtattttcttccattatttttggaggattttagagttaccttcatcagattgtgttttcttttttctctttctttttttgagacagcgtttcactctgtccaggttggagtgaagt

SEQ ID NO: 73380 - DNA, 1630 bp, Homo sapiens
gaggctaaatgtttcaaattttggatggtctcactagcacaggaagagaacaggttcataatccaaaattataaaacacaggaagaaatatatcacagataatacagacaccaaaaacgtcagtcttatgtctcctaagaaattcagcaatagaggtaatcagagaaagactgtaaaataaatatttttaagatgattgaatcattttaagaaggacctaaaaacattaagaagtactacaaaaataaacttgctagaaatgaaaaataaatcattgatgttaaaacctcaatggacaggaaaagtaatggcatttaatattggaaatggagattacaacctgtagacagaaaagggaaacaaacattgatgactgcctgcttcgtgacacgagctgcttttattaatgtttattttatttaattcttggaactactttttgaggtagttgaatatcccacttttagagagtgctgttatctacagataaggtgaaaacagtaaattaagtaagaccagtgaggaaaatgatgaactcagttttgaatgtcttaaggaacatgtggggttttctagggagtgatccaggagatactttagttcaggagagagatccgggcttaaaattttaagctgcttaaattcccaaggttatgggacttgcagaacacaccaaaatctgtttacttagaaatacagcagtttacttaaaggatgctagctaaagggagctataattggaggggtgattgacgtctgacatctgacattttatgtcagcattttcaaatctatagagacaaaaagtagataaatggttttgtaagactgagatggggagcttggtagaatggtaagtgtctgctaaaggataaaaggtttctttatgtagtgatgaaaatataggccaggcgcggtggctcatgcctgtaacccagcactttgggaggcatagatgggaggatcacttgagcccaggagtttgagaccagcttgggcaatatagtgagacctcctctcagaaaatatgataaaattgattgtgttaatagttttataactcagtgaaatacactaaaaaccattgaattgtatgtatactttaggtgaattgttggtaagtgaattatatctcaaagctgttatgacaaaaaaggtaatggttccacattgctgtattgattaatcataacctagaatatatacaggtgagcaaaataataaatagtacgttttagatgccagatacaaatatttttctgtatttaaagattaactagattttcccttacatgtattctatttataacattgaaaagttacatattactgcccaattcagaattcatcaggaaacaaatctggattatccagagttattaatacttaattgataattgaagccatggagatatatatgataacctagaaagggtttgtagagtaactagatgaataggcaaaaccttgggaagagcaacatggatggatgaaggaggaagaccaaagaggaggaaaaccaggaatgtggtgttatggaagtcaaggagatgagaatgaatgaagtgttctcccgcaaaggtaccatgtaattaaggattgtgttccatgaatagaaggttgctgataa

SEQ ID NO: 73381 - DNA, 1006 bp, Homo sapiens
aagcgattttcctgcctcaccctcctgagtagctgggattacaggcacctgccaccacgcccggctaattttttgtatttttagtagagacggggtttcattatgttgggcaggctgatctcaaactccagaccttgtgatatgcctgctttggcctcccaaagtgctgggattgtgtagcagcattttaaatacaaagacacagtttgaaagtagaaagatgaaaaaatataatagtgatatgtacattttggactatgtaaggtaggtttgttgttggtactcacattgtaacttagtaataaagcacaagttttaatgaatgctttatataggtatactttactttgtacagtaaacaagtcatattttgtagatgttcagtaaggacttgttatggaaggtactttcactgtactgtcccagagatagattgtgatatcctcgtttcctaagtggggactctggggttcagagaggttaagtaataggttcaggatcacatagctagttagtgacagagccactcttatggtctttccattgtgtagctcttgtggctttaatacctaagaaggtacataggaatagatttttttgcaatttgagtcacattttttaaagcagctttaaactgtacacaatttgatactctttcacacacgtacatacactgatgaaaccatcaccacaatcaagataatgaaaatataatttgtaatagttctttttattctaatttaattgatattattctttttttcttcttttttttttttttattgagacagagtcttggctctgtcgccaggctggagtgcagtggcgtgatctcggctcactgcaacctccacctcctgggttcaagcaattctgcctcagcctcctgagtagctgcgactacaggcgcctgccaccacgcctggctagtttttgtgtttttagtagagacggggtttcaccatgttggccaggctggtctcgaactcctgacctcaagtgatcc

SEQ ID NO: 73382 - DNA, 1137 bp, Homo sapiens
gatgagaatgttctaaaattaggtagtggtgatggttatacaactctgtactagaaaccacggaacttatccttttaggataaattttatggcgtgggcattatatctgaataaagctgctactaaaataaaaaggaaaaatacacctaatagtagcataaattacctagttaagtcattttcagaatggagtttatgtagtaaaagtaacgtggcattctggcttctagtaatggtgcaatactgtagagttaccttcctatagataacaatgataatatctggacaaaatacattaatttttctttaaaggtactggagagtgatcaaaagcagacaaactggaggagagcctattcttaaaacataactatcttgtgaaattcatgagttggtgggtttttgtctgagggtgctctgtaatcctcctgctacttggtgaagaataccacaaccttatttgcatgaaatgtaaggatacagagttctgggctaacagaacagcaagaaacttagtgggtaaatcctggaagagaggcagctacaaagaaagtgagtccaaaaaaattcgcatataagatctgtccaaattcttggcagtttttaaatactatgcatgcagtggtggcatgtgtagtacatgtatgtgtggcacacaagttgggttcttgacatttagtaggtagaacattaactctgaatagattgttttaagttaaagtcacagttgtgatccctagtgagaaatctcaaaattaaaagatgaacctaaatgccaggagaggaatatctaatggaatgctaaaaaaaaaaaaaaaaaaaaaaaaaaaaattgattaacccaaatgaagacaggccggcaggaagagaaataaaaaacaaacgagatgatcaaaaacaaaaataccataatgaaatgcctgatttcaacaatatcagtcattatgatacatttaaattgactaaagcatcccgattaaaaggcagagattgtcagactggattaagaagcaagacccaactgcatactgtccattttaaatacattttgcactatgtagtgcattttggctacagtgcatattggcttctatgtagcagctttttttttttttttttttgagacagagtctcgca

SEQ ID NO: 73383 - DNA, 1119 bp, Homo sapiens
ggcaatggagtgagactccatcttaaaaaaaaaaaaaaaaaaagaaatatttttcaatattcaggtgtggagtaatttgaaatttgggtaggacagacaagagccagattgtgaaaaaccttttcgctggggaacattttaaacagtgaaatagatttgtgcatttagaagcattgctttggttataccataggggatggattggtgaagatgagaagagagtttgggagtaacagaaaaccctcaaggtctcagatggggagtttgggagtaacagaaaaccctcaaggtctcagatgggtggcctgactatagtgttggcactgagattgaaaagcagaaaaagttattaggactaatcttttggcatattttaccttatagaatagaggttggcaagttttttgtaaagagccataatattttttaaaagcctaaatattagggctttgagggccattctgcttgtattgcagctattcacctgtgtcttgagcgcaaaagcagccatagactgtaggcaaacaaatgagtgtggttgtattctaataaagctttatttatgaaatcagttgggggtctagattttgctcacaggcccttctaggctagcgtatccagtggtgaagattaatagctcaagcaatggctagagtaagatgataatataggtgagggattgtagggataagaaggaaagaggagcaggggaggaaagaaccctgaggaaccaaatcatattaggagaagaggtgaaaatggtactgagggagtctgtaggaagcttagcaggaaaatggtgtataagaacttagggaggagagtttcctgaaggaggggcagtaattgcagtatcaaatgctacagagaggagaggcatgatgagaccttacaataagccattcattgtatttgctctttgggggccagtgagaagggaaaactgagggtggtggaggctggaagctagatcatgatgagctaaggagtgagttggagttgagctatttagactagttagagctttgatttaaatatttggtagtcatgggaaggaggaatcacaggttagcttgaggaagacgtagggtggaaagaaggctgttcgtttgtttttta

SEQ ID NO: 73384 - DNA, 1097 bp, Homo sapiens
ggattcgtagggctgactgtactgtgccattttatagaagagatttgagcatctgcagattttagtatcttcgggggagggagcatctggagccaacccccccgaggatacagagggaggactgtattctcattttcaagtggaggtgaaggaatattaaaagtataaggaggatgtagctatcctttcttgcagttttgctgttaagaaaaattttcttacagcatagccaacatcagcagttaaaatatggtaaaataaatcatgactatatttacttggaattaatcattcttggttttctgggttagggaggttgtatacatactagattttactttattttgacacttgccttaaatagaatataatttagttgttttcttggttcttgagaatcaccattatgcatatggatattgggttttgcttttacataagtgatgccttcaggttgttaaattaacagaattttcttcttgatttttacgcttgtggagtttttgctcttcttaatttttttggcttgtccttcccttgcttttggtctatcagctttcttttgatactgtcagcatatttacttgtggtagcccctatgtttctttttatttgatgctttacatattctagtgacttgggaaacagatttattaaacatttatttagctttttttttttctttgagacagggtcttgctctgtcacccaggctggagtacagtggcacaatcacggctcactgcatccttaacttcccaggctcgagtgatcctctcaagtagctggacaggtgcacgccaccacgcccagctaatttttttattttttgtagagacagggtttcgccgtgttgtccaagctggtctcaaactcttaggctcaagtgattcacctacctcagcctcccaaagtgctgggattacaggcatgagccaccgcgcgcagcctatttagtattttctacatgctatgtagacatcattaggtgccaaagattataaatatgaaaatattccctgatctaaggaagttcagtttagtgggagagactgatacttaagcatatggctagtgtacagtgtggtaagttctat

SEQ ID NO: 73385 - DNA, 1006 bp, Homo sapiens
gtttatgagatttttcagtgagcctgatgcctgattatttctccagattcagccttcctcccccacccccttaagccctagcaacactgaacttcttatatgcttatacataatctggaatcccgcctgcccctcctcgccagtgctatttctattctcagggccatcttgctgactggaatatccttctctgcctcctgttgcctggctaattcctaccacttttaaatactcaactctgggtaggtaccattctttgctcctggaagaagtctgagtgtatctttctcgttgcaattatgataatgtattttaattagattttatttttcctactagattgtgagctttttgagggcacagactatgtatcttcattgcctaccacttagtacagtggctagaaccaagcaagcactaaaatattccttgaataaatacatcgtaggcaccgcagacacaataatttttcccatgtgtatttttgaactgaaatgtttactcttttagtgccttttcctactgcttcccaaatcaactccaagctttttattatgacaggtaaagttctgggagattaaggtatatacatagtgaatgaattagtgattaaggctaatttgtatggctaagtaacattctattgtatgtatataccacattttgtttacccattcatctatagatgaatacttggattgtttccaactttagtctgttgtctcccaaccatttaaaaatgccactaatttgttcgggtcagttttcttttattaaattgcactatatgaaattgcttttttccaggtttgtaacaacagccaagtattggcaatttcatatttagcctaatagactgtcctaattactgggtttgtctgtttccttctggtggtgcttaactggttcctcttatttgtttttttaccacccttcagattttttgtaatctggaagtttttttaaaaaaaaatttttaaacattatttttgagacagaatcttgc

SEQ ID NO: 73386 - DNA, 2249 bp, Homo sapiens
ggatgaatgggagtgagctgattgtgaaggatgaaagaaaggtggccaggcaaagggcgggagaaggctggtggaagaaaggggcattccagactagagggagcagtaattgaagagtcctgagagaaatgtaggagagagagagactaaagggtaaactggggtcaaatctgatgaagggcctttattggggatttaggcatatctaagagtagataaccatgcttagtcttgtccattagaaacagtacaacttagctctgtaactgagtagttgtggttatcaggctgttccaaaacagtgagatgcactttgataagctatgatgcctattttttcacatataggatagacaaaaactaaaacatgttataaattatagaagcagctgatacacaagatgttaggtgcaagaataagatccatacttgttaaagaaaataaaaggatagagttatgccaggggatttgagtagagagagggttgaggaagaaaatttctttgtcattcaatcgagagagactttaagagatctttggagaggaaaaaaaaaatgaggttagtgaatcttataggaaatatgtaccaaacttaaaaggggcatgttaactggtgaataaatatccaggtaaaaaagaagagtgattatattaaagagaggagacttccaggtggcctgtgttgatgcaagaatatcttgtggcaaagagttgcttggaagctttttcttaatagggagatgtgaaggaatttattccagagcaaagaggagatgtaacatgattagagcaatggaaagggtgacagggcagtaatacctagaattcattttggagaaatagcgctgttgtctgatctgcaaagaagagttttccaaaaaattgagactgggaatggctacaacctggaatgaggatttgatgatgctgttcttcctccctcttcctcctccttcaaattctctttataaagatcactgaagagaaagggagtaaaggttattctgaggtttataaatggaggaagggagggagtaattatcatcactgatagaaatttggagcttgggtaggggatgcattttgtagcaaaaactaggaagtacatattgaaagggaaacatttccttttatttgttctggaatgtgctttttttttttaaaaaaaaaaaaaaaaaaaaagagggtctggctctgtcgccaagggtggagtgcagtggcccaatctcggctcactataaccttcgcctcctcccaggctcaagccgtccttccatctcagcctcttgagtagctgggactacaggcacatgccaccacacctggctaatttttgtgttttttgtagagacggggttttgccatgttgcccaggctggtttcaaactgctagctcaagttatcctcctgccttggcctctaaaagtgttgggattaggggcatgagtcaccatgcccggtcctggaatgtgcattttaatgctagaccttttcatgtaaggcattgattcttaaaaacttttcctgttttcaaagataacttatagaaaagtgtgcaaaacagaaatgttctgtttaatgaataattacaaaacaaatgctcaggtaactgcaatccaggtcaactcattttcttgctgctgtatacctcaagggtgtgacattttcattagtaacagtaattaattattttaaaaaccttaacatttattgtttacagtatatcagtgctaagtactttatatagattatctatttaatcttcacaacagtcctatatcaagtaagtactattattatccccatttactgctgaggcaacttgaggcctacaacccttaagtaagtggccttaagtcttccatcgggtgttaagtggcaaagcctggacttacaatatatcaaagctttatgctaagcggctgggcgcaatggctaacgcctgtaatcccagcactttgggaggccgaggcaggtggatcacccgaggtcaggagttcgagaccagcctggccaacatggtgaaaccccgtctctactaaaaatacaaaaattagccgggcatggtggcgcgtgcctgtagtcccagctacacgggaggctgaggcaggagaatggcgtgaacccgggaggcggagcttgcagtgagtcaagatcgcaccactgcactccagcctgggcgacagagcgaaactccgtctcaaaaaaaaaaaaaaaatacaaaaattagccggtcctggtggctcat

SEQ ID NO: 73387 - DNA, 1054 bp, Homo sapiens
gttttactaaaataaattggatacacaggttcataattctcttacatacctcttgctccaagctagtagaatttccaagtggttgcaaaactaaacattcatcgcggtcactcagttagttgctactcagcatgttgccattgtctcattaaggtgacattagcaggtactatttgcaaactcggcttattgaggcagcgctagaggtctctctgcagctactgaaaacagtaagtataatgcacaaacttcactgggaccgtgacctttggatttgttagggggaaaatggttttaaggccgcagccttctttgctaatactaggcgacatgatttgcagttttgtaatttttgataagctagtgtgattaagaggtgtgttttatcctgtcttaaggaaggttgtggggtaaatataccattcagtgttctattttgtagagaaacagacaaactcaggccgtttttcagagctacaaaattaaatactagtaggaaagaacctagggagatatccgtggaattcccatttaaatgagtcaaataaagatcatatattctttcctggtcatggttaaataccctttgtaagaaatacatctaagcgaaagtaaaacttgggaataggaacaagaaattttggaactgcctcctgttattggtccacttgatgacaagtgttaattttgaacttttcccattaggaatttttcttgaagcctatcctgttccaaataaaaatttattgaaaaatactcattgtttgtacagaaaaaccagtaacattcttctctcggatattggtacaggtttttgtttcattgtttacctctattgtgttctggtagctcagtgatacttagtaaggactcctgcacataataggtacacaacaaatatttgctgataagaatgtaacccgtgacttttagatgcatgaaaaagagcatggttgctaagccattcagcctggtattggtcacaacattacatttctcgggattctatagtgtaactaaaacatgaaatagacattcaaatggtagttctaat

SEQ ID NO: 73388 - DNA, 1097 bp, Homo sapiens
ctcactaggcgtggagaattactccaggcggatcgtggcatgatgggaactgtagttgacgaccgccgccccgcgcctgaggggcagtaaaagtcgccaggtccggctccatttctggcacaaaacttgcagcaccgaggggttgtggagagcccttgcaggggaagagggcagggtcatcccgagaaccaacgggcacgtatagcccggcgaacgcccaagccggtcaccgcccccggtcacgtgtcgccagcctccgcggccgcgcgccgctctcagcaccgttcccgccccacccggcccggcagtcggcccgcgcctcccccggcgctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaagtgagtgtgcttccgcggtctgggcccgcctggccgcgccggcccggcgacgcggggaggggcggggggccggcgccgggctggttctcgtcggcttgtggtcggccggagttggccgccgcctcccgtcaccgcggccccgggctgggcggagcgggcggcgagacgccggccgggctgcagtcaccccccggagctgccggcgcggcgaccgggaaatgccggcgttttcggccccgtcacgcgggcgcggcctggtgtcggcgaggaggggatgtggagctgaggcggggtccgcgggccagggccgcccggatgaacggggatgctgccgcccgggccctccgaccgcacagccgagggggcggccgctgcttgcgcccgccaccggtgcaaccttccgtccggtgcagccccctctgcgcctcccgcgcggctcacatggagcctcggctctgccggtccgggctcctaccttctgcgagccgggcccaggcgggcggtggcggcccgcagaggggggtggggaccagccgggtaactgac

SEQ ID NO: 73389 - DNA, 1815 bp, Homo sapiens
aattctgtagagaaagagcagcgttttctgtatgagtgtaaaaggtttctctattcatggtatgtagtacttatattatcttagcattcaaaatataaaatccagattatacaaatataattctaggatttaaactgttggctttgttttacctctaatgtggactcttgggatgttacctgactttatcccccctcataatcactactcatttttttagctcagttcaagtaggattctaccaaattgtcaacccttaatgaaaattgttgtcagcctatgcttagctttttgtgtttccatacttcccagtcaatgctttctgacggctcagcttttatggaacgtttctgttttttccttcctagggtattacttatgaccatgtcgaattaaatgtatacttgaatggaaaaaacatgcattgtccagcatcaggtatacgagggacagtgtatccagttgtttatggtaagcaaaaatatttctaatgtattattacatacatattaacttgtttggtgtgtgtatcagtctgttttcatgctgctataaagacatacccaagacttggtaatttataaaggaaagaggtttaattgactcacagttccacagagctggggaggcctcaggaaacttacaatcatggcggaaggggaagcaaacacatccttcttcacatggcaataggaaggagaagattgagcgaagttggggaaagccccttatgaaaccatcagatcttgtgaaaactcactcacttttacaagaacagcatgagtgtaaccacccccatgattcaattacctcccactgggtccctccacaacacatggggataatgggaactataattcaagacgagatttgggtggggacacagccaaaccatatcagcgtgtatgttacttttatagctatcatctagaaatctggacacattgttaataaggacctttttattttatttatttatttattgtttgaaacggagtgtcactctgtcacccaggctggagtgcagtgacacgatctcagctcactgcagcctccgcctcctgggttcaagcgattctcctgcctcagcctcccgagtaactgggattacaggtgcctgccaccacgcctggctactttttgtatttttagtagagatggggtttcaccatgttggccaggctggtcttaaactcctgacctcagatgatccacccacctcaacctcccaaagtgctgggattacaggtataagtcaccgtgcccagccataaggacctttttatatggattgtagtcggtaggatattacaatcccactttgcaggattaaggatagtttctgttccccatgtattaaaataaacttgctaaatacaatgattacacttaaatatgcaataaccgtactccctttttcaacatgtagttttatgttttagaaagtttcaaaaagctttactgaatttagaaaactttttctgcaagtcattgggaatgattgcatggccaggaaacataattataaataatattttggaattagagatgggaattttatgtagactgtacattaataacccttacaaaattccttaaatgttaatgctcttctgagggaaatagtgacttagaattttaattttaactttaattttttgtttttttgttttgttttgttttgttttgttttgttttgcgacagagtcttgctgtgtcccccaggctggagtgcagtggcccgatcacagctcactgcagcctcaaactcctgggttcaagcaatcctcccacctcagccaccccagtagctgg

SEQ ID NO: 73390 - DNA, 1454 bp, Homo sapiens
atttggagctttttgtttgtttgtttgtttcggttttgggttttgttttggttttttgttttgttttgtgacagggtcttgctgtattgggagtgcagtggcacaatcatggctcactacagcctcgatctcctgggctcaagtgattttccccacccagcctcctgagtagttgggactacaggcatgcaccacccacacccggctaatttttagaattttttgttagtgatatggtctcactttgtcgcccaggcatgtctgcttctgggttcaagcagtcctcccgcctcagtctcccaaggtgctgagattacggcatgaggcaccatgcctggcctgaatttggagctttaagaatgggtaacttgttctttctagaaagttctacataggtataacttcaggaagaaattgtaatgcttttaaaatactccctatattctattcattaagaaaccaaatccctttgatgtttctttattttcaatgataccagatggtcttggtgtctgtatactcaagttggagaatttaattaagagtttataggtaagggttcagcaaatttcaaagctagcatgcaaattatttattttggctaaactgttatttgctgataaacatttgttcccccagaccattgttaattggcagtcttggtatgtagctcatatcaggccacatgtagagtatgtagatgaatgtgaaccaactagagtgaactcagagaatggaaaccatatgaggtgtttgaatgtcatgaggagtggctagaggtactgagaagcctgcttgaaaaagaaaaaaaataataatcttgagacttgtttattctttattgcacaagaggacaaaactgggcaaatcaagtttcagggaggcaaatataaactccaaagcaagggttttctactagtagtggatgtgtacattatagaaatgactgccttacaggaccttaaaatgggtaaaatgggaaaaacactcttaatcaagataataaggcattttttgaagtgaagcaaatcaccatatcagcttgaacaaatcctagctttaaaaatgtaaggcagagccacgcacggtggctcaaacgcctgtaatatcagcattttgggaggccgaggggcggatcaggaggtcaggagtttgagaccagcctgaccaacatagtgaaactcagtctctactaaaaatacaaaaaattagccgggtgtggtggctcacgcctataatcccaggtaatcaggaggctgagacaggagaatagcttgaacccaggaggcggaggttgcagtgagcagagatcgcgccactgcactccagcctgggtgacagagcgagactgtctcaaatatatatatgcaatgaaaatactaggagtagagacataatttttaaatatctttagagatatttaaagcttttgtaagttagcgcttgtcttaaga

SEQ ID NO: 73391 - DNA, 1175 bp, Homo sapiens
acactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatcccagcccccttgaagcttattaatcttgggggtagaggagtgagtgatggaatgaatggacaaaaaagctggtaggtactatatttggtatgtcagagagtgacaagttctgtggagaaaataaagcagggaaagtgagaatgatgtgataaaggtgtttgtaaggcagaagagagatatttttaaatagtatggtcaggaactaccctacagagaggacatttgaacaaagacctagaaacaataagggagcaaaccatgtaggtacctgggagaagacccttctgagcagatgaaatagcaaatacaaagaccctgaggctgaagcattttttgtgtgtacatggaacagcaaagaggcacatgtagctgtgatcaaatataaacaggaagaatagtagcttataggatcagagagttgataggggccatatcttgtagctgtttaagctacaagatatctgagctacagattcagtttttcatactttgttttgagtgagtgtcgctctgttgcccgtgctagagtgcaatggcatgattctcggctcactgcaacctccgcctcctgggtccaagcaattctcctgcttcaccctcccgagtagctgggattgcaggcacccaccaccatgtccagctaatttttttgtatttttagtagagatggggtttcgccatattggccaggctggtctctagaactcctgacctcgtgattcgcccacctcggcctcccaaagtgctggaattacatgtgtgagccaccaagcccggcccagtttttcatacttctttaagatagtttt

SEQ ID NO: 73392 - DNA, 1148 bp, Homo sapiens
gggtctcactatgctgcccaggctggtttcaaactcctgggctcaagcagtcttgccttagccttccactgtgctgggattataggcatgagccaccacccctggcctaatttaattaaaatctgaacaaaaggccgggcacggtggtggcttatgcctgtaatctcaggccaaggcaggtggatcatgtgaggtcaggagttcgagaccagcctgggcaatgtggtgaaaccctgtctctactaaaaataaaaaattagccaggtgtggtggcgggcgtctgtaatcccagctacttgggaggctggggcaggagaatcacttgaacccgggagaatcacttgaattccagtctgggcaacagagcgagactccatcttaacggcaacaacaacaaaaatctgaacagaaatgctctatttacgttcttttccttatctgtagtgttttaaagtcattaaacttaaaaatgatgttcaggagaagatgagtgtatttgcatagtctgtcataactctggtattattttgtacaaggagtgtgttagggttttcagttgtaaccatgcagaaaatctacaaaataaaagcagttgttaattagtcctttacaatcagaattgtctattttggaaatttatgaagtacttcagatgtaatttaagaaattgtatttgagccaagcgtggtggctcacacctgttatcccagcactttaggagcctgaggcaggtggatcacaaggtcaagagttcgagaccagcctgaccaacatggtgaaaccccatctcaactaaaaatacaaaacttagctgggcgtggtggcgcgcgcctgtaatcccagctactcaggaggctgagtcaggagaattacttgaatctaggaggtggaggttgcagtgagccgagatcacgccactgcactccagcctggaaaggaggggaaagggaaaggaaaggggaaagggaaagggaaaggggattgtattcgaggctgggcacggtggctcacgcctgtaatcccagcactttgggaggccgaggcgggtggatcctctgaggtcaggagttctagaccagcttggcgaacatggcaaaaccccgtctccactaaaaatgcaaaaattagccaggcatggtggccggggc

SEQ ID NO: 73393 - DNA, 2235 bp, Homo sapiens
tctgatatcttttagagaaaaggaatttcatttctacatctgagaaagtggaaactaggagtttcttccttacctggtaaatgggccagaaacagggaataggaagattaagagctatgggatttgttttatttctcatctcagggtaccaaattaactcatcatcccaaggattcatattttagaattacttaaggattcatattttagaattactgtatcaaatgatatccaactctaagagaacttctagtatgaagatcaatgttgaaagtaaaatatttagattattaataacaaattatttaagggagaattagtttgtttagagctttttttcttaactatatttggaattaaaatgtcttaattagatatttaataaaattaacatttagaattaaagtatttttctttaaaagtatatttgcattttgctagcttaagtttattgaaactgagctcttgtatgtcatttcatgtttttcccttgatgtgaagtcttacctatttgatgaagatgtcttttgaaaggtgtactgcaaggaacaaaatgtttgtaaattctccttttaccaaggtaaagatcaaattttataaatttacttgtttgtttatacaaggaaaaataacttcatatattgaatatattcaaaagtttaagcatttagttgtattgccctgttaagttggcatagcaaataaatgcttttcttttcctcattttattctttgtgtttcctaacctatagcactgtgctgggcacagaatggacttcagttaagtttttgatgtagaaatgttttattattctacttaaaatctccttaaaaataattatgcatattacatcaatgttataatgtttaaacatagatttttttacatgcattctttttttcctgaaagaaaatattttttatattctttaggcgcgaatgtgtgtttaaaaaaaataaaaccttggagtaaagtagcagcacataatggtttgtggattttgaaaaggtgcaggccatattgtgctgcctcaaaaatacaaggatctgatcttctgaagaaaatatatttctttttattcatagctcttatgatagcaatgtcagcagtgccttagcagcacgtaaatattggcgttaagattctaaaattatctccagtattaactgtgctgctgaagtaaggttgaccatactctacagttgtgttttaatgtatattaatgttactaatgtgttttcagttttattgatagtcttttcagtattattgataatcttgttatttttagtatgattctgtaaaaatgaattaatactaatttttcagatgtatcatctcttaaaatactgtaattgcaatttaataattgtattgaatgccatcaagtttttttaaaaagcttatgcagcattagaggaatttattttaatgcacatttatattcaacatagacattaattcagatttttacttgggataaaacaaattctagttttccctttgttttgaaattacttttaaaatatgtctttacagataaatataaaatatattaagcattttgaacagagcttagaagacaatatttagtactgtttctgaatatttctttatatctgaaggggaaaagccatcaaaatatgtgaattaaatacctaaaattctggttgtcaaaacgtcacacttaaccataactttaaaggtagaaaaacccttacaagtgaccaacccactcattggatagctaaggaaacacaaaactcaaataatttgctacacatcacagattggggtcttagtcttatgtcttctaactttataatggtatactatttttttcatgtttttattaaaatgttttcttaaatccttagccaaagatttttgtttgataagtcaaaaataaggtcttgtttactttgtttacttttttgtattcaagatttaactcagagtaagaccaaattatcattgtagttttattgatataaaatgtcaacataatttaatttttttttttacttttttgtatttttaaaattttttattaaaaataaaagtagacagccaggtgcggtggctcacgcactttgggaagccgaggcaggcggatcaccaggtcaggagatcaagaccatcctggctaacacggtgaaaccccatctctattaaaaatacaaaaaaaatagccaggcgtggtggcgggcgcctgtagtcccagctactcggga

SEQ ID NO: 73394 - DNA, 1071 bp, Homo sapiens
taacaaggaaaaaacattaacttatatacaatttattttttccatatttcttaaaatatattaaattctaacatagaaaaccaacttaagagatttaaagattcccatctactcagatttattatattcaagttgaattattaagcaagacatttaatttacttattttgtctcacctttcaatataactactttttttttgttggaagattataagaatggagagttctggtatatcaaaggcccacagcccagaatataaaccaccagacttggaactatggttgttgtgtaaaggataaggactgaatgattctgtcttcagaatatttttgtatttttttttttagaagctcttttctttggctctacatctagccattagggctctttctgtatctggttaggcaaagtggcttttctttcagccagcaaacgtaaaagcagagatttaagggatggagtcatgatgatatttccagtggactaagataaaggattgaagaaatggcatggtctatactagtaaagatttcctcacagctagtccattttgaatggagagataagtatggaatagggaaccagttatctgcccaacacagtacctaataatgagaataattttctgtattcaaaggttcttagtggttgttaatgtcttaaaagagaccatttaactggaatggaagtgttttctttggagaaaagcaggaaacattggatagatcttaattatacagaccttgatacttaggcagaaagtagagattctacttaggaaactagaaattactttttttttttttttttttgaaacaaggttttgctctgtcacctgggctggagtggagttcagtgcagtggcatgattatggctcagtgctgcatcaaactcctgggctcaagtgattcctcccacttcagctcctgagtagctggtattacagatgcccagctgatttttaaattttttgtgtgggggtggctaaatgatgagagcacatggacacatagaggggaacaacgcacactgtggccttttggaggatagagggtgggaggatggag

SEQ ID NO: 73395 - DNA, 1043 bp, Homo sapiens
accattgcactccagcctgggtgatagagcaagaccccatgtcttaacaaaaaaactaacaagaatgctgcactgggctgaaacatacaaatgctgctgggtgtttataatctgattgttctgtgctgtataaggatcagaatacagcggtggcaacctcagttgaaatgttctaacttatataatgtgctgaaatttttaaagtcttccctctttttcctaggtttaataatgatagaatgaagaccacaataaaagagacctctacttagctcagcaattcttaccttgtaagtattaactctgagtctccctattactgtttggtgtcatgttctggtttatttctgatttttttccctgcttatcctattatggtaactttctaacctctcctagcccctctacacgttgagatttgatgttaattaatagtttagagcaagaataatgccattgccttggtaagttatttagggaagtattttatacccaggccctataatctccaagtctgagaatcacaattttgagcccttttccttcaaaggaattaacaaataggtaattgtcttttttagtactcattattcaggtttattggtcttatggttttataaattgagagtattctctccacttgagaaatgattttgtaaagtctgtttttaatttcattaggttacacttgagacttctttgtgaagagcttaacatttagctgttaaaacttgaggaggtggccgggcgcggtggctcacgccttgtaatcccagcactttgggaggccgaggtgggcggatcacgaggtcaggaggtcgagaccatcctggctagcacggtgaaaccacgtctctactgaaaataaaaaaattagccgggcgtggtagcgggcgcctgtagtcccagctactcgggaggctgaggcaggagaatggcatgaacccgggaggcggagcttgcagtgagccgagatcacgccactgcactccagcctgggagacagagcgagactccgtctcaaaaaaaaaaaaaaaacaact

SEQ ID NO: 73396 - DNA, 1024 bp, Homo sapiens
attataattagttgctgatatcacaagttaggtaatatattgaggatagaaaagaaaagctggctatggccacacaggagtgtttctttcacttttggactacattatctttgttttataaaagcccagtctaacaagaccgaattcttgttgatttcactataataaaagaaagaaaacaacattctatattaacttagtgttgtaaataactaaaagcaggcaacagatgaaaacttatgtcttttttcttactactaaactgcttactttttctatttaccatttctcactgaaatatcttttatctgaactttttatctagaaagcttagattattctaaatcttttggaaacaggactttgtaatttcaaataatatagaagaatgtttttatttttataatttgaatttgcgccgatttttataacctaaatattctattttttttcttccttttacatctaatttcaataggttagagttacagggaagtgtgaatgttggatttctataaatgttctgaatttatttgtagcggtcttggtgggaaactactaatgcctttttttttttttttttttttttttttagtgtataaagccaaatgtcccatttaaagtttgacatttgcaatagcattctatttaaaaggtaatcatatagttgctttctggtcaccttcattaaaatcactcctgatcactctcactcttaatattttcctgtgccaatcacagtaaattcagaatattagttccctggtaatattactaaaaaaagctttgtcatagtatgtgtctagttatctgaaaaaataaatgagcccacaacctttcttggcattgtgaagtcaagcatattcagccataaattgaggttacttttttgttgttgttgactaatgctagaggtttttaaaaaaaagtttatgtaatttaacagataacatattaattactgttacctcccctaactaaaacatgagttacataatcctctctattgaaagcacctcatttt

SEQ ID NO: 73397 - DNA, 1153 bp, Homo sapiens
gttactgtttcatacttttattttaaaatgtctcaaacttagccttcttgattaggtattattatttaaacttacttgccagttctagcctatgtgggtttttctttttaatagtttatagatctccaaatttttctgactttttatatttttctgaatcacaagttgcttaaggttctaaaagatgagttgcatttacagttaaagctgtaagtctataaatagcatcacattacatttaaaggtaattgaacagtgaatatttctatttctgttactcatcaattaatactatgtacttactaagtttttaactttgtattgcacatttaaaataggtaaattgcatatggaagtttttttaatgggatttatgcaaaaacagtatggactaaaatcttatttctttgctaatagtgtctaaagtcaaacatatggtggtgattagatatggggcacttgggagctagaggcattttgtaagcaaaataaagtgtcatttcttgattggagttttacactttcttattttccaggagaataggtagggaagttactctcaatgaatttaccccaacattggttaaaactcttcagagaattttgataattgagcggttaaatctagacttacaaggggaagattattatatatgtcattaatttccttttccttgcatacattataggttccctttataatcaaaacaccaattttgtcttttttctctccccaccccactttttaaagaaaaattattttaaaaataattttatcatatagtgatataagcagaccttgagaggtagattgatgtctgaaccatttttcctctgtgtgtcagtttgatattcttttctcagcttgctgtttaagaagcagcagcagcaacagcaacagcagtgaataaacaagttatcaccacagcccttgttcttaccccttacagctgggagcagaggctgggagatcgatgctgcttgtcagctgttgtgcagaataacatcaatatgcaataatggtggccaaaggagcctgcacccatccgtttttacaaacccaggtgggaagagcccaactgtcactgtaccacatacacagtatagagaatacattctttagcagaaaggttgcagcataaagagaacagta

SEQ ID NO: 73398 - DNA, 1236 bp, Homo sapiens
ccaggttcagtttgtcactttcaatgcaggtatctttagaacagccttaatgagttaaataggaaaagagagacagcatttgagtttatatggtagataagatataaatccacagagtcgtccaaatttagagagtttgtgatttgtgatctttgaagatatcaaaacttattttgaacacaaatatttagcatcatataattgttcttcctatagttattatactgggttataaacttctaataatttagcttagtaaataatttcatatctaaaagaatcaatacaaatattaacagtttacttgtatttggtcaattcttacagggtgagaaactttaacctaattaggagtatgggttattttaggaggccaattaacaaagagttcaactgctgtgtatgattggctctcttttaactaccccttgtaagacattttgtaaagattttgaccgttttaaatttgcaaacctgattatctaaatttaagccttgatgtgtagttaattatgttggaatttgggggaagagatttattgtgttaatttttatctttttttcagtgatttgtatctcattttttcaatatttatgtttttggctaaatgcacaatcagggttaaataacattcacttttgggaaaaattcttagctgtccctaaaatacagttataccatcattgttcctgtcttactgaaatagtttttttagtatagaaagaatatttgaataaactagaatagaggtaacttaacatatctacatatgaaggaacttaaaattattatttgtcagagatgtataatgctagtttataaggatatgttacattttaggcagtttgtcagctatgacattttaatagaggttttatatattgatgagaatttgttaaataatagatacaattaactttttaaataaaagttttaaaaatatttatttgaagcagttttgttcatgtgtgtattttgtgttttttcttaaactagcaaataacatccttaacctctttcagtttttcttcaaatgagatctaatgtatcagaattatattttctgataagcatttttcaaagggtaatatttaattaatgtgaaggtttaaaattaaatacattttgaagtgaaatttctattcacagcaccacaaaccacacttttgatacttcattaacatattatttgacttagttttactttcctattttcatggttagaatcttagagg

SEQ ID NO: 73399 - DNA, 1839 bp, Homo sapiens
actacatttctgatattttctttatgaactcctcttgtaccagtcctctaacagctacccgcatacacactcacccatactactttgaacatgaatgccctaaagagaaatgaaagcagaaacatattaatctgatttgtttgaagaggcttcggatgataaagcatatcacaggtgtttctaatcaagttatttctatttttaaaacattttcaagttagagcttctctgaacattggcaagattagggtcattttgaagaccatacctctgtgttcagggatcaactgtggaactgcaggagatggaaatctgttgagtgtcttcatgctataatacatgacatttttattgcaggttttgacctgtagcagagaaccaattctggagaacagcctcacttctttgattgaatacttacataatgcattggaacatgacatgagattaaggtatactaacaaattttaaaaccatataattttatgtctttgcaatataatcggactagacaattggtaaagttgaaatttttacgtgaactaaaatcaataagtaattactcataaacagaaatcatcatatgaagtggccataagctgagttgtctagcttactaaaactccagattttttttttatacaggtaatgttcttctcagcatcctaaggtctaactccaactgaatttattccaaaaatatgtatttatagtaatttttattttcttaaggttattacagtgtactcagtaaaatatgaacttttcatcttataaaatggagagtttaaatcaaatggaatttagtgcttagctgtttgacaggtggaagagtagtaggtagagcctgcaaaattaggtaaaattgatgagaatattttaagaaaatgtaaagtattccaagtactgccctaaccaaaagtggcaatatggtcgaaactgaaaaaaccactttcttaagcagaaattactagtatcttactcaacatacactgagtaaaatatttcagttgttaatatcaaaagttgcagactctaaaaataaaattgtagaatccctaaacctccagtgatttttatagttttagttgaaaatttcagacagtatttaactaatacaactttcattttctaaaatggtaatctggtatagtgaaaatgaacttattgaacagtattactaagtattacttggttaattctttcatagtaaagtattaatcttatatgtacatatatgtgtgcgtttatttgtgtaaaaactatttgctaaagtaaggtttactaacataatacaattttttttaattttttcacctaaaaatatttatatacttagaggaaatgtcaaaggtttgttttcatgagaaaattattatttagtcttaagaatgaagtatatcatcacgatcatagaactgcttttaacttccaacaatgtaaaatttttaaagatgaattctgaggtgtgtttaagagtgaatgttgaaatacatatcaaaatactaaaaactgaaatttgatatttctatattggatattaggtagataaaccaggaatgaatcaattaacagttgaagttaaataaaatgtaaagatgtttagaaatcagagtttaacataagggtgaagtttagatacttttatattggtgtcatactgtaatgtggttcagataaatatgaggtatggaatgtcttcatatgtttgatttgagatttttatgaaaaagcagcttagtttgaataaaatgaaaataaatacaatttttccctcactgacttaacagctatttttcaggttagagaacattaagatgaaaagtggaaaatacagtt

SEQ ID NO: 73400 - DNA, 1029 bp, Homo sapiens
tgctttatgtagtacattttcgtttgttttgttttgtggagacttgtgtgtatttttgtttgtttgtttgtttattggtaggtagtaactatttggaatgtcacagaatacttaaagccagaaatatgggtcagttgatttggtttacaaaatgaaaaaaaattcccagagactgtattagataattattatatatgacacattagctttcttcaaaagaagatgataaatttatagtttcaaaaaattattctataaaaatttctcttattttaaaatattacctaaaattggctcttgtgttttttttcttctgtctaatgaagcttaaaaattcacatattaatttctttttaacccctttttagaagacacagattttaggtctgattataactagaaaacacatcttagaaaaaattgtcatatatatagtttcgtgggggtttttggttttgttttgtttttaattcagcaaactttgaaacattgtatgccaggcaactaattttggcacataattagagctcaactatgacttgctgaaattttgtagccccaaatctcataacaccaaaggaaatcagtaataaaataccactttatttcaaataagcattgaaaatgagattaagcatttaatttttggaagtgacagtattagaactttaatgtcatgattgtcttaagagtaacaggatagatttttagaatatcacattactattatatgtttatttatctcgtagatcatataaatattactttctggtggggaactgaatgttttttatttttttgcctcggttggttttttgtttttattttttgatctgtattagagatgctttaaaggatcttccttttagaaagacaagttttaaatattgaaattgatattaaatatatatttgaatattattaatatttcttatcaaattataagaagtttactatacctttggttaatcctgccttatttcagtaaagaaaatttgtactggaataacttgtagtggtttctaagaa

SEQ ID NO: 73401 - DNA, 2024 bp, Homo sapiens
gtgatggccgtcatctcgtgacaagaaacttaaggtcgacagaaaattcaggacccggagtcatgggtccctccggtgggtcgtggcaacagtcccccccgccaccgcccggcacccatctatctatattgtcttttgacgctgaagcgtgaggtgccccaggaaagagtttcccaagccctggctgccctcccccggcgcgctgggtcccggtgaggtctctaggtaggtaggactggccgcggctcgcgcttccaagatggggcaggggcaggcttttgaggttgtagcgggctcttaggaaagatgctggactttagcttctttctggggatttttgtcatttgctctcgcagcgttgtcctttctcaaaggggaggagtgttcacgggtgagatgaaagatggggcttcgagctaacgatttccttctcgtggctatttcctccgagtcgcactttcttagaagacttttttcttctccggtgtttgaaacatgtcgcaaggaaaaaagcaatctgtgaaactattaatgttttcctcccccaaaagtctttacccggacaacttaacggtaattttgcgatccccaccttttcttgacgctgaggaggagggacgagagttgttatttgtctttcccttcggtgattttttttttcccccttagctggtggtttctatcaattcttactccacagctcttgagtgatgtgagccagtgacggcattaactttaggtaatacttctatggcctttgtaaaaatcccgcgttaaggatgtattagatcttgagttcttttccgcgctggaggcaccactagattaaccctttgccggtgtattgcgtgtggggcgcacggctctgggttgcaaatattccggagatgctttctgcagcagctattctgttcagttgttcgcaaagaggaataacgcttcctgggaaccgcggtgacacgcttctttaggactgcctgcctacagagtttttccccgtggaattgatgtaacgattgatttatttcttatattctatgaagactgggggacccgccctcgcttagaatgtttcccggaggagaatagaagagtgcaatgtgatgtttttcaaattgtgtctaacggagctccctaaactctggacttgttaccccctgattggctggaaggaagcgggcctggggggtttgaatgttgaacgctaaactataattctcgactttacgaaaaaatatacttttagccagagaaccacggaaatagctacgaaacgttaggacgagagtttagaaaaaaagttggtttttaatagttttttttcctctcagaaaggattttcgtgtggttctcaaatgtatattaaaagtaaaactgaagaggctgttttcgcaaaattatgtttctgctggttgaaattaacaagacttttatatatttgtcactgttctttattggttaaaaactgagtgaaaaatttagtttttttcctttgataggaatttttcaccttaaactacatatatttgttggatgcagattaccggacagttgtttcttttattttgatgcaaagaaactaattttcttaaggttcacgaatgatctttttaacattttccataaaaattgaacatcttatttaaaaaacttttcgcatctagtgaaaatatacattttgctaattcagtaactgcagtgaactaaaactttaatttacaaaacatttatgtttcttaatttagacaacaggtaagcacaggtgcgtatctattatttagttcctttgataaattcattatgaagaaatatattgtatacaacagtgtgggtgtgctgttttttatctggttgattttcagttgatttttgttcgatgttgcctgagacagcctcagtatatttccatttattaccgagcttgtcattccatttaattgcatcttgataaaaggcaggtgtcgttttcaaagaacagcggcaaactaactgataaacagctgtagatgctttgagaaacaatt

SEQ ID NO: 73402 - DNA, 1085 bp, Homo sapiens
aacactgtggcttatattgaccattaataaacgctgggctagactagcgggatacacacacacacacacacacacacacacacacacacaaactggatacgatggactccagtacccggagctttaaaagggatgggggatgggggcggggagggaaaggagttgacaaccagatgaagtggggaaaaggaggggagaagaatacattcagcaactgcagcaggtaggtaaatcataaaaaaatcagttcctgcaactaatgaaaaaaacaatctcactatagtctggggaaaatggttctctgacgcaagcctgatggtgagtctatttgtcatgtttcttttccggactatcaaaaaagttatttcgagattcagccaattgttttgactagcagacagaaaaccggaccaagcgtttcctgatgtaacgcaccggccgcggcagggcccagcgcggagagcgcccggagctgccctcccggggctgctcagaaaagatgctccctacggccctgggagaggcgagcccgagatcggccggagaggactgcctgtgttctgtgtggcgcctgactgcagccttcctttggaggaatacgccttcagttttcttctggaaggggaaatgggcgcagctctccacgcggcgaccaagattcccagtcgcttgacaaacttggaaactctgggacgttctaaactgagtttccctcgttcagcagagttccttgttatctactttaccagtgttaaagggctgcagaccgaggggtgctatttgagacgatttttttttccacgtcgactggagaagcgccgccgccagttccgaagacgacttgccgacctcagcgccccgggctcggcgaggcgcaccgcccgcccctccgcacccgcccagccccgctcacggagggagccggcgagggagtatcttatccagcggccagagctcggtgccagggcgctctcctgacataaccctgtccaggggggccgagacgtgcaatagccaccgcgaggctccccagctgccagccccatcctattcccgccagcgtcttccctggaagagcccccagt

SEQ ID NO: 73403 - DNA, 1017 bp, Homo sapiens
ctcatactttctctgatgttctgcaattttctgtgccctaggttgaacttctttcagcattgcactagcatcttcatcataatcgaatttacaggcaagggcaagatcatgggctgcttcttcccagtggcctagaagtctgtgtgctttcccccgcctcttgtaaggctgagctgaatcaggatttatttcaatggctctgtcacagtctcggatggctgcatttggcttctgtaatttgacgaagacactggccctcttggcatacaaaatggccaagcgaggattcagcttgatggcatctgtgaataagtcaatggctttctggagttcaccatcatttagggcttcaatagcagccacttttttatcatttgcctgatccatcacctcctctgttatctccgcattttcatctcccatttcttgaggagcatcagtgtctggttcaatcacaccttctttatcaatttctagatcactttcctcacttgatggttcgtctgcctttaagtcttcctccaccttactatcaggtttttcttccttggtattttcttctgatttagctttctgagtagcagtacctcccatgctctccacccactccctcaggaagcgcatttcctgggtgtgcagaatgcttggatccttcttacacattttcacaaaggcccgaagctcgttcactttgcgggggtccatggtagggagatggtgggcgaagccggggggctgcggcccggttccaggcccaggcgctggctcggcgtgacagcgcagaagggggcggctgcctatgctatcaacttttcaagccaggtttctcaatccagttttctgaaatattcaacctgaggttgcctagtctagtatcaatatgcattcattctaacaatataatgtacaaaggactgtaaataccctatcctttggtgatactgtcattcaacaaacatgtactaagagctcactacagatccagaggcagaattaagagtgccaggaatgcaaaga

SEQ ID NO: 73404 - DNA, 1043 bp, Homo sapiens
aacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcaggtaaacacgcgcgcccgggcggcggggtcggcccaagaactggcggagcggcccgcgaccccgggcgcgccgccccccaccccggtggctcccactacccggcccggcgcgggatgggattctctctgggacagctggccccgcattttggtcacacgtcatagcaagccgcggttttcaaacccggaagcgccgaaaaggaccgagcgtgtttcccgggccctgatccccggtggctcgggtgggagggtggaagccgactcagcctgaggggagccacgcgggttcgcggtcaccggtgcgctgcgggccccggaggtttctgcccttggtgtcccctacctggcagctggccctgcttctgtgatcctactgggttggaaccagggatccagtaggctcgaagtggcctcagacggtgcgcagttttaagaaagcaaagggacaggcctgcagtggcgaggcaggagggaagcgggatgggagtcgcggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatattctt

SEQ ID NO: 73405 - DNA, 2992 bp, Homo sapiens
aacatacataaagtgtacggattttaagtatgcaactcactgaacttttcatacgtatacaccaccctagtaaccatcccccagttcaagatgtagactgtttccaataacgcctcatgcctgttcctagatagccccaggaacctctatgctgacctctgtcaccagagattagttttgcctgtttgaataagagtgtaccctttgtgtctggcttctttcactctgaaagattcatccttgttgtgaaattcattcatgttgtagcagttgtttggttggttggttagttttttcattgctgcttctgtttaattgtatgagtatccatactatgtatctctactgtggatggacatttgggttgtttccagtttgcaactattacaagttacacttctcagagcattcctttaggcggcttttggtagacatgggcactcatatctctagggtgtataccctggagtggaatggctggttctagtacttgtgtgtagagctgtagttgacaatgttaaatggttttccaaagtggttatactgatttatattcccacaagcagtgtatgagagttcccattgctgcacatcctcggtaaaaacgtttgggtggtaaaacagctaatgcaaaattcagggttttgacagaatctcgcaaagggctacccgtatacatgcttttcattagaaaaatcatcctttcttctcacttcgtcacatcaagacaattagattttcagagtaggaactctaatcattctttcagaatcaagtgcattattgttatttcagatatacacaatagctgatgataatttgagcttcttattttgttgttctgtttaatcagtattgacatcgtcattttatacgtgtgtttgtgtccttgtattaaacacaaaaccctcaaaagaattaaatattgattgtatccctgaaaattgtaggttttaatatatctactgctgggttgtgggaagagtttcagttgagtttctgttcagagctgagatctactgtgaccttttaaggcattgggggaggctgagcagctgttggaactgctagaaagagctgtgtggtcaggggggcaggaactcttaacagttaaaaacttgagctaccagctcctgcaattcttccttctggcctttagcgccacctgcaggctctgagggtacaacaaggtttgacagcgactgcagtgcaacactagttctcaaacttgagggcatcatttacctggggagctgggcctcagttcccagaggtgctggttcagtaggtcctgggctggggccagagaatgtgcattggtaacaagttcccaagagatactgatgctgctggtccggaaaccactgcccccaccccaggaaccactgcagtaaagactttgggaactagattgggatataagaatgacaagcctcatgtttggccctctttgtggtgggccagaatttatatggtcaaggaagtgcatgtaagtgcagagtgtgaggctcatcttcccagatgtagttgtcgtcttttccagaagatgagaaatcagcctgcttagttacccattcgggagttggaaacgatatgcccttggctgagggagcaccatactccagtaaagctgggcccttaataaagaaaacaaagattattaaacatttttcaaaagtatttggcggaggcggcttgtattcggttttagaaaacttgggatctgaagaacttactttgtgtactgaaaagtgagcacatgaacccacaggccaacagaactttaaagggatttatccgtgagacaagggtaaagatgcctaaccttgcaatgatacttttttccaacatttaattcatgctgttcatcgagttgcctgccacagcactgtgttatatcttgaaggatatatttaaatgtttgatttaggtatctttgcctctagttttcagtttgtttggagaagctggctatctcagataaacaaatctggaacttggaagagatactgtgagatatgcagacttgggacgttggttttcataggctggtgaagacagaaccatttcccatttcagcaaggcaagcatttcttttagtttgggatggtcttaaatgtttctgtaaaatggcctgggaatactagcctgtttgcagttttaatttctataagaggccattactttactttttggaaagtagtataagtttccatccctctttttctgccctaaaagtaaatgtttgagtcatatttttaatgtttttcttaagtccatttttcttgttaatgctactaagttgggatgtacccaggtgtgagaggtcacctgattcattgcgtttagaagactgcatttattgctgttgggggctgaacaattaattgggttcatctccaaggaaatgttaattgggaaaccctaacattgtgtattgaaaaaaaaaaaaagaagaaaaatcatttcaggcctgttaaaacaaaactcatttgggttcacttaggctgattaaaatattccttaatcagccccctgattaaacagtcctgaggtgaaactgcacctcaactcgaattttcagttagagacaagttttgcaataaagttatccccctttatttcatgaatatacatgttaaaaagtattttaggaaagattgcacttattatttatttctccacagaaagcagtttcatggaggtagaggatgggttgctttttgggagataagaatccctgtctaccttagacatttcaaatacaataacagctttttatgtgaggcatcgtgataatcacaaatgattataccagagctatctttccaattggaatgcaaaaatagatgtggaaggattgtataaattcatgcattagaactatgttctaattaaaggatttaaaaaataaatttaaaaggaaaaactaattttcttatttaatgatggagaaaatttatattaatgttatttctgattacagtcttga

SEQ ID NO: 73406 - DNA, 1081 bp, Homo sapiens
ctcccacatcctctgagactgtgattttaaaaaacaaacaactcagtcagtgtgctccaaagcctggctataataacacagacttaaaagctagatttatgctatttattagctctgtgtcattgggtggtttacttcctcactataaagcctcacttttgtcatctccacagtggggagaagagtaccagtctcatggggttgttatctgtggtttgagttactcataagctttcttacacctcaagcttttagccctgggcctgggacagagtagatatttcaataaatatttactgaacgaataaaagtctcacattccatttcttcctgcaatgtctttgcttattctgctttttcctccccttctacttctatccaaattctaccctttcctcaaggttccattcaactttattttccacaaagctaagccatttgctccagctcagcttctccgtcttgactttgtgtctgcctggaatcctgcctgctcttcactttatctacctggcaaattcctacttatcctttaaacccagctcaagtatcacctctaccaggaagccttcccatgggtctctcctcttgttactgcccaggttcgtggtacctctttgaccacctacacatttcatcatgattattcatttaagtgccatttttatataaatatgtattgaacacctaatacatgccaggagctagagagagtccaagtgtgttttccctgagtggccatttcgcttctcagtgtgggcacctcagccttctgcttcagagcacaacctccaaacagtagagcatgtcacgtaggatttccaggcctttattcagagctacctttatgacttccttgtctaaggatgactgtttgctaaagcagaatgggccaccccgtggcaaggggatgtaagggatttggggctgcatgttctagtccctgtttcattatctgtccccgaaacagctaagctggaggctggcttactcctccgagggcctaggtctcaacatttggtaaggctctcctgcatgattggctacctttgcctgattgtttttaaagattttttgttat

SEQ ID NO: 73407 - DNA, 1049 bp, Homo sapiens
tatattaatacccctctttcagtaattgattttgtttactcattatgggccatatttttctgcttctttgaatgcctcatagtatttgattagatggcagacattgcgaattttgtctttttgggtgatgagtattttgtatttctataaaatacccttgaacttcattcttggacacagttactttgaaagaattggatacttttaggtcttgcttttataattagtttggtaggaccagtccagcaaatagttagggctgactcttccctactactaaggacccttttgagtactatgcctaaagctccatgaattgtgaggttttacagtctgtctgggagtaggcacaattcaagaccctgaggaagtatgaggtactgctccctcgaatctgtttagatgggttttctcctggcttttgggtagtttcatcacatgcatgcactgatcctacttaagtaggaccctctgcagatctctggggtcttgtttctttttagccctctcctttcctgtgtgctgacctgtgaaccctaaccaccttggtgtctctggaattcttagcatcatctcttcaattcagtgagtcagctaggctttactgggttctccctttctgcactgtggcctggaagctcttttaaagcagtaagctgggcaatcatagggctcatctcatttgtttaccatctctcagggactacggtcctgcatggcttgtgtgcagtgccttgagaatagttgtttcatatattttgtctggtgttttgtgggtttttgttgttgttgttgtttcagagggttaattgaattcctgttattccatcttggtggaaagtagaaatctcaattttttttttctgtagatacttaatgtcactattagtttaagaaaaaatggtcgtattttaaccattcatgggtaagccaacttgtaaaatatgtctgctctatttaagcttatgaagatctgaagtagagtaaagggagtgggggccatagaaaaataaaagagagtaaaatctcccttctttcattctttctct

SEQ ID NO: 73408 - DNA, 2720 bp, Homo sapiens
cttctcatcattcctcatagcaatacatttaaactacctgaaattcaactgcaacttgcagagaaattggtaatttgctcaagatcacaacatttgtaagtgataaattgagttaaaaatcttacaaaagtcatataagtagaagaaaggaaaacagggtaaagtaaggtgagcaacaaaacagctgtgtgttttaattttagatattcacggtttattttcagaatatttaaaagatgcttcaaagaagatgaaaaatgggctaatgtttgtaaaactggttaacccctgttcaggtaagttctcttctcataacttgaatgttcttaaatgttgtggctaatgagtatatacacttttatgtctttgtgtccttgctctttctgaatagcttttaaagttaagatggcaccgtgaggagaagaaaacaaggtgatgacattactagtcttcccagataattcatttgacttaaacattttaaaaatttcttctcataattttaattcacagaactgttcagccatcagaaatacgggcaaaacaaaaaagtagcatgtttgagttctctttaaaaacagattaattttctttggcttccttaagccaacttttcttagttattcaacattagcctccatttatatccattttatcttataaagtaaaataaacaaccagaatttaaaaaaacaaaaacagaaggcttttacttgacatgccaagattttgattaggttcagttttagctatacttccctattttcttctgaccaaaaagtagtactttttttctccgtcaggggacttttttttttttaaatgataagcattgtttattgaagggattcatatcttattggaaaaattttattttaactttatattcagtgcattttcagttttgtcttcacattttttaggcaaaaatattaaagtgtattctaaatattgagtaatatgggtgatagtgtttatctctgtgtgtaattgtttttccattaatttataaggttttgtgtagacacctgatacttgccatattagaggtttctcctggtgacagtaatacggaatagtaaaagtatgggagggccactgagtagtgccttgttgttatagagacatgtaaatagaagcaacaagagaagaaacacattcctgactttctccagtgttcttttcttcaaaatgaaattgactgtaattggtcagctatatttagaaatcttagttatatatcagactaagttgacgtgagaaatatttcttcaagagaagttttaggtagcagtaaaggttctaaagcatttaagaaaagtacaggtacagaagaaagccagccctcttttaaaatttctgttttatctaaatgctcatagacaacagaggaacaaatgtttttatttgctacattggcagtgggaaagtaaaggctaacatttgctgagttcttactatgtgccaagtattggtttaggaaatttacatgtgttcttttttttaattcttataaaaacccttgaggaggttcagtattgtctccattttacagatgtggaaacagccacaggaaggtttatgtaacttctccaagggcacgtgcccagcatatggtggagatagagttaaagtcagcatccttgtctccagagattgtgctgtggttaaaaaaaaaatttttttttcattagttgaagtgataaaacatgcagatgtgcacagtcttcaccctcttgtgcctcctcccttttttttttttttttttttttttggttaagaaaggaaaggaaaaaaaattcattcagttgaataaagctttactcactccctatggcttcaagcatgtctgtctttctcacttagggttggcctgtggcttggtccctgtcagaccctgtgtggggagagccacacactgcccagaggcagggacccacgtgccagctcatgtcatatggctgaactgttgtgttttgatagtttaggaatggatattccctcttgatctgatggaggatttaaggacaggctttgtattagttaagataaatgacttgcactttctaattttttggtttaagtccagtgaggattatggagctggaaaactaccatctatgtataatagctgtaagctttccttggaatcagttttttagaatagacctgtgtatgtttatgttcatattaggaacattcgtcagagatactggatagtcttttggggtgtgtgtgtgtttgtgtgtgtgtgtgaaaacttacaaataaaagacagatttgtcttaacaggagaaggagccatttacttgttcaatatgtgtctacagcagctgtttgaagtaaaagttttcaaggaaaaacaccattcttggtttataaatcaatcagttcaatcaggtaggtgactagtgtaagcatttccaataactaaacacatactccagcttttccattcttcacacgtggggttgtgggtctgtcaccgggtttggagtctggtcactggtttagccttccttggcatgagagcaggtttaatcaaggagaaaggaaagatcatttgagcactaaggttaagtcatctcctgtgtgtcttagacggtaggaagttttaaactagcaactctgatttgtctcctaaaacagtgacacatcctgagttagaagttagatttgtacatggggcacatattgtgttgattagaaactcttttgag

SEQ ID NO: 73409 - DNA, 1033 bp, Homo sapiens
gtggtgttttctaggataaattaatgagcagaaagacaccaaccagcctcagcaaatgtattgatctgcacttaaggctccccctcccctttttgatagcatttctccatctcccattaggaccatgactctgggggattaaccctgtcttggcactctgggcacctccagggtgctatggcgagctcacgttgacaagtgcagaatgaagcagaaatgctgttcagggtggcctttggctttcattttaaaccgtcgtacttcccaaacacgtcttcccaagtgccaaaaatgccctttaaagtaacatttgagatgtttaggtatttccttctctacattttagacatgatcatttcctatttagttaaaaattattgatacacacttttgaaatgtgacctgttcttttaaactttattttaacatcagtaaaaataactttttttctaggtatcccactgctactagctttatagtcaaggcaggttgcttattgcatttccttcaatgtatatatggtaaataaaaataagaatgaaacactagttaattacaaaattattttatatcatgattgtatggtagtccattacatataaatattgttttagagtagtcaaatatttaagatattgattgatcatggaagactatagatttaaggtagaaatctaaagacagtaagacttgggaaaaatctgtgcattattcttactatttgaaggaaaaagaacatttaaattgagatagttcatggcactagttaacctaagagaaagtatggcaagctatcacgtgttcttaaatgattgagaagattttacccttaaaacccaagaaagctgcatttgcagaaattgatcagatgcagtttttgtgtcttcaggaggagttgtcagtacacgagaggtagagcgagctagaagtgggtcatgggcaaggccatacatctggtacagtctggtgtccccaaatcagggggctaataccttaatttagacaaacttcacctctacttgctactagtaca

SEQ ID NO: 73410 - DNA, 1050 bp, Homo sapiens
tttagtccagtaaggcagcaacaactcaaagtgggggtttccacgttagacatagataggagacaaaaggtggcattcttttgatcagccttccactgaatacacaatgtagtctggcttgagtgtggagccattgctagggaccggccctcttctgcccagaatttccctgcctcctgtccctatcaacaagattattttcctttcacattagtttgctgaggttttaaaattaccttttctacagagttgtttgtataatttgaaggttttcttaaattcttactcatttagtggttgatgactcctgaggtagccacattactactaacatttaaaaaaacatttcaagtatgttctcaggtttgtaaattaagcttttcaagaatttaaacttacaaaatattctttaaatggttaacttgtatatgatacaaccttaggagtttattttttttttaattcattgtgctgagtcttttttttcttttaaggtaatccagaaatagacaacaagaaatattacaagtacagcaaagagaagacattaaagtggctggaaaaaaaggtatagttcctctctagtgccttgtggtaaaagtaaaaattcagttctctaagaaattttcagagaaggcagtaagtctgaatccagagaccatcttgtatattcagtgaaaagaggaaaattgtgtagagataccaagtatgagaagaaggctttgactttttaatcctccctaacttctgtatctctgaagttagctttatgttttcttgtgacctgcattctcgtttctccctgctcctactacggaatgaaataatttgttggtgtagatttgagtcttccaagtaagaggataccaggcttggcacttgttggccactgtcagtcctgcaggtgtctccaagggtgatgcttacacacagccaggcaaagggacccagggacacagccaggcaaaggtgttcaggtttagaggaagtatgtcctgctctcagggtctggacactgatgaggggtcatcttacaggcaaaccctgtat

SEQ ID NO: 73411 - DNA, 1059 bp, Homo sapiens
atatttcctaggaagtgggaaatttatattattctatttaggaagttattacatataaattttgtgccaggttctattgtaagggctttatttacatatattacctcatttaattttcacagtagtcttatgaggtgaatgctatttttttcccccatttcacagatagagccacagaaaggttaagtaactagccgtggttacagagccaagcccagcagcctgactccagagtcagctctcagttatcacaatatgttgccttctcatattgtgtaggccatggaagtccatgtattgagatcatccagatattgctgccactcagcctttcttcaaatgggcaaccatttctcatcttctggtgtctggtgaagatacttctaggttctcaaatacttctttgcagatctcttaaatggtctgaaggccacctatgaattcatagatttctaaagttaagttgaaaataccctgcctttcccctcttggttgcttcataggttaatcaaactgtggcagcattaaaaaccaataatgtgaatgtcagttcccgggtacagtcaactgcatttttctctggtgaccaagcttccactgacaaggaaggtaagtaaagcattttatcagaaaagatttttgtctggagtaagttgcttatgtgtaaatgcctatcttaggatttaaaaatcttaatatcacagaagcctcatattcctaccaatgcctcatacacattgtggcaggtgtgcatcttatttcagaagcgaagaatatttctaccataggttacttctgtcattcattgatacttaagttatttattcagcaaatatttcttttacattgatagtagtaacaaccctggctatcatttattgagggtgtattgtgtgccaggccctttgctaagttgccactatacaaacatgatctcatccaaccctcccagtaaatttcataatgagcatcttgaggccctgtgcaaagtctcacaactagtaaatgccaaagctgagctacttatggagcttgtctctgaagcccacacttgtaatc

SEQ ID NO: 73412 - DNA, 1048 bp, Homo sapiens
gcaaatacctagtagtagagacatggtattttatttctcttaaatgagtacactcattactgttgaataattagatttattctttattgaagcaggcttagaaaagattacccttttaaaaaagacatgactatttcatattgttgtagatgatttttaaactttatttgtattcagtggtttcaaataagaaagcaaccctgagtttttgtttttaatgtcatttagggagcatctactgtattatacttgttttatcttatatctttggtatcatcacatgtcatatctcatccctcatatcttcccactagtctgaccgatagatattactatccccattttacaaatgagaaaactgaggctagagcttaagtgagttccctttatccagatagggtcagaatttgaattcaggtcaatttgactataaaaccaccataattactattttttttttttgctttcactcctccttctgtttctttcagaggattatattcgttatgcccatggtctgatatctgactacatccctaaagaattaagtgatgacttatctaaatacttaaagtgagtattgattatcttcagtcataatgaagtaccatttgcttcttggtttccccagcagtggggtttccttatggcttatcatatcactgtttatgatacaagattattcttcagctatgtcatatactttgtgctttggggatgatttttaatggatgattggaatgaactgatttgatggatacggattgcaggaactagtgaatgtcaagattggaattatggcttggtctgattttagaggattaactatgttaaaattttatcctcaattatacttaactaatttggttctttgtgatcgttttaagaggaagaaaggagggatggaaagagtagatggaatatagacttttttttaatttacaaaatattgatatcattttcactattatcactagatgttcactaaagggactttatgccaaagacttggaagtcaaagtaatatgaaacacaatctgtgtctttg

SEQ ID NO: 73413 - DNA, 1692 bp, Homo sapiens
ctcctagctgaagatacctttctagtaaaaaatgtgcatcacctaaacaccctttgctgtcttaatttaaatagaaacatgtatttttttttttgagacagagtcttgccgtgtcatctaggctggagtgcagtggcacaatctcagcttactgcagtctctgcttctcaggttcaagcaattcttgtgcctcagtctccggagtagctgggactacaggcacatgccaccatgcgcagctaatttttatatttttattagagatggggttttgccatgttggccaggctgatctccaactcctggcctcaagtgaccgcccacctcggcctcccaaagtgctgggattacaggcatgagtcactgcaccaagctgaaacatatattcttaacaaagttgcaaatatacattcacttggtgctgataggtggttcatttgtgatggattagtctttttcttttaatgattcatttgctagaggttgctgtgtggccaagaggttttcctatagtgtgtggtatattcccaggatgagcctctgtttttttacagcaaacaattttaagacatggtgttttatcctcttgggttatgggataaaacaccatgggctgtggaatcttttagcaccaactctacccgttctttgtttagcaaagcaggggcatgaagaatgaagctgggaagaagtctgtttcctaggttagatccatgttgggtctggtcaacctggtgtctccataaacagcctgaaaattataaaaatctgggttgtgatcaccatgcagtcaattctccatgttcaacagcaagacttgtcttccctgcttttgtaccttttacataataagtgtggcatgatttcttctatattgtgatcattaaggccttgacaagattctcacattcactggtgtaaaatgttcatgtgaaaggagaaaatattaagtaaaggtctgacttagttgcattgggcctaatggaaagaacactgtatcagaattgaaatcttggccaaagtcctctacttggtgaccttaagctattcatttagcctctctgtgcttccctctcttactggctgcttgcttgtgcaaggttgttcttgcatggataaagtaagataaatattgtcccttcattcataagtggacattaaactggcccaggaggtaaatgaaatagggattctggctggacacctggcccccttcaagagactattctcattttgacttctgtgccttgcattcatctggtaattagcaatcccctcatgcccaccacacctggcacctacaaagcctgtgtttgctggaccagctaaggggctcagccatgtacttacccaatcatatccaccatcaccaaggctgcttcttaggagtgatgtgtggctcaattccctagatgattggcaaaatgtaaaggagcctgtaaaaagtaagccctttgctgggtctgctgtcccattcgcctctgtagaggtctaaattatacatgttgggtttttttttaatggattgatgttgtgtcaaagtgacatttgacaccacttcactgctctaatgttgcagaaaataaagttatcagatgagcctgtagaagcaaaagaagattacactaagtttaatactaaagatttgaagactgaaaaggtatgtgggttcaggtgtagtggtgtttcgtt

SEQ ID NO: 73414 - DNA, 1001 bp, Homo sapiens
gattatataataccttggaaagacaaattcagggactgagccttatctttaatcattttaaagtgatatactgcagcattttattggaacttttagaaaaaagatatagtcttctcatgaatgcttatgcttccttatcaaacgtttacatgacaatcaacagaaaaattgagtgtgaatttccaaacccaaggtagaaggctgagactgatggtacttttggggttggagtaaataaaatatctgcggtccagtatttttttcacattctcctgcacctacctcctacttaccactcttcccagaccttcctctcccctcctatttttttcttttttctctaatttaaggctatcatattagagtatcagtttggcttccataactgaaataggaatatacatatttatttttctcttgtgtaacagtgcagaggaagctaatccaggggagatgtctctgctccacgtgaacactcagggacccaggctctttccatgtcattgctccctcactccctaagtaggttgctcttgcctgcatggtcaaaagtggctcagaagaaagtatccttgtttcagccaatagaaaaatgggaaggaaaaggctttgcacattcctttcacttgtaatcacctcccgttgaccagaatctactcacaaggtacccagagctgcatggggagctaagaaatgtggtcttttgtggcatgatcttgtgtccagttccaacttctgttgctatagcagctctggggtcagagggaggcaagcaacaatctctgatagatggctcagtttcatttgtggagttaggaaggagaagggaaataagatgaagaagacattttcttcatctggaccttgagtagtgacattgagggaaaaacaactttctagcttttcacaagatcaaagtcttcctatttatcccctgacagggaactggtctgactgcctcctccacaacagtcctccagaagacacctggagaggggcac

SEQ ID NO: 73415 - DNA, 1125 bp, Homo sapiens
tgtcaatctggtcacatctaaagcccaaaccaagacttctcttgtggatcaaaatctcaattttcctgtgattccttaagaaggaagattctgagccaagatttagaaaagtccacattatgatgttctagaattcaaaatagtgattttcaagcccttcaggtaagggaaatgtcaaggccaatggaaataccagctacagtatcatctttgcacagataatttactatccagagtagaaacaaacctgagcctttgagttggcaatagtttagccaatggtgtcttgagaggattgtagaacataggttctggcattcactccctgtttatatttgatataaatttcctataataccataagcaaacagcacctattgattggtagtagcaattcaactttgtgcaaagaaattcaatgtggttggtggaaaggagaacattttaaggcaaggttgtaagagtatgggtaatttgaaaaaaggaaattggacagatgagggaaggtttcaagactagcttattagaagaggacagagaaggtattgggaaggagggaggaaaagggtgtagaaacaaagggtgactgaagctgatgggacagcaggaggtcataatgaagaatctattgctgcagcaatgccttgggtacactcctagtcatgacggttagagggagggtctgtttactgtgtgctgtggacattgaccccatggtgaaggtcgtctctgaaaaccatgattaaggcctgaagaaacatcccttcctcacaagatctaacccaaatttgactgttattagaagcaacacattcttatataaaacagagcacctttcttattcttttacataatgttgactctgaaatgagaatcccttaatcaaagtatgataaaactgccccaaatacacggctagaacgtttggaagaagaaccgtttttacctgaaattcctttcaagttagctttgagtggatcaaaaagatcggtgactccccaagaatttaaaatgctttttaagttgaattgattttggatcctaaacctaaaaggcaaaaacaaaccatcaactttcaaaattctcactcaatatactttcatacacaccacatgaagtccaaaa

SEQ ID NO: 73416 - DNA, 1037 bp, Homo sapiens
taatttggttggcaatctttttctataaagggccggatattaaatattttagccactgcaagccatatggtgtctgtctcaactactcagttttgctgctgtagcaggaaagcagccatagatgatttatgaatgaatgagagtggctatgttttaattaaacttcacaaaagcaggtggtaggccattgtttgctgacccctgctttagaggaacaaaacttcatgagagaaaattaacagactggcatgttttgtcagtaggaaatgtgaatgcaagcttcatacttggcacatgataattgcttcataattattaaataagccagatctgcctgcctacctttctgctggtttgagcaaatataagtagatttgaatagcgttaaaaaaaaaaaaaaggtttcgtatcaaaaaaggtacttttaaaactaggttatttattagatcttgccagaggagtttgtggaccttggaagcctttaccaataggggagctacatgatgtgtgttaagatcagtcctgtttgaggacagagggttgatggcacattaggatgtacttttaggacataaaagggagagctttaggagttatgaagggacagtcagtaagccctagtgattcacggaatacagtgatgtagaagaaaatacagcgatgtagaagaaaatacagtttttaactctgatcatcaaaatcaccagcaacaacagggatgccatggctgagctctggagttgcaagaagacactggttagattttgcacattatcaaacatagaattctcttaagttcttcatcccttgctctttccttgccctccaatcttttcacttcagtattcctcctttgcttgaaatgtcagattatgcctgtgtcagtaaggaaagtttctgtttgagtcatttgaccaagtcaacagtatttacttggtatccaactgtgtgccaagcatcgttgtggacacaatgcccaaacttgactattgctttgctatctctttgcgtgttcaggcaatgagtacagagctggt

SEQ ID NO: 73417 - DNA, 1073 bp, Homo sapiens
caagtctcagccaaatgattgtttcagtgctttgttggtggacaccgttattctttgtgtatggctggtcatactcaaaaggttaaaagtcttcaaaacatgacgttgtataaacattgtgtcccaacatttcatcctcagcttctcataaatcaggataaacatatcatttgctgtttcttttgtctttacaattatttgctgtagccagtgttagtggcttttaaaatgttattgccagaacttgcttctagtttatctttttcatcttgtcacttagttgctaacactaagtgttagggagagggggctagagagagaaacacatagcacccggcccaggagagggagagagagtgctaagaagaatctgaaatggcctttgaaattaggctatggttagttgctttctccatttgtctcctctagcccactctgcacctctttctattgcaattctgaccagacatctggtgtggcataagttaacttacataacttccatactcaaccaaacaactctggtttgttcatttaagtcatagtaacagagaacttgtacttcttaccgagcagagattggaaactacctacttataaaagccaagaacaagacagtttcttcagagtttcaagtttgtgcacaaggagtattttgtggactaggaggcatgggtctatatcaaagcctgctgatcctaaagccagtgggattgcttaagaagagtatctttagctggcatcttcagtgtgagtgaaactggaattactcttaaaagctgcataacatctagtatcaaggagactgggggggaactacactctggtttcagctgggccttgagataatattgaatgagtccttaaggcagcaaaaaaaatatttgatgccaagaaggaagagataagtgacttgtaaatggggaaagagaatttgagtaaaatgattctgggctttgggaccgaaaggccaaatgtttgctgtggtggttggagttccatcagtagtacaaaactgcttggtaatccctcgtaaactggaagaagagaggagaggccagtattttctgatc

SEQ ID NO: 73418 - DNA, 1383 bp, Homo sapiens
gaataaaaccagaccaaaataaagaatatgcggcattccatccatcttgtaagatgtgcacaggatgttgggagttggctatattcactgtaaggaacagttattttccagcatcagtgaaggggacaggaagggccagaggaagtaaaaatcaatagaaacattcactagtgtcacttgtcctaaaatcagcaaagaatttgatttattttagcagttggtctttttctctagggtctttaagaaacaaatttcactatcaataattagcccctcttactagctaattaagcaaactgaaatgcagtgccaaagttacaaagagctttagggttaaagaatggttatttgacagtcatgagaggcttttactaatctccgagacttcatgactatataggatggtgtctgaacattttaaatgaatgttggtgaaataagcagagattcactatgaaaccccttatcagctaaaatacagtaaatgtgtctgtattagtctgggcaccttggcagtgtgagaaatgagaccagttgatgtggatgagtctggttagatgggccaggctatttcagtattttgaaactgcaactgaagagtttcatttaaacagtttctctccatcagactataggagtggtccaataattgacatttatatgtttgcacagccataaaccaaggtccatagcctatgtcatgccccagcatcagcatcttttaaattttatctctggtaagagttgacatttcaaaagaccaacatatgcgataaaaatgagaatatgggagtcatctatggttttgcatttttcctcccacttgatcttgtattacagattcctattattttttattgagtagctattgaaatattacagaactaatgaaatgaacctagaagtcaagcacaaagggattctcctggtctttttctactcccctgaagtgttgacagctgcttagtgccattgagggacatacgccctattttcccaaaagttgttctcaagattgtttataggtggcattctgtaaaagggttccatgattaattatatgtgggagatgctaaacagttttgcacttttgttttcagtaggggacttcttagagctgctaatctgctaacttttatagtgaatctctacaggacaattataatacatagcgtttaaccatagaaccacccacaccattctctgtcccagatttacaggattagcattttgggaacatactttgggaaactgtagcccaccataaactcgcttgctcctacaatacaacattctatatacaaagcaaaggggtgatactcttcctaccctccctcctggcatactctccactcttcttccataacatcttctatgggtttt

SEQ ID NO: 73419 - DNA, 1074 bp, Homo sapiens
ttcagaaacataaaagccatcttggcctaaccacagaaaatgataaaaatgtgagttgctcattaacatttttctaacacatttagaacacattctttaaaaatgtacttacaaaatttatagtatccaatgctgcttactgtgtagctagggaaagagtggaaaattctgtttttgtttttactggaggctcaggtagctgtttggaaaattcttaagactcaatatgttaccaaactttaatttgttatatatatttaatttgttaaaatatgtaatcgctcccaaaataatattcagagcactgccccattttttcagtggttcattttcagaaatgattctagttaaaactacaatccctccttcagccagtatttcctaaacttcagtgatcatagggtatgtgttaaaatgcagattctgtagcccgggaatcattttcaccaagcttcagagatcatttcccttgaatgcctttttggactgcactttaagagccacttttaaatgacaaagtcacaggtttttattacaggctttattgaggcacaattcagagtaatatgaatgtgtctagtgttgcatgactgtattctgtatacttaggtgtatcagttatgcaattaatttgcctcatgggctagaatctacaaagcaaatgagaggttagtataaatgttctatgtgctaacagtttcacagattataagtttagcaaataggactaagtgataatttagaggaattggctgatttttgtaagctaatcattaaccatttttaaacagctccaaagatgaaaggatacttgatgacacagtaaaaaatgaaagatttagaaccagaagaaacttaggaaatcattcagtccaatcctttcattttagagtgagctgtgaactcacctgagatcacacatttgaaaagcagagttgagaatattctgattgaaagcccactcccatcccacccctctcctccattcaaacactgccgcctttcagaaagtgtatgctagtcagctccaacatgccactgggaggtatctgtggcatgaatgttaaaatgatc

SEQ ID NO: 73420 - DNA, 1407 bp, Homo sapiens
tcatatgcagttctttaagctttgtttacttctatacaaatacttttaagtaatgcaagataacatttaatagatggaattgttaaggtaattgcctgtagtcacattgctaaattcattgagagttacacaaaatccagaatatattgtctgttcctaaattatatatatttagattctggaattactaggaggaattagaagtcattcagataaaaattcatacttaacaagagtatctaggaaagagattcagcccatcccaatattgagcagctttccttatcagaaagttttattttctgtttcacagattgctcatgacctttaatacatttttctgaatgaaccctggagggaggtgagaagtagcagttttgttcatctcttctttttgtcctttatctctctgccactgttctcacctcatcctaaaacctggtcaggagggtttgaaacctatcagaactaaaggttaatatctcatctccctcaggcttttttcatttaaaaaaaaaatgggtatattagttaaattagaatacttgttgtagaattattgtcaaaggggaagggaaatacatctaggggaaacatcatgtcttttaggccctttatgtcactgaatgacttaaggctcgacaaatgatattcttggaaagtttaatcttgaggttttcaaatctttttttttaatgtctcccatgtttctcatttgctgattgattcattagttgctcttagtaagatttgtcagttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaactggttttggattatccttatattttcattctgattactgaggcagttctgaaaactcctaccattgaaatagtggtgtgtcttttccttgtttaaggattttacatcatttttatgcacttgaattccaaaatcagaatctctcttttacctatcaacctttattggctattggcttttggcaatgacctttctgttcaaatgtagtcctgtctctttgtttccttagggagtagaacctgtcctttttctcatctttcatttttttgacgtgtcctttctaagagaaggctctctgccgcctgttctgggtgataagtgatattttcatctaatcgttatgtggttgggatgatcatggtgaaatactaggaagacatactctgttgatggactttttctctccaaataatcccaaatagattattttctagtgaatggtttatatctttctcgtcacaaaaatgttcctttgatttctagcacaaggtacagcaggatgc

SEQ ID NO: 73421 - DNA, 1031 bp, Homo sapiens
tttaaatgctgctgaccaattttcatttcttcttccattttgtgggagattatattcatactttgttcacattcctttcaatattcagcttacaaagagcatgagaagaagctattgaagtatttgcttggggagcccaaatttcactagagtgtttgcagcccttgaatatattttgaatatattagttttttgtttttttgtttgttttttcctttttcttttcggttgtggaaggaacaacctctttcccattgtttagccctagagtgttttagggacaaactataatactgtactaggataataatttgctaatctttcaacatattttatattgtcgtagtattgatttttctattttcatttcactttgaaaaatcttcccaaaattttctctcctttcttaaaaaaattatactgatatatactattcattaaaaagtaattgagagtactatttattttttcatacaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtaca

SEQ ID NO: 73422 - DNA, 1986 bp, Homo sapiens
gcttacaggcttgtaccctggagattggcctaagatagtgataaggagagacagcgtgaatggcatggttgagtctcacaagagtgcaagggagtaattttgcaatagcactaggaagtgaaggaatcagtgactccatgtccttttatgcctatggagattgtgcaagagaaagcaatttctacttttggtctggaaaggagagcagtctccatacaggagagctgggtttcagttaaagcataagttgttgtagagaatattcagtaaagaggagtttgcaaatcatggaatcgaatttaggagagagtcaggaatttgggggatttgtgatgagtgtataggggaatatgggtaaactaagtttatagtttggacaggaaatgaggacagtagagatgaattcagctgggatcctggaggttggtgagcaatcagagaacttaaaattcagctgctttctgtggggcaagtctaataatctggtgttaagaggaaggcttgcgagctttcagttttagtagtctaataagctgaagtgggcaccaggttgctctgcactggtaaataaatgatgactagattctctagttagaaggtatactgtaaaacattacctgtttggtggtatgttccctgcagaatttggaacagttaaaggcagaaatataagtggaaagtaaaaactacccagtgtttacttttgcctctaaatgataccagatgtataaggcatatgtgtgagttagggctctctaaggtagagatagatgaccgtgataattttgatcatagatatttcattgaagtatcaagaacctacttgtttcaataaaattgctatagaataaaccagaaaactaaaaactacttgaaattggctttattttttcctccaagggtaaaaattgtaaatattttgtaaatactgtgtatgtgtcacattgaaatctaccgtatctttggcaatgcttaaaaactatatcacattatttgttaacttgcattagtcaaggaaaacagttgacttgctgtagtaatgttcttttgtagctttatttactgtatgctttgagactggatcccataattttttccccgtatctttgtttttagtttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaagtatgtataataagagacgaacctcagatctgatttctgtatgtgctcaaaaagcaaaaaagaaaaaaaaagtcaagtaactgtagtaaaagaatacatatgattctagatctgtcttgaacaacatctcagttaagatcctttattcatctgaccaacaccaaatatcttctatttccaaggtactaggtatggtggtaggcagcagggactgagagcagagcaacactgtacagataaattgacaggaacccatagtcttgaatattctgaccaacgatggaattttaatatagcagctagctcacaagagatatagtgaaaattaaatgacttcatgtctgtaaagttcttgtcatagtgcctaccactatgtttagtagttaaactgtgatattataggatatgtttaggccaaaaaactaaagttatgaaagctctctggtatatgaacacaaaagaacttcgtgggaaaaagttcagtattattggcattca

SEQ ID NO: 73423 - DNA, 1012 bp, Homo sapiens
gtaatgtgtgtggactattatcagagaggagcaagaatgaatgtagggaaaccctaatgaattaatggacttatcaattatatatagtggtcatacttacagcatgttaactgaagggaaacaaaatattatatgactcctgatggaagtatccaatactgcctttgaagttgtcttacccaaaaaaaaaaaaaccaaacaccaaaattgaacatcaatgtaatcaaaccaatttataggaaatacaggggacagagaaacatgtgggataccgttagtaaaatccagattgtagaaaactctacaggacaaagaatctgttgggtttttttcctggaaaaaaaatattttttccagaaaaataaaaggggtacggaaggattttacagattcaaatgtagtttaagagatatataagccagttgcaatgtataggccttaactgtactcagaatcaaacaaaatcaaacttttccacaaacagaaaacatgttggagagtatggacactgactgtatatttgatgttattaaataattgtgcatgcacaggaatcagttgggaaacccggggaacagatgctgctgacctgacagtggggtttcaagaagaatatgtatttgagaaatacctggacataccactgaaggacttggttactggtcagatgttgggaccagagcaggggaggagtcagacgtatgtcttgagagacactgggtgggtggaagaagaaatgataaatgagtttagtttagaagtgcatattaggtcatcaagtggagatcctaagttagaagatgaatattgagtttgggctcaggagaagaggattgggctagaggggtagtatgagaggcaggttactgcctattgcactgaataaaatctcaccaaggcaaaaagaagaaaaaacgctcagaacagaaccttgaaagtgccaaagttaagaggagaaagcagaaaaggagattgagaaggaagaattttagagctaggagaaaatagggga

SEQ ID NO: 73424 - DNA, 1060 bp, Homo sapiens
agaatatgttggtaaagaagactgtctagaataacactaggtagcattcatatataaggaaacattatttgagaactaattggaggttaactttttttgctgttgtattctttttgaaagatcaagtgcacagtgttcctatagcacaaatggggaactaccaggaatacctcaagcaagtaccttctccactaagagaacttgatcctgatcagccacgaaggttgcatacatttggcaacccctttaagctggataagaaggtaattttgaaatgttctattatgtaatttgtttatggtaggcactgtcagttttatagttcttaatttaactgaagtaagctgaagctattttcctggtagagtatctaataaatatgaacagaatatagttaccttcattggaattgacactggttgtgccatttaaacattgtttgtaaattcaagaaagttgtattcttttttgctaaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaagtaagaattgtttttttcttaaacattatttgctgccttttggttccttttcaaggaagatatttttgttatagattatagaaggaaattgattagtagtacaatgagtgaatgaatgtatagaaaatttgtttaaatgagcatgtaatcatttttgtatgtctttttaatgaacatttgaacatttcttatttatgatgctttattagctattatgttctaacatacatttgcaaatctttcaaaataatactttcgaaaggagcattatcactatccacagaaagatggttttcaatttcagttgaagtcaactaattattaaatatgtatgctattttggataatgct

SEQ ID NO: 73425 - DNA, 1059 bp, Homo sapiens
gcctggggataggaatagtgattgactgcaagtgggtacaacaaacttggggatggtggaaatggattatgatgatggtttcacaactataaatttactaacattcatcaaactatatacttaaaataggtgattttatggtatataaattacacatcaaagctgttttttaaaaaacttcagtttttaaaatttggagattgatttttacttaaatgagtttacttcttttatccagaatatataataaaatctttagagttagatggtgaattgagattgtttggttgagctcactaccaaattttcatcttttggccctgaaccggtacattaagattatatcatatgtctttattttattttttttaagctaaccagtttatatatcttatttccaaacctatgctgcaggctagagattttagtctcttgtaattctatgtttgacaataaattttgtcctcgaatgttgtttaataggatttgaagccacagacatttagaaatgcttatgacataccaagacgaaatcttttggatcacttaacaagaatgagatctaatcttttgaagagcactcgcagatttctgaaaggacaggacgaaggttagaacatagtttcaatactggtatttttaattttttttctttatagtctgaaaaagcatagcatggtgatgtaaatttcaaagaattattacagtactataacattcttattgtaagttcaaacaaatgaagtaaaaggtgaatcatccctgattctgtacctttcttcctaccatcactgttgccccaaattctcttccctagaggtaacaacctttcttaacagtttagtttccttttatagcttttctcatgcattcatgcgcgcacgcgcgcgcacacacacacacacacacacacacacacacacccacttatcaaactgtatacttaaaataagtgatttttcttatctcaatcattttcttgagataataccagtatctgatggtttaactctggatggccagtttcatgacattttctgataattccttcttcacctt

SEQ ID NO: 73426 - DNA, 1982 bp, Homo sapiens
agtttttgttgtattatttcccaaatctctagaaacactttgtaaggtggataagtgtatattcttatagaaccatatgctttagaggacttgattacttcaaaatagtgtatcatagtaggtaaaaccaataatgtgcattttattaaatacatgatttagtttgtgaaagataactttttaacaaaagtacttaaaatcacttatgtattctgttttgatgcaggaatattatagcatttggctataaataatctttctaaatcatccctaatataattaggagattaatttcttgagctttaaaaatcatgacattttatagttctaacagataagttgtgttgaatgtctagcacacagtgcctggcaagtagaaggacaaaaaagaacaaacacttcgaacaggaactgttacatatgttgactcatttacgtttcatagcaaccctgaagatttagccaagccagataggtgttaaatatcagggctgggatttgatttcagtttgacaccagtgcttatacactttctaatatgtcaatgattatcatcctttttctggctctatccgattcacaaatgctagacactcttgctagtgatatttttcatcgtataaagtacttctcagtctctccttacaattgaaagttttttttaactttcaactaccacatccataataaatattagattgttttttcctcctgcttatgtttccttcagagctttttttcagctcagcatatgataataatagtaatgattaataatttgtacccaatggttttataaagtgctttatgtgtattaactcatttaatcccatgacaaccctgtaagagtaggtattgttattatccccattttacaaatgagaaactaagccacagagagccagagagcttatttataatctgatctagaatcatataactagtgagtggttgagcagctaattactcaaaagtagaaatcttgcattttccttgagtgtttttcacttactacccatgttttatcagagctacctctagaatgtgtcttctgtccatttattccaaacctagtttctcccagtggtaccaaggaagaccagtatcttatccttcttgtcttggggagttattatggcctctaatcctttttaactacttcaaacggcctttcatcccactgacaaacattttactgaaacataaatacgattgtgttacttccttattgaggaaaagaaggggaaataattttttggagaaaattttaagacagactatacatggaaccataagtttttaataagcttaatattgaatgatgttttcttttttcctatagcccttgaagaaagctgttaggatgatgggagcacctaacctaatagcagacagtatggaatatggacttagttacagtgtcatttcatacctcaaaaaactgagtcaacaggtaatatcaagaaatagagtgagccattaagtattttgaatggttttggctaggatggttaaacaggttaaaagctagttcttgatggttctaatggaattccattatattaatatattacattttagagccatatattacataattctgtctcacatccatggtgtgctatgttttgaaacattaatttgaaaattatataataattcctaatttatgaaaatggcttcatgagtgtggtcctagacttgctatatgtgaacattatttatcttttgagaaatttagattagaaagtcatttttccttaaaaaagaaaaaaaaaactctttatgttttgaaacctgcagatttttctttcagaatgggagtttctttgaaatgtttgtagaaaacactgaattttgtcattctggccataagtcacattaataaatactatagtagtcaagcagtatatagtttaactgactgtgaaattattaatgtcctatgaaatacattatttctccagtacttctgacattgc

SEQ ID NO: 73427 - DNA, 1036 bp, Homo sapiens
ttgttccaaaataatttgataaaagcctaaagttagtttctgggtacaatctagctatcatttttgaggagtgctgttggagaaaacttaccttccatgaaatcacattaaatttaaaagttatagtcaaaatattagtacgtatattttatagaaaacattgtgcatgctttgtttctgtcttcaaatctgctttgtgtctaggtctagggagggcatagattttccttgtgtgttttctgattctaacttaattcctgcatgtacttttagaccataattggcatcttttcattttatagaaaatgacaaaaccgtaaatcttactttcatgttaaaaaacgtctgatgttactctctcaaaaataacaaagcagactttaaaaaggaaacgtctttgacttgacttctatgtgtgaaaataatgagtagtgatagtttgttcacattatacgtttctagatgacttgtttaaagtgcataaagcaaaaccaacattgaagtggagacagtcatttgaaagttatttgaagacaatgcctccctactatcttggggtaagaatattatttaaaagaacttgttggccgggcgcagtgactcacgcctgtaatcccagcactttgggaggccgaggcgggtggatcatgaggtcaggagatcaagaccagcctggccaacatggtgaaaccccgtttctactaaaaatacaaaaattagctgggcgtggtggcgggcgcctgtaatcccagctactcgggaggctgaggcaggagaatcgcttgaaaccggaaggcagaggttgcaatgagccaagattgtgccactgcactccatccagcctgggcaacaagagcgaaacaccgtctccaaaaaaaaaaaaacaaaaaacttgttaattatattatgcttatggtttattgtgggtattataaacttttatttattgcttttatagattaaatgacatgaaaattgagcatacagatgaccactataggtataaaggtaaagagaggtttcagtgatttgcaga

SEQ ID NO: 73428 - DNA, 1030 bp, Homo sapiens
gttatgtacatctacatttataatttgtataattagaaatatatagtgtgttcaaaaactgatcaagatctatgattactttggaagtcgctactctctataagtaattgctacaaatgaagacttgtgagagtttctatatacatttctaattttttggatgtaaaaattaatgaatactcaattactaaattttgcgtaagacctaaaaatattttcatttctatagattttcaagtgtttatctttttgttgtgaatattacataactttagcattacattttcaagtgtttcctttcagcttaatgttgcttttagcagtaaatcaaactcttactagcaagacggaggaactgagtaaattttgataatgaggaatatttagttttgtttctgaaatttcatgtaagtagtaattacaagactttcccctttagccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtaagctgaacaacttacagtgaccccaaaatttaaatgaggcatttcttaaaaagctgaattgaatcaatggtttatgtaacattctttaaaggttattaaagttttaaccgctcctttttaacaggtgtacgtgagcaatagtgcaaaatacagtgaacttggtcatccttttggttacttgaaagccagtacagcactgaactgtgtcaacttatttgtgatgccttacaattatccagtccttcttcccctcttaggtaagtcattcttgtcactttctccttggcttagcatataaaagttctcctaaagcgcatttctttgtagtttttcttgtcttctggaaatcaatgaaaatattttgaatattctaaaatgttgaacatctttaagaaaatataacaatctgttcgtgtttacagtaaattaaaagat

SEQ ID NO: 73429 - DNA, 1020 bp, Homo sapiens
gttttgtggactgattcaataaactgtgtgtcaggtgcatgctaggcacaggagcacaagatgagtaaaacagtgcttcccctctgaacattacccatctatgggcatgtcagacacgtacacatcatagagtacagtgtgccaactgtaatggaggggtggggcagagccagaggaggtgggcctgacagcctggtgtgtttttggagtacagagtgggaaggggtatgagggaagaggtcttttagaggttgttacatgccaactcatttttctaaactttgtttgcaatatgcaagggagaaaataagtacttggcatggctgaagtatggagtctgtatggcgtggtggtgggaaggcagatagggaccagatcactgaagatctttatatgtgatattaagtgtctagaccctatttttaggtgattggctgttacttttaccgaacagttttagatagggaaattatatgatcctatttatatttcactgccatggattgatcagacagggactgattagaaactaaacaaagcaaaaagcatttgtactagtctaatctgagaaatgatgaaggcccaaattaaagtggtaagaaatagaagataacatttctagagagatgagagtttagtattgacagaaggcagcaactagtaatgactacctaccatgtttatgtgttctggtaagtgccttagaatttgtgatatcagtttatccaggtctttgtgacagttaaatatggaggatgaggggaagatatcaagaataacggctaggtttttagaacaggttttgtagcttgggggagaagaaacaaattgtacatattgtgtctgaggaacctgtggaagattcaggttatgtctagtgggtagttagatacagcagagaaataggagccatctggccccaacagtagatttgtgaaccaccagggtataagcagtaactgaggccaatagagtcctttatagctatgacatttaaaattatttcctcatagctcattt

SEQ ID NO: 73430 - DNA, 1060 bp, Homo sapiens
caacaaaacctttttgaaaccttttgtacttcaaacctgtatcagcttttcaggataatttttattttgagtttataaagtgatatttcctttattcattagggatttaataaagtagtgcatgaagttaaggttttctaaatttcattgaagtatcttcattataccttttctttttttctgatagaaccatcatagttttttagtctggctttatggagaaacttccaatttctttggtcattttactttcttttctggagctctttcaactcttacagaacagataccgtatttgtatgaaatattgtcatgttggttatttattctatttatttaacatgtacaggagaacatacagtacctgagttgtaatggaaagaaatccaaaaccagtatcagaacccttatctattaatgctgctctagcagtctatcacaaattcttagaagccatagagggtaggtaggacttcaattggagaaggaaatagtatgagaaaaaaaatatggaagtgaaaaagaacaaggtatgtttagaggagtaacaagtagctgagtacgggtggatcataacatgtatataggacattgagagtactattaaactaaccaaattgcttatgactttaaatgcagggttaaggaatattagcttttaaacagtggagttcaaagagcagtcgaagatgtttttaacagacatctttagaaaaattgatttggtggtggttatatgcagtaaaattagaaggggagatgagttgaaaggcaggtaggttacctatgagggctattgatatggttcacgtaagagattttaagtggttgaattatgatgatggaagagagaataataaataatattggaaagaactggcaaactttagtaactgaaggatattaggggaagtgaaatttttataaattacaatattgaagaaatattgctactgaagttaagtgtaatttacaagatgtgaatttgaatcacggcactattagttattaattagtacctttggttatcttttgtaagcttcaatttcccatctgttaa

SEQ ID NO: 73431 - DNA, 1226 bp, Homo sapiens
gtaatcccagctactcgggaggctgaggcaggagaattgcttgaacccaggaggcagaggttgcaatgagccaagatcgtgcctctgcactgcaacctcaaaaagaaaagaaaagaaaagaaaaataacatatctatcacagggttgttttaatgattaaatgaaattatttatttggaagcaattcagcacccagtaattaattgagtctaaatctgaaattcattccaacaatacagatttttttcagtctatatcttcaaagtaagtttaagaaaattaaacagtatcatgtgctgttttagctatgtctgaacaagtaagcttttatatttgagcttgtttttcaagtgataggagagttgatgcagttctaacgtaagtgtaattaaagtaggctttttgaaaaaatagtctgtggaattcttattactgtttttcccccctactttcagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggtaagttttttgctggcagtaatttggtaacttaaagcagattttatctgaatgttttaaaagtgtacattcaaaagctccatgtttgtttttatttcacaagttaatattaggaattaggcatatatgcttttaatagtacatttattgctaatggtctatgatcttcatttgaatagaatgtgggttactattggacatgacaaggaatggtaatattttttctacttgtatagaaaatgctattatttgaagttgttaaactaattttcttatctacaaagattgccaatgatttagaagtaccatagcattattttttgcaaaaacagtcttgagaatcatctctgtgtatttgatgaggtatgcttggttaagtgcaatttttcccagaggcaaagagattgatagattaaaggaaacagatagtgaggtcttatccagcttctgtttcacttatacatcagattaggtaggtactatgccaagtgaacatcaaggaaaatcttgaaatacaatatgtaatcaactcagaactcatttaatatagaattggctaacaggtggattaatttcatataggtatg

SEQ ID NO: 73432 - DNA, 1035 bp, Homo sapiens
atggtagccagcttccatggaagtggaaataaggctgctaggcctagtaagacttagactctgaatacctttgagtgcttcggagtactgtgccatctaccagagtaaccaagccaaaacaaaacaaaaacccattgatgacttagtgtaagagttgtttatgaaaaaaaaattaacagtagggaaatccaagaattgataggctaagtataactccaaaagacagatacattgagaggactggggaacgaagaaaatttcctaattattcctctgcattttctttaagcttgacctcaactgggctgctgatttcctgaacacttcctctttctttcctcatgtactccttttccctggacgttatttctctatctccctatattaaaatccaacccatccttaaaggattaaaggctttcttaaaaatctttctctcctcctttgcactgtattctccaccagttctgaagtttaatttagttttcatcccagtatttattattattatttcttgtctcctatgtgtttgatcatgatcttcactcttcattactccctaacttgcatgaggttctggattctcagtaaacttattattcttcacacttgctcagatgctacttcctctgagaagtcttccctggtttgtcccctaatcatttattcttttgtactttatgcatatttttattgttgtacatatcataacacataattgtttacttacatgtttttgaaagtagaagattacaatgtgtaatgtgttgcctttcattaaataaatcctgagttatagcttgatttctgatccctattttaattttttttaaaagtccccacatgttgacaataaaatgtgtatatttatcatgacctaattatttctttgatactgtgctgagttcattggtactaggccactgcagtaaacggtaaagaaaagttatgatttggtatatgaagttaaaaattacaagaaataatatatggtcaagttttttatatctcttaataaggcaagaatgaatatat

SEQ ID NO: 73433 - DNA, 1054 bp, Homo sapiens
tttttcctctgtatttggtatcagtccctggatttttgcttttatgagtctgtttctttcattcctattatttttgttatcaatcatcctagtgcttttttaaatgattgtgttagctttctagcttgtcttggctgctttcagtctgtcctgcaggttgcaaaattattttaaagcataccacttgagtgtattactctactgttcacaatgtttcattgctttccattgtctactaggttgctcagtgcccttcacaacttagccagtcacattatttattcatccatccatgtattcattcagccatatttattaggttctatgaaccagacaggatggaggaatatgtgctatgagagcttataatgaattagatctggtcaaggaggtcattggagagccaagatctgaagagagtaggatttgttactcaaaaaatagaaaagaggattgtaccagacagagggactagcatgtacaaaggcttttttttttttcctctgaaaggaatatattttgagaatgaagaactgaaagaaggctactgtggcttagacacaggggtgtccaatcttttggcttcccaggggcacattggaaggaagaacaattgtcttgggccacacataaaatacactaacactaatgatagctgatgagctaaaaaaaaaaaaaaaatcacaaaaaaatctcataatgttttaagaaagtttacaaatttgtgttgggccacattcaaaaccatactgggctacatgcagcctgtggaccacgggttggacaagcttggcttagagcataaaagaagagggatcgtagtacaagatggaaaagaaggttggacttgaccatacagggggcttccagaccatgctgagtaatattattaatataaaagcaataagaagccatccaagggttttatttagaggtagggggtggaggagagggagataaaagtggtctccgttggagcattgttgtttagtcttgacaatagcttggtcaaggaggttggtgatggcagaagagtttcagtttcaagagatac

SEQ ID NO: 73434 - DNA, 2028 bp, Homo sapiens
ttctaggataggcagatctgtttagtatacctttttccactgcatcatttcagtttggatattcttgactttcgaattgttcttggaaataattagaaagaagtagggattgggattgttggacggtgaaatcatagggagagaaaggaagttgaggaattcaatcttgagtcttagaactgtgtgtgtgtgtgtgtgtgtgtgtgtgtgtgtgtgtatagaagaactacatacatacatatatagaaggaagaaacggaaatgaatctataaaggcctgatagtacttacatattttcttgttattgtctgttatgttatgaataggacctgcggctgtattatatttgagaaataggatttaagaaatacccactcagtttcaccaaaaatgttaaaattttatttgctttaaaaaaagcttttattaagcttcttttccatctacattatccaagcaaatctgaataattgggactagagttggactagatgttggagggaccaactttctatttattaaatcacggaaagatttagcattagtttgattagaatgggtgctttcctgcccttaacacacatacagtgcctctttgaatgcatattttctgcaacaaagaaaaacaaattaacaaacaactagttgaaccttcaaggattctgaaaagcttctggcaaggtatattttttaggatattggttcagcttctctattgggacaaaaatagctggtttaaaaatacagaaggcttttcctttcacatcaaagatagaactggtagtagtcagggaagtggagtggttctgctctaagctattgtctagggttccaggtttcttctactttgttcctctatctttgcttttatctgaatggttgatgctggtttcacagcacatcatacaactggatttcagcctgtgggaaggagtaaaggcacacagcttcctaatataagcatgacctaaaacataaatgacgttgcaatgagactccatcaactagaatttggccacacttagctgtaaggcagagtggaaactaatccctgcttgggtggctgtgagtccagttaaaatttggggggtttaattagtagaaggaaggagagactagatgtggacgggcagttatcagaaattaaaggggtgataaagtaagcttgaaagcttctttgctttctagtgtgacagcttgttctgagcttatcttgtacatttttgcttcagacctgaaatcaggtcaggttccatgtattaggacgtggtatatggaaaccatagcatgggttttagaaaagggtgcattgccattgagttaatcatcattttcaggctttttcagtacagagctaggaaatatttttttctgaaagagaaaataggtcatgaatccatactactatttgcatttcacttttaaggtagatatttaaaatgttaaagaatgtgtttctgtcataaaaaccaaagtttgattcctggttctgcaacttattagaggtataatttttttgctcattttgagtttcagttttctcatctttacaatggggataataactacatctcatggttgtcatatgattaaatgagataagtgctcagaaatttttactgattttattattctctatcacaatacaaaaaggagagacccctaattcttcttacaggggttagagaagacttagagacacttgtgccatcagggaagattgaattttaaatgggatatggaggtttagtgagaagaaatacccaggtaagggacccagcagaggctgtgatctgcatttgtcaaggctggtgcataggattctattttgaccctttaaaaaaaaaacttttttcttatagtatttatcatagtgtgtaattaagtagtagtttgtgtgcttatttgcttactgtctgactgcctttctgtcccacagtgacaaggaaggactatcctgtctttctttttgattaccattataccttcagtacctgccacataatagtcacacagttgctgttcag

SEQ ID NO: 73435 - DNA, 1002 bp, Homo sapiens
agatgagaggaaaaaatttatacaaaggaaattctgatctttgcttcttgaataacatggatcatgatttatactaggggtcagcaaacattttctttgaagggccagatagtgaacattttaggtttttcagcctgtatagtgtgtactggaactattccactgttggagggcaaaagcagccatagacagtatgttaaatgagtgagagtggccgtgttcaataaaattttatttacaaaaaataggctctgggctggatttggttggtgggctatagtttgctgatcgctggtgtataccctgttttgtagactactgttctagaccttggagttgtattgtactacttctgttagatccttttcacattagttttagagagtggactttatggaattgatttttcctttatgaagtgggtagaacaccactagtagagagtattcagttaaagtgaacagatgcttattgaacagtagtgaagttcagatgcagggttaggtactggctcatgagtttgatatgagaggtacagttatggcatagtgtaagatgtaaaattattaaagcacaagctaataagatggtacagttgagaaagtgaggccggagctggctctaggaaatgtcttgagttggattttgaaaggttaattcaagtttgtgaagtagatgtatgcaaagacataaaggtcactgaagagagtttgggagaactgtatgtacctcagtattgatagctggcaaagtgttcaagaaaaacagcagcaggaaatgagactagatagattggcatggcacgtcctatattctctgccaaggagtttcgactttgtcttacagattgatgaaaaccttatagattgaaccttacagatgggaaccttatggattgaagagattttagtagaggagaaagttattagatttgcattttagaaagaagtagcgtggactatacaaagagcaggtttttttggcacctcatctgttttcact

SEQ ID NO: 73436 - DNA, 1054 bp, Homo sapiens
aaaatagtttttattcagagggtgaagcaatttcaccctgtgtttattagcctgttagaaccaataagcaataagagagtctacatatgtaaggaaaattttatttagagatgtttctattatccaattctagctcttatatatataaagtactgtggtatttagaacagtagctttgaaatggctgcaggctgcatcaaaatcacctggtgtgccttatagaatacacatgcctttgttcttattctggaaattttgtttcagttgatctgggtaaggacctgggaatctgtatttttacagtgtctcatgtgattctgatgtacagtcaaatttagaaactatagttttagaacacaatctaaccacaattttttttaagctacacaaaaagcatgtgaaaatgaacaactttaacaaaacaggttagaaagttagaaatgtttttgacttagaaggccaccaaaaagtatttttttaggataaaaataattcttgacctttagaattgttaaatttgggaacgggtttccaagggatatggaactggccttctgtgaatatttttaataggataatttctaatttgcttgatattttagaataagttattgaatagcccccaaaaattaacttctgtgctgactgcagtcaatctgcagttactgcttacagtgtgctatattgaggactctccttagaccccatatatgaggagagaggctaagaagagaagagcagttaatttatattatctgtcatgtgtttcttatccctggcttaggaatttttatccaaaggatggtatagtattctggtatccttactaagccataattcctgatttggatgtccatgtaattagcattatacacacacacatgcacacacacacacaccccctaccttaccagatgagagcagtttataaagaattggtgatagttacacttaattttctagacagttgctgcaaaaatacccttccagaatgaattcgttagattttgaattgtgaaagtatattttaaattaattcagcaacagttttcct

SEQ ID NO: 73437 - DNA, 2032 bp, Homo sapiens
gaaaaatgtggtgccatattgtctcttgacctggctaagtatgtataggcccaaatgaaccaatttcttataacttgtttgtcagaaaaatgtaggaatactgttctctgggacagctcgtcacttagcaatgtgttatgagttaggaaagaaaagtaatagatacattatgaatgaaaatcttgagctgtatatgatcattttacattaatttatgatttcaattatatccttgggcctcatttaataaaagtccaggccattgtctgaagtgtcatgaatgtatttctagtgtagtctttttggataactgtctaggatttctgatgattacttggattgaattttatgtgtatatatttggctttttttttaatgcagctatttgataaaactggttgtagcattttcacttacgaggagtgtgtttgataggactttgaattctgaaacacgataaaactatattacttacttccttagtagttaccgttgatgttgataaacatacctgtgtccagatactcagtactgtttgtcatgttatataactgatatatcaaatgttttggtagaatcaacaaattagagttattgaaaaggattttcttctgatatctgcagataatcctctctagtactgctttgcaatggaaaactattctgtactatgattccaggaacacatggctaatgaatattgctcaatagaggagcccagaagaaatcctgccagtactttcttagtgatgaatgacattccaggatagtgtagcagttatttttctcttccttgaaagtgctaatagtagtattgtctttcaaatattgagatttctatatgctgacaagtccttctgcatctctttaccaatgttatgattgctgtggaggctaacgttgagagaaggtatttgcagccaaagtaatctgttgggaagagttttacttgcttattagctgtcccagctttttaagcccaactaggacaactacttttgtaacttcatgggatagatattcggtaagggcatgtcttcatagaaagagaatgagtagtctcagctgtgtattcaaatggctgtagattggggtcttctattccaacttgtgggttctcaaaaatggatgcaaaagtccaccatgctttgagatatggataattctaggcattgtaaatgggtttagtttaactggtgaagattataattatgatgtgcatttaattcttaatgattaaaagacaggccagaaatttttgaaatcagtttctagtatctgaaatgattaaaaaaccacagctccctcccctacctcccataaaatgtttttattcactaaaatcactaaaaatatttgccttagggtgtcaaaactctgatttcattgtatacttttaaatatatatttaaaatagttgcttttcctaagacacttagaattttggagaactttctcttttttgaaaagatctgtaaggaattttgagggatgccacagtggtgtgatagaaaatataaaacattttatctgtgttacatgtgtttgaattttcatgtttatcctgtagtagcctcttcatagtgatattactagggactcagtaaaaatctgaagattagctcttgtcttactgatttgcgattcagatgttctaaatacatgcataacactactgtatatgttagtctctgtcaattcatctttctaagaacatttaataagaatttgttgaatgtagaccatttgtatttctttttctactcatatttttggccctgttctctcaacccctggatttattactgctggtatgttataggaatatatacatctgcaattattagtagtttaaaaatatgtaattataataatgcataattaaagaagttgatgaaatatttcaatttaatatagtaagttttcagcaatttacatttgcagtactcttattgatatactttttttcaagatcatgtagtaagaaagactcttcagtacttctaggcaaacacaacaatggagaaattta

SEQ ID NO: 73438 - DNA, 1007 bp, Homo sapiens
tctcaaaaaaaaaaaaaaaagaaaaaaaaagtcattttaaatttgaagctctcaaattaatttttcttcttaataggacacataatagttaacagcttcattcaactttatatattaataaattaaaagtcttttgaatgtttgttttgtttttatccataatgattttgcttgagaagttatttctgttttctgttgtaaagtattcttatgtgcgaggtgatgcatttgaggtgctgtctactgcctttgtagaaatgccctttggggtacaatgtattttgtttccatatgtctggatctgttttgtttgtaaaatttgttttgtggagacctcttctagcttaaaaatatcttgaaatatacatgtgtattggaattgctcacctttcttcctatgtctttccttgggaaggattttggaaaaatagggcaatgtgtttataacctgaaactaccttgctagtaaggttaggaagattttcctgtgggcagagtttttaccttttagttctatcttttacaatactagcatagtattgacaacagagcctatatttttaaaaagtattgattataaacattggtgtattgaatctggtagtcattgagttcaaaattgattaccgttgcaccttattatctgaggtggaaggttcatttgttttaaagcaaaagtaaattattttgaagttggaacataggccggtgagttgtttcaaggttaggaatgtctttgattccctgcgtgttttcttcttaatgtaccaacgagactctcgttggagcaatgagaaagttatcctagattaatttttgctaaatgttgtgagatattgtgaaatattctagcctaaataattatgggatttgttttaaggagcttttcaattcatagaaaagcataaagatgctttttgtattgttcttctgtgtttgtattgtgcacgtgcatgaatgctagatatgatctgtattctggttcctactagggaataacaattttg

SEQ ID NO: 73439 - DNA, 1050 bp, Homo sapiens
tggcctctcaaagtgttgggattacaggtgtgagccactgcacccagctgtataaaaaatttatagctaaccttatctattctacagcaacattcattatgcagagttgtgtgtggtgtggtataatgaatataatagatttttttaattttaaggtgtttttactatggtatttgaactgctctttaacatgggctgatatagaaaggtgattgttttgatggagctttattgtttgcatttgctttagtatcttaattcccatggtatttataagggtttaattaagcaggaaaagtatacattttaagttcagtagcttttagaattactttatttgtgtgacattgtggaatacaaattggacatggagtcagggcatgtgggtcctagtctttgtttatctactttctagcagtaaactttgtaccagtgacctgacttcctaatttctatccttctccatgaaataaagagaataacatttgccttacttcatagggttattggaagtttgaaataatgtatatgaaggtacttagtaggctgtaaagagaagtatatagtattattctttcatgaggcattggaaccactaaagagatataattctctgctcttatttgggggaaaagagctaaaattgttttatttgaacagttgataataaagggaatttaggatataattcatggagatagagctgaaaaatttaggtagattataatccatgattaaataatttatagtctatatataatcagtagccttggaatgctctgtagctgaacttgatgggcttttgggctttgttagattagttgacatgtacagccaattgtggtcctgctactttcagaaacaggtagacgtggattatataaaaagcaagcaataaaaattcattttagccgggcgtggtggttcacacctgtaatctcagcactttgggaggctgaggcgggcagacatgagatcaggagttcaagaccagcctgaccaacatggtgaaaccctgtctctaccaaaaatacaaaaaaattagctggg

SEQ ID NO: 73440 - DNA, 1049 bp, Homo sapiens
tcaatttttccaatgtagtatgccaaccagtattagggttacatttataacttttttcctggagagttgatgagttaactaccatattttcatttaacttaaggtagttttgaaaatttctaagcattatatcttaagattcagaaaaataagaccagatccacttatgaatttccattccactcgtgacctgacaagtcgtataacctctcagcctcactttccccattagacaaatagaatgaaaagacctatcttgcagaactgtgataaagattaaggaatgtacaacataatttattattgtaacacaacctattaatcatttttatgtattttctcttatttgaattttaaaaattgaaattatggggtactagaggtttttttaatcttgcttttttcagaacaagcagcatggtggtatggaaagaactgctgtattagaactggctgtgcctggttctgtcactcactagcttatattgtattgaaaagtcccttaatctctctgagcatcaagtttctcatccatagaattgtgattataccaatgcttaaattttgtgaggattagaagtaatatttgttaatcatctagcaaaagtgcctgcctggcatatggtaggggctcatttatgatgatgatcatcatctccagtattacggtaaacacttaacaggataaaagctttttagtctgaaacctttgacaaaaacagaattaaggttgttccataacctatcatacagttatgtatcgcttaacaatggagataggttctgagaactgcaccattaggcagatctgttgtgggaacatcatagagtatacctacagaaacctagatgggatagatgactatacccctaggctatatggtatatgacccattgctcctaggctatacatctacctgtatagcatgtaactgtactgattgctctaggcagttttaacacttacaagcattcatgtgtctaaacagatataaacattgacaaatacagtagaaatatggtatgaaagataaaaaatggtataccta

SEQ ID NO: 73441 - DNA, 1820 bp, Homo sapiens
tagttttgtgagtttcgtacatttcagggaaattctttctgtgactacaacttttatttgcttcctattgaaggaaattgacttgtttctgttttaggaaattttaagcttcttagggataacttcagtgcttaagtgtctttggaaataactgaatttagttctataacatttaaaatgtacactgaaattcagagtgagcttaccaaattgaacttccaacgtttagttaggtaaatatgtactttcttaccacattaatacttttatgtttttcccatctctgctgcttttattttgcaacttttaataatttaggtagatttgcaatgaactttttggtttgtttctgtaaaatagtagtggatttccttctcttttatattcctttgtgatatgtagtgcaacacagtcttactgcttaaggttttcatccttacctctttgagttcaaagagatatttaaaacttgccattatttggttacctttatttggttgtcatgttgttagtgtatggcagaactattagtttcctctttttctgcatcacatttcataagtggtcaaggcatttggacatattcacctcctattacctattaaaaatacttcttaaagattgcttccttcgaaaaactgcttgtcatggagaggctgaggacatttgtaatttaaacctgtattttccttttcccagttgatatctgcccccagagaacactttagttcttgtctataaggcttaccaaaagtttgcgggaaaggtggtcctgtgctgttaccactttgaccaagagaagaacctggagattgggatgtttttgcatgtcaggatttattaattcaataacagagagggatgatgcttctcacttattctgatgaatcagcaaagattgcaaagcataatattaatgcttatgtcttgaattggcacattaaaaatgacactagcattaaaataagccactgttttcaaatgaaaatgataatttgagtaaagagtattgaattggaagaaaacattcttccagaagatttttttcatcataaaactatctgatttaaacatttcatgttttctattcacaacaaggataaatgattaggaattttggatgtctcaaatatttaatactgaatattgttcatgtgttttcttctttgtaaaagtactttgtatctgcctgtttgctgtggaatacttttattttgtaacttcaatgtctttacataagtatttcccctttcctgctctatactaggatctgtggtgttcacagtactaaatacttgtatgtaacgttagtagttgaaggaaatgagaaaagattaggtggaagatagaacgtatatattttatagaacatctaaaaactttaatgttctgaattactttcttaaatgtctgggttaatatatatatttgtatatttatgtagatatccaccattctcccacatatatgcacatatatgatttttcataactaattacaagactattaaatctatattgcatttgttaacttagttaacatacctacagataaaacatctttgaattattagctaggatgctatcagaatttgcagggcattagtaaggttaagtaactgagaaaaaagaatggttcttagtgaatgttttcctcaagcactttgggtatcccactaaaaaattccatgcctacagacattgttataaatatttaattttgataatcagtaccatttactgatatttctacagtaatggagcaatgtatagcctttagtcaatcttttcctttatagcagtactttaagttgcatatca

SEQ ID NO: 73442 - DNA, 1320 bp, Homo sapiens
gtgggagcatggcctttagcagtgggatatcagaaaaagggaaacacagtctctggctcaggcagtagtgaacttggggaggaaggtgcagtctgaggtatcaaattgcaagggcacaagaattagattacaatggaagtgaagatcagaaagattcctgagactgtggtatgcagagaggggaacttactgtggagtcccgtggtctggtccaaggacaatttgagagctgtttaagatgttactgattgaaattcctctcccctcacccactaaaaaacactgctggaaggttttcagttctttcaaaactgttctgagagatctcactagaaagatatggagaatatcagaaacctttaaatttgtttgggggaaaaataatgcaaagaaaattgcatatttctatgaaatacagttctaattctagagagtaacttcattgtcaacgaatgttttgtggtttttataaacttccaagtaaataaactcttctggtattatttattattgttgttattttagtttttgagacagagtctcgctctgtcacccagtctggagtgcagtggtgccatcttggctcactgcaacctctgcctcccaggttcaagcaatcctcccacatcagcctcccaagtagctgggatcacagatgcatgctgccatgcccagctaatttttgtatcttttgtagagacagggtttcaccatgttgcctgggctggtctcaaactcctgggctcaagcaatccacctccctcagcctcccaaagtgctgggattatagatatgagccactgtgccaagcctgtattattattatatatacctggctaaggtgagcaatatctatttgagtccaggtctacatttctggagtaggcaaacccaagcaaacagttctgttgcagaattcttttctaaaagtttttaaagggcttttttttttgttttgttggcctaaatatgcacttattcatctacataataacataataacttgtagacaaaataatcacctggtgactttgtctacaggaaaacaaatcatgaatagttctgttttcatgttgacacactcctgataaaggaaagatattggggactagagtgaaggcagctcagttgatacactaatgtctcattcaaagaaaacggaagctggaaaatgtggactgtgacttcattacatgaatgaagtatggtagtttagggggaagaggtgaggatatttgccctgtttctcattgctatagcacacactggttctggaatcctagcaaagctccctgtaggtcaccacgccctctccgaccc

SEQ ID NO: 73443 - DNA, 1018 bp, Homo sapiens
aaaccccgtctctactgaaaatacaaaaattagctgggcgtagtggtgggcacctgtaattccagctacttgggaggctgaggcaggagaatcgcttgaacccgggaggcggagtttgcagtgagccaagatcgcgccactgcactgcagcttgggcgacaagagtgaaacttcgtctcaaaaaaaacaaagaaaatactctcttcattaaatctagaggaattaaaggggtatcagttacctgggaaagcagactttgatgcagttgagactattttgaattgaagattcttatggacttcatgtcctaaacagagttgcaaataataaagtggcgactgcctcacctctctgaaagttttaaagaatgcaatgtgatactggccagattcgtccttttgggttccctcaggcctaaatggcagtcagcatcagaaaaaatgcagttaagattagactggttctggagcagccatgtggtactaatgactctaaaacttgggtggagggttgaaaaaaaagaactgaagtattatgagaaacagtccctgtttctcccattattgcagtgggactttctgtctttaattcaattaaaaatcacagctccatccttttttcttaaatttttttaagctttttttgctcaatgtagcttgatgtagaaagatgagtgtgtgtgtgagagagagaagggaggcgggaaagatggattgtttagtttcatcttcaacattatattttgggtttataaaattgcactgaaattggaggtcgttattagttctcttttcactaaagcacaggattaatgcgaagcacatttgtgctgtgattgctgcaggaggccatgtgccaaccgtgctaagctttgcaatatttgtattcctgaagatgatatttgaattttaaaagaatgtttaagtggagcagttgacattcctctctctccccccctccttttttttgagtcccttctcctttagttaatttctctttgtttttattattgtttttt

SEQ ID NO: 73444 - DNA, 1007 bp, Homo sapiens
ctaagttggttgtttgaaaatgggactgtgtgtttgaatgatgtctttgaaccttctccagtgtttcctatgtgaccttgggtaaaacatctaatcatacccgtgaaaagtaggaataaaaaatatttgatgctgattgtgattatgataataggtagttcatgatctacatggcttctgtgaatatgaagggagacatataaaaactgtgctgggctctttagaacaactattaaatatttcagtattgggtaaattgtcaaaagaccccctatttagtgggagcagttaggagcaagcacaggtagagaaggcagggacctgggagctgactgtttagtaagcacttgttgaccacacgtggcttccaagcatacttaatttgcttaggctcgggtgtactcaggccgtcagtcctgcggaacagggagaaccagtccaggcctgggtgtactgacttacctggtttctttcctacaatgccaagccctatgatgagttggttcttttttagattgagacaaatcctcctctgtcattttcaatcagcagactccagcacacccccaaaggccaaaagcaaaaaactcctgttaattcacacgccccgaatcaattctgaatcaaaaaatagacttctagactcctgtgtgtatgtgtctgtatgtgggtggggagggtggagggataataagatctttcttttgtttgtctagttcagaaaggataggttatttctatttaagatggaattggagtggtacagagagagtggtaacagaaacgttacacagcacaaagtattgttaatctagttaagcaaatttagagtccatactgacagaaccagccaagaccaagccccttggaacttgcccagtttgagaatatcttatttgttatattcattaaaaggataactgaacaactatggggtggctgtaaaattactgtttttattttttggtgagtggatgttaaatgaaatgttttccaggagatagtgg

SEQ ID NO: 73445 - DNA, 1056 bp, Homo sapiens
agttaccttggccacatcaacacagcacatgtacacttcagaaaggcagtggctgggaactgatgagagtattatgttccaagttactttccctttgtcctaggaaccttatatctaaataatctatctcccctggaataataactgatgtaattattttattaatggcatatattcagcataaactctgcaaagcagggactgtgtgtacttgactctgttacagtctggcacccagtacaatgtccatgaattttaagtgctctgtaaatatttatagactgaattaatgagcgagtaaatgaatgaatatagtttattgagttgatattacaaagaggttcggagcacaagccctggtatcagactgcctctacccccctcaagttgtgtcacattgggcaagttgctttactctctgtgtctcagtttccttatctgtaaaatgggagtaatagttgtaccaattttatagggttgttattaggactatctgatatatacatggaaagctcttagaacagtccctgtatgtatcaaatgctccataaatattaactcctgtcagtgtcattatcatcatcatcagtagcagcatcctccatttgcagtaaccaggaagccttggttaaagtctatgtcatgagcatttagtgggccagttccaaggggaggaaatgtcttagtcatggcatattccttaggactattcaacttatttctggtcccatctttagtctttgctgttgcatcacaggaatttaccagtgatttgcaaaacatgggctgtcttctgacatggacactcttttttctgcaaaggagtttcttatccaagttgttgccattttaatcttcatcgtcctcaagaaaaggggttgggcttggagaggtgtacagagtactgaagatgctctgaatggatgactggagaagatgtagcaaatttgtcatcacaagtgactcccttattttcgtggattgagagtatggaataaggaaaaattgcaagccattaagggttaaattgctttctattgttttaggaatttggat

SEQ ID NO: 73446 - DNA, 1103 bp, Homo sapiens
tcagtacacagttgctgctgtctgcagccagtgtctgttctgattagccggtgtccatgccaaccatttggtcctgcttccaggtgtcagacttgggtaacagggatcatgatggaggcattagtggcgtgtggtgctttctgcttatttttcttttgtgttcatgtaatgcgttgtcacctggattttctgaagagtgtagtgacttcagaatttgcactgtagtttttttctttgctcatagagattcaatgaaatactctcctgagttttaatgtcattttgagggggctctttgaggtttgtgtgagtcaaaagatcagtggataaaaaatcaagagacagatccacattttaagtgtgggctatgcaacatacaaccaagtaagcctctgaccctgagactttttccttagtatctctagactttcatttccctatctaaaaaatgagtcattgtgctaggtaatctctaagaccccttacaaactctaaaactccacaaaatccaaaacttaacaaccaaagatccaaacttctttcaccagcagctttcctgagtagagaaacagtaattgtcagcctcataaccattaggctaaatattatgatgttaggtgtaagcagttttcaatttcagcaggcaacttttttgttcagaataattttctcaaaagttttgagctattttttctttttaaaaataaatatcagcaactaaactgtctaaactgatctcatatcatttgctgtttaatattacagcagaatttttattgtgtataaatgttatttaaaatgtacaacactctttcactgaagggtggcggggacacaaaatactttagctagcagctttctttgtgtgatacatcagtgttctggcttcagagtttggccatgagcaggatattccccattcactgaataacttccaagagcatctgtccttaagattctgaaatttgccagaggcggtcttgaaagtggttacatccaaacctgtgtgtcttttctcccttccatcctcttgggagggatattattgagaagccaactgcatatggttacttgcagtcagtgttggggaaccgggggtggga

SEQ ID NO: 73447 - DNA, 1102 bp, Homo sapiens
tttaggaaactagttttatgttcttatgctccctctactggttttctttctggagctaaatgccggatatcatagttctttgctatttctgcagaaagtagaatgtatttctatgaaaaagtcgtaaagtaacttgaacagaggagaattttttttttgtttttttgagacagaatctcgctctgtcgtccaggctggagtgcagtggcatgatcttggctcactgcaacctccatttcccaggttcaagcaattctcctgcctcagcctccctagtagctgggaccacaggtgcccgccaccatggccgactaatttttgtatttttagtagaggcagggttttaccatgttggccaggctcctgacctcaaatgaactacctgcctcggcctcccaaagtgttgggattacaggcatgagccaccgtacgtggccaaaaatcatattttgaccactggaaattaatagtgttaatacagtcttttttcttttatttctaagaaattattttattagcatgaacatatttgaaacaggagggcttgaatgtaaatctgccaaagcatactaattaatgaataattaaatacagacttgttcatgagctgttaggggactcattgaaggaaacagtgtaactataacaagaataactaaacaaactaagaaagtcacagttcagtgtaaagatgcaagttcatatagtttagaacttcaatttttgtttacagtggagactcacacagatccagtttatataaagtgcaggtcaagagatgtgaattgtcatccatagtcagtcatccgctctctatgtatatgatggtgccaggaaatgtgggtgaataaaacaagcataatctttgcccttatccatcttccagccagcatggaatgcatgcattagaccagtagttacagagaattcatccaaacattatgagtagcaggtgccgtggagccctgatgtgcacagaggcttctttggaagcaaataataaaaggtccactcctcttgcggataattaaagggaggcttcccaaataagtgtgtttttgtttttgttttgagacagagtcttgctctgtcacccaggctg

SEQ ID NO: 73448 - DNA, 1023 bp, Homo sapiens
tctcttttgacaagtactttgaagttaaccattttccaattacgttagaattattctgggtagactttccctttgacaatgcacattcttataattaatttcttgcaggatacaaaaattacatagaaaagcaacattttaaaaagacaaaaggggtctcccacgttctttctgtgccctcaccccagtctcatttcaagagagtagtcgctattacccacaatgtcatgccttttcaaatgccagtaattatatgcttaagaagattaaagctttatttgctcagatcttaagtccatgggacttctattagtaactaatcaaaatgatcattactgttagaaggtgggaaatggtagaacattgcttttgaaaactatatttggcaccattaatacaaaggctgggatcgttgtgatgagtgctggtcatgctaaccatgttcccgcatggctggtgattatgtcctgggttgggttctgcacggtagcctgctttgggttagggacagtcacacctggtctgtcctgacttctttctgggccctcctaaccaaaccaggggaggggagaaggacccaattcttttcctttggtgcacgtagcctggacccgttatggacagaggccaaaggaagataacagtgtggtgtccagagatgaaaccaagtggttgatgggcagttctttgagcaaccttgtttatgagcctattgatatgcagatatagaggcatccaatactattgactaatttaaaatcttattcagtgagtcaacactctaaataagcaatggagatggttccattcatttttttgcaagtatcatttttataaacataaatttcctgagatttttgttttcatcttagcctctgtggagctgcttcgtggttatgataagtgctgtgtgatgctcaccttgggaggtctgcgacatatattgaagtcatctctaacctgaagtactgacagactttctggaagaaaaggcttgtaggaggaaacttcagaattctatta

SEQ ID NO: 73449 - DNA, 1030 bp, Homo sapiens
atggcagccttacgtcagtagtatatgccactatgaagtatggccaaaaccctagcgtcacttgtaaccattgtactcttatggatttgtgtcttacaccatttgccttgctttttaaatgactttgtttttcaaggtgctgtcattttgcaaaaggaaatctttatatgaaatgtacaaaaaccgttactaactggacaacagggaaggtgctggccccacattagtgcctgcccaccgctctacttctaaccagggacacggatcttccattctctacatccaccggactgcagcccaagtctggacctggctgcagtgggcatattaccgtatggatatctttttctttctttttttaaagtgaggagattcttcagggggtcaggctgagaatgtaataagcctgacattggaacagatttctcccgtgtggtctagctggacccctccggcatttgccacactccctgccagtcctgacattgacttcctgaatgtgattaggtggtaatgagcaagaatttcctaggatattgaaacatctgtatccaggcccccaatcaaatgctgctgaatattgtgaatgtttttactccgctcactttcccactgtgctttcctctaaccaaaatatacgtgtagccattaccaatgtacaactctcaatgcggagttgccgccacggtttaaaataaatctctgtgaaaacctttctgcagctatggtcccatcacggttacatgtggccacgcacacaccgacaaccttgctgtgctgtttagccctgtgggttctgtccagttggtgggagggggaggttccagaccactccacctgctgtctagatgccagggagagctgctgtttggaggtgaagatgagccctgttcaccacagtctaagcacagcacacgggctcaagccatggagcccttttccttcatcatgtaagtcagctttttcttgtgcttagtaaacttttccagtgaggagaaatgacttcggggcaaacactgccagggaaagc

SEQ ID NO: 73450 - DNA, 1014 bp, Homo sapiens
agccagggaggaagtcaccttgaaagaagcggccgctgggctgtgcggctgcggcagaggagagggccagccacagcatggtgtccgcgccctgggcctcggagcgcaggcggtccccgaacctggcgtggaaccccggcatcgcctgcctcacacctgggagaaggaagggtcaggcggattaggacagcattctccagcaaatgtggttgacttcccttaatttaaaaaaaaaaaaaagtgcaaaaatgaaatgggatcataaactgctccttctattttatagcactcacccaagccactcggaaccagttccaaagaaccttgttacaaagcccccaaggtgtcacctgatggaaagtggtgctcaccagaggcctgattgagtccccatgtccccggggcaccagcacccagcccagccctgagagcagagtcgcccgcagagccctccctttccatcctaagagaggattctaatgagctgtggggctcacagtgaggctgggcccagcaaaccacttagtctcctgggttcaggagccctctcaaaccatctaggctcagaggatcctggctgttggttccctggactgttttagtgttttcctcttttagggaggagtagataagaggaaagaattcttcacttcctctgccaagcccctcgaggtgtcccaccctctgcatcccagggctacagggaggtgtttgcctggagtagcctcccgggcctggcctgtgccacagcgtcgggcactctacctgcccacgccttcgaggacccagccacacgctctggctccagtccacaccccattttcccacagacctcagggaacacagtgtctccacagtgagcacattgggaaacaaaatagttctctctcgaagccaaggaaagaaaataaaccagagaaaacaacaattaagagccttactgagatcatggaattttagagctagaaaggatcacctaagcaaaagccctccttttttaaattaaaaataaac

SEQ ID NO: 73451 - DNA, 1056 bp, Homo sapiens
acccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaatctgcctgtgagtgagatgcgtggtcagaggccagtgccgtcttgtcttcacgagggcttctgtgaggcactggcttggcttcatgtctttttagggggcagaggaggataggattttaacagtagggggaatgagggtgggcagagcccccttgatctgccatccccagcactggtgtgagtccctttctctaatgcaggcctgcctcagcggcgtgtggggagaacgctgaaaggcagctcctgtcaaagtccctgccc

SEQ ID NO: 73452 - DNA, 1045 bp, Homo sapiens
ggatggctgaactttggtttcccacatcatttcctgtggtcactgagataaagtttgtgtccttgaaaagttcactcagctgtgagtctttgctgcctcccctctgtgcccacagcacacacctactgctgaagggagtgggcattcatgtggagtggcctggccccattttgtgctttgtcttttgtatcaagtttcaggaaggagtttctttaaaacaaaaatcaataaggaaaacacaatagaacagtaaatcctgtacgcaataggtaagaaatatagtataaggtaaacatctgcctgtttttgtgtgatgtttaaagtctttcaaccgtgcaatcaggttattagtggtaaaaagaaattagcactgaacttacatattacagaataattggatttgattaaataaacctagaaagaaaagaatagtgatttttttaattgggcaggattatgagaattttatttagccgaagaggtatttagggtatcagacttagcaaataaaaatataggacatctacttaaattttaatttttcataaacaatgaatggttttttagtataaacatgtccagctcaatattcatgacatatgtatagtaaaaattatttgttgtttgtctgagaatcaaatttaactggatgtcctgtattttacctggcaactttaatttggaataaaccattagtgtgccagtttgtatttgaagagcccttcttgattgattaggagctccttgaggacagccttgcggccagcgtgatttgtttctccttggactcaatagcaccccgcatgcagtaagtattcctgaaggaaatgaaagataaggtgaagttacggggtagctcagtggaaggatttaatatagagaactatttacaaaggtattagagagctggaaatccaaataggcaatgggaagaaccccagagattaacaacagcagggagctctgtcctccaggatggctgagggacaaggtagttactggagcccaggggctgaggctgctcggtgggagccgggacaatgaa

SEQ ID NO: 73453 - DNA, 1009 bp, Homo sapiens
actctgcgcctggctgccggacgccgtgggtcccaaaggaagcaaccgcggcaagagtgaactccgcacctggaaaatcgatccgctgtgcgcaaaggccagccaatggcctccaacgggcggcgggctttgggccgggaacgggggcgcaggcgcccaggcgggggcttctagtgggggaggtggccgagggagggagcgacggctgtcaatcacaggccacgccctcctcagcccaaccccccactgctgtcccgcccacgggggcgggagccgtgtgcgccacgccgaacactagtctacgcctcggcatattctattggctggaaggccgtgggaagcggctaccagtaaccaatagtaacgcacaattggcccgtgggggcggggcgagcacggcttgctttctcaggagccaatagggaaaaggaaagtgaagcgtttcctgagttcgggggtcggcggaagatggcggccggcgaaaggagctggtgcctgtgcaagttgttgaggtgagcagccggtcgtgtgggctcacagacgttttctcttctgtaggggtacttgcccgtccagtgtagctaaattttgcgggcaaatggccttccttgtcatgaatctaaggtaatttctcaggccaatgagcagtctttctttttcttgggggtcttctatatagactggaatagactaggtcttaaagactcaatttaccgcgttttcttctgcttcactgttggccgaggggtcgagttcccttccctgcttcagctttttttttccctttcacactccagttagtctgtcataaattattcatattcattccttatttttctttacgattgagccacgagacattttccaatctatcatgtctcttttcggtaaagaagaaaccggatcttccttctcatcttagtttctactcttaaactcaccaaaactgccattgttaacacgtcacttaaatataaagcttatgttgaatcctctgctttttgataat

SEQ ID NO: 73454 - DNA, 1050 bp, Homo sapiens
aaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggtgagtttggcctttaaacaacttgtttggtgccatgagatacacattttaagttcttttgataaaatgataatactctggaaatctgcatcatgccctaattctcttgccctcatccaccaaatgtgctttcctcacttgagaccttgtaagatagtagttaataatagcagctagtatttattgaccaattcctgtgtgtgggccactgtgttgagatttttacatgtattatctaatttaag

SEQ ID NO: 73455 - DNA, 2666 bp, Homo sapiens
attatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgcccctaaggagaagaaagagaaggagcaactgatcaacctacagaacttcctgaccacacagtctccttccgtgaggtctttggcagttcccacaataatagaggagctggaagatgaagaggagagagaccaaaggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccagtttctcattaaagcccctgagggtcctccaagaaaagataagaatttgccaaatgtgattatcagtgagaagcgcaacatccacgcagcagctcatcaggtacaagtgcttccatatccatttacccaccatcggcaatttgaaaggaccatccagacccctataggatccacatggaacacccagagggctttccaaaagctgactactcccaaggtcgtcaccaagccaggccatatcattaagcccataaaagcagaggatgtgg

SEQ ID NO: 73456 - DNA, 1475 bp, Homo sapiens
attccagtccttactaccttttagagttggaatgagatggaaagtagatgaaactactttgaaaattacgacagttaagggctgggtgcggtgtctcacacctgtaatcccagcactttgggaggccgagatgggtggatcatgaggtcagcagttgagaccagcctgaacaacatggtgaaaccctgtctgtactaaaaatacaaaaaaattagctgggcctggtggcaggcacctgtaatcccagctacttgggagactgaggcaggagaattgcttgaaactggaaggcagaggttgcagtgagccaagattgtgccactgcactctagcctgggcaataagcaaaactccatctcaaaaaagaaaaaaaggaaaaagaaaattatgagagttacttaaaggtaacatcacatactaaatgtcttctataatcctatatttattaatgcattacaactctgtagattgttagttactaggccagtagctaggaattggtataaatttaatgcaccttctatcctgaataactagcatggaaaagtgaatatatgtgtgagcagatatggctataaagacctatagcttttgcactttatgcatatataatcaatcctttctagttcagtgaattgaccccatccacaggctgattcatctttgtgttaaggggcaaatgaaacggtatattatttctttgcagtctcctctcagtcattcatcaatgtggccagcttatctactcccaattatgttgttgatacatctccaagccatctgtcatcagatcaaaaagcagcaaacagagggtcagtcacaggatgttctgacacaccattgtaactttttgttagagatgatcccatttagaaaaagactggtagaaattggagtgaaaggaaccctacagattagcccagttctctcttattttcagctttacagacaagaacaatttaaatctaaagaatttagtagattccttcagtgtcacaaagctgtttcatgaaagaatcaagattataacctggatattctgactcctggcccagtgctttttcttactttgtagctacactttgaagtaagattcaaactgttatccactcaattgccttattcctgaggatgtagtgaaggaagaaaaagttttctggaattccgtaaattatattttaagcttatttcttcaaaattattttcatatatcacagatatatcattggaagatataatttgcatatatgttcattatcagtgttcctaatttggtattacatgtattctatttttttctgaatgatagcatgaaaagtgtcaaagtggtttgtccgctagcgtctgtctgcagaactttcaggatgactattaattcctctcagatgtcatttttgagtggtccaagcctgctgttttgaacccacagcagtggagatttgtattcttatttacagttgtgtactataaagtgt

SEQ ID NO: 73457 - DNA, 1059 bp, Homo sapiens
tggttatcaatgctttcagaatacttgtgtttatgtaaatataccccagagtccaaaactctgatatattcatatatattcacaatgagaggatgtctgtgccaaatctgtcaatcagtacaatagaaaagttaattatataactacaacacgaaacacaaatttttagaagcaaattatgtcctgtaatttacccccctccccgctgctcctctgctaactcattttcctcttttcccactctaaatgtaaggcaacccttggctttggagaagcatctgttccaatattctggtgctatgtgctcagttgtactatatgcaaatgttactagacacagaggaggtcaaagtgttgatacacttattgctaccatttacagaatgatcaatttgatagctatcatacatggctagcaagacactgatttttctaataaaaaaatttttaatgcatacaggtctggtgaacagtttcaatttaacggatgaggccaaggctaaagccagagtaaagtaatcagagccatgcctcaggaacacgatttagctaatagtgtgtgtaaaatgggtaaggtctagaattagggactaaaatcagctgaaagtgttgcagatatgtatacttatcacagtgaatacttccagtttacagcaaagaattcaaaattgttgagtaaagcttggtgactattacctaaaatagactagactttagccaagcatcttttatcatgggaacaaacccgataacctgacatgctttttttttttttttttttttttgagacagggtctttcttactctgtcactcaaggtggagtgcagtgatgtgatcacggattatggctcactgtagcctcaacctcccaggctgaaactaaagtgatcctcccgcctcagcctcctgaagagctgggaccagaggtgcacaccaacacaccagctaattcttttttttttttttttttttctgaggggtggatagagatgggtgtttccctatgttgcccaggctggtctcaaactcctgggctcaagcgatcctcctgcctcagc

SEQ ID NO: 73458 - DNA, 1192 bp, Homo sapiens
ataactttgtatgctgtataattagtgcatagcaatgaaataagaattaaatgatatcactctcctgtttaagaaagtttattactgttctgtagctaaggttttttttttttttttttttgagacaatgtttcgctcttgttgcccaggctggagtgcagtggtgcaatgtcggctcactgcaacttccacctcctgtgttcaagtgattctctggcctcagcctctcaagtagctgggattacaggtgcctgccatgatgcccggctaattttgtacttttagtagagatgggatttctccatgttggccaggctggtctcgaactcccgaccacaggtgatccgcccgccttggcctcccaaagtgctgggattacaggcgtgagccactgtgcccggctgtagctaagatttctaatgcactttacctttttattatttcagtttcagtaacaaaatatgagatacgaaaattgccaaatgtgctacagctagagttaatataagaccagagcatcagattcagtttgacaaaggctatgacaattatcctggctaggagaagaccgctgatcttagaaacagatatcaggctttgtagtctgctgggttttgtttgtgtagtttggttttaccttgacagtagatttaccttattgcatgtgtgtattattgctgttggatatgtgagcattatgcatgcatttacatctgtgttctcactctctgtataccaattcctagagagcgaaccatgtgctggatttagccagtcctgcatttttctatacttcaaatcaaaacgggccatgcttcacatctacccatgatgaataggggtactttgattaagaataaatagagctgactgaattctgaacaagtgagtattttgtgagaatcattatttttcattttaaatataaatgtcggccgggtgcggtggctcatgcctgtttcccagcactttgggaggccgaggtgggcagatcacgaggtcaggagattgagaccatcctggctaacatggtgaaaccctgtctgtactaaaaatacaaaaaaaaattagccaggtgtggtggcgggtgcctgtagtcccagatactagggaggctgaggcagaagaatggcatgaacccatgaggtggaggttgcagtgagccgattttgcgccattgcactccagcctg

SEQ ID NO: 73459 - DNA, 1035 bp, Homo sapiens
gaagcagattagtagcagtgaagatgggaaggaccagctgaatggaggagaaaaattgcccaggtagaattaaggggatgtgacatcatgggataatggtagggtggtcagagagagcaaagatttcaactggctgcgttggagttggtatccttaatgttagcagaagaatgcagatccggggttgagaaagatttttacatatgttatagtttttagaaaacaaacaaaaaaaatctgtttatgtcaggggcattttaatatagaagtgtgaaaaatggaaagtcagtctgaaaggggacgtcttgaatgtcgttttgaaggtgttgcatttgaagtactgatgcgatgctgtcagtggaaacaaactcaggtgggaggttaggtttagaattttattatattagtgttatggagttatttatacatggttttcctataatgtagattgctttctgtggtatgatagcagtcttgaaagaaaacacggtagtaaagattatatgtgagattcattcccctgattaccacctttctgtaaaaatacctttagtattaactatttatttagagccggagtttcgctcttactgcccaggctgatcttgactcaccgcaacctctgcctcccatgttcaagagattctcctgcatcagcctcccaaatagatgggactacaggcatgcaccaccacacctggctaattttgtatttttagtggagatggggtttctccatgttggtcagactggtctcgaactcctgacctcaggtgatctgcccccctcagcctcccaaagtgctgggattacaggcgtaagccaccgtccccggccaactttatttattattattattattattattattattaattatttttgagacagagtcttgctctgtgtcccaggctggagtgcagtggcacgatctcggctcactgcaacctctgtctcctgggttcaagtggttcttgtccctcatcctcccgagtacagtagctatgttacctatgttacttaatccttacaatc

SEQ ID NO: 73460 - DNA, 1138 bp, Homo sapiens
gttttatgcagagtgtgttttggtggccagtgttggcaagatctgataggtcttggggttggatgggtactgatagacagaattattaaaataattcttttttttttttttgagacaatgtctcactctgctgccaaggctggagtacagtggtgtgatcgtggcttactgaagcctcgacttcccctggctcaggtgatcctcctacctcagtctcccgagtagctggtactacaggtgcatggcactatccctggctaatttttgcattttttgtagagatgggtttttgctatgttgcccaggctggtctcaaactcctgagctcaagtgatccacctgccttggcctcccagagtgctggtatttacaggagcgcaccaccatgactaccagaataattatttatagggaaattactcatttgttctgtctggcagtgattacgtatctgcttggatgagaaattcacatttatcaatcaataatggctgggagagttttgtgtgtattttgaagctccggtgttaggtacatcctcatttaggattaaggttccttgctgaattgacccttttatcactatataatgttgctctttatccctggtaatatccctggttctgcagtctattttgtttgatattaatgtagttactctagttttcttttgattagtgttcataaggcatatcttccgtttttttacttttaacatatatatgtctatacgtaaagtgggctttaaaaaaaatagttggattgtgcttttttatctaatctgacaatctatgtcttttaacttagtgtttagattatttagttttatcattatatggttggatttattttgctggatttatatttgttacatccattctgttttttcatctttttttctgccttattttagattaattgaatattttaatggtttactttaactacactattggtttattatttataccttaaaaatgtatttagtgggctgggcgccatggctcacacctgtaatcccagcattttgggaggccgaggagggcagatcacttgagatcaggagttcaagaccagtctgaccaacatggtgaaaccccgtctctactaaaaattcaaaaaacttagctgggcatcg

SEQ ID NO: 73461 - DNA, 1048 bp, Homo sapiens
acatatttggttatatttaatattaatacatagtttgctagactctagtatgaaagaactgtcttaaatgcccagtatcttattctatagttgaatagtctatataaaaataagtgccttttccagccgggtgcggtggcttacgcctgtaatcccagcactttgggaggctgagatgggcagatcacgaggtcaggagatcgagatcctgcctaacacaatgaaaccccgtttctactaaaaataccaaaaattagctgggcatggtggtgggcgcctgtagtcccagctactcgggaggctgaggcaggagaatggcgtgaacccgggaagcggagcttgcagtgagccgagatctcgccactgtactccagcctaggcgacagagtgagactccatctctaaataaataaataaaataaaataagtgcttcttccaacaaataactgaaccacaggccagcaaggtcttccctgccctcttaggtagactgggaagattgctgtgtgaaccaccgatctcgtgatgcataccagcagcaacaagtattgcaggactgatgaagatgattgttatttgtctgttttctccttaggctgccctaaacaagggaagtcagggccacatggagttcatatttaattgtagtattctggggtatcttttttttaaaaaagctttgatcacttggatgtagctcctaggaattgataaatgaagcaatcctggtaacacaccaattgtgcaaggaaatgttagcccatttgtggacgccaggcagggagcatttgggtatacacagcacaatgctaaattaaagtttagcagaaatttagtaaattgatcagtgtgaaatgccaagcagataaataatgtgaaaatgtatccaaattggctattaactttgataaaattaagcaaataacaataaactctccacgtcaggatgtgctgtaaagagaagagactttggtgttgtgcaaagataattttagtgggtgttgggcatacctgcatattcttgacctgtgagttataatggaatga

SEQ ID NO: 73462 - DNA, 1073 bp, Homo sapiens
gagcttgatcttgatatttgagcctctactatgtctcttctgggtacttcaacttttgtaggattaagcattagttaaaatttagttatagtgtgaatgttctttggattttagtaggacattcagtaaattatttcttgcatatactggtatacattctgcctaccattagaacccagagtgtgtttaaattagtgtcctaaattaattacattttttttctgctgtgtgtttctattaggtttcagaaaagggatccctaacatcagaagagtttgctaagcttgtgggaatgtctgtcctcctagccaaagaaaggtaagtaaggttcttacctttcattacaatgtatgtttgtgtgtctgcatgaacagataattgtgtgggggtttttttgttgtttttttttaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttg

SEQ ID NO: 73463 - DNA, 1027 bp, Homo sapiens
aataaggtagatttattatttatataaatagttattaacaaattgatatttgcaagaaaatttaaattttttttttttttttgagacagaatcttgctttgtcgcccaggctggagcgcagtggcgcgatctcggctcaccgcaagctccgcctcctgggttaacgccattctcctgcctcagcctcctgagtagctgggactacaggcgcccgccaccacgcccggctaattttttttgtatttttagtagagacggggtttcaccgtgttagccaggatggtctcgatctcctgacctcgtgatctgcctgcctcggcctcccagagtgctgggattataggcgtgagccactgcgcccggctgaaaatttcaaatttttatggggaaaaaatagagggtgcttcatttttttaagtcattttaattctttagatggatttcaaccaaaattcatttctcatttcaggcctttgaagacctcagcaaactaatgatcaaggtatatgtcatttatgcctattaaattcataccaattatgatacagtttttgaaatatattttgttagcagacattttggggacaatagtgcttttcagtctttactttttatttgacaggctaaggaaatggtggaattatcaaaatcaattgctaataaaattaaagacaaacaaggtgacatcacagaagatgaggtaaataagttgctttttttaaggcatttgaaactagataacacaatgcagtaaggtttttgtggtttacattggctttctgaatgtactgttttatttattatttatgttttatttattgtttatttatttatgagacggagtgtcgctccgtcgcccaggctggagtgcagtggcacgatctcggctcactgcaacatccgcctcccgggttcaagcgattctcctgcctcagcgtcccgagtagctgggactacaggcacgtgccaccacgcccggctaattttttgtatttttagtagagaccgggtttcaccgtgttagtca

SEQ ID NO: 73464 - DNA, 1012 bp, Homo sapiens
aagtcagcttaagggggtactcctggttttaaaacaggtgctgtttttctcaaaattggagtggaaatttgactataggtgtggtagagggatacaaggttccataaactggcagatgcaattatagaatggatatgtgcatctcttttgctttaatttttattgtaggtagtttctttactcattttttgatagttgactaattccaaattttataataattataaaaataaaagtgaggaagcttttctctgtgttttataatcacttaaaatatttatagacatttcttctaaggcacaaaaatatttactttttttattgcctatgtataagtttacaggacttatttacatattctttgtggactctcagcttattttttctacagcaacataatataataaatacagtgatttaccatatacaatttaaaagtgttatctttaccagttttctttacacagataaaaaaatctattaatatcttatatattaaaagtaaaaacctaagtgtgcaaaatgtgtgttttatttttgaaaactaggttggtgtgtgatttgccctctatttaaatgttagaattgacttagtttcagagctggcgcccagagtttctcacaaagggtttcctgcatctgctggctctagctgataagaatccagtgtttaagccttttgtttatctaaggaaattcctgttaggtgtgtgcacattcccctttgttttcagttattaaccttagtgagttggccataagaatacgcaacacactattcttttagcaaaatccttttgcagatgggggatgctttcctgcagatgggcataagctgatcagagccactattatatgtttcagaccaccatatggactgatatttcagttaatgacaagctgcttaactggttttaaaaaataacatctgtatgcatcaattagataagattctgcactgggagtatattttcagtaacttgaaataatttattataaatatatttaaatt

SEQ ID NO: 73465 - DNA, 1080 bp, Homo sapiens
cttcataatcagtgtgacatttgagagaatagacagtacagctgggtaatgttttccaggcctgtctaaattaatcaccaacactagacaggtactcaaatgtatgaaagtagcttgaataataacttaattaagaaccaaaatttaaactgtgattttttttgtacatttgagaccctattaagtatctgatacgtaatagcttgccaaagaaggaaaatgataggaaatttaacttatctctaaaatgcagagtaaaatatgccatttattgtatatttggtttttcctgaatgattttaagatcattatgtacagcaagaaacaaacacatgttttgaagggaagctaaatgtccgtgtatgctgtttttctttggttctttgtaggtcctttcccgccattgaaaacacaatgtggttggttacaaaagattttgtttccttcctattttgtatgttttattttctacctcttttttttttcagccaggaagaataagggctgtaggaattgtaggtattgaaaggaaactggaagaaaaaagaaaagaaactgacaaaaacatttctgaggtaactgttaaattctggctctccatctattccagccatttgtgtctattcttttagatacagctgtgcctaattcccttctgtaatttagaatatatttcatttgcctgaagctacatagtctcctattctctttaacaggtctacctcgggctggcaaaatctaaccaaaacctttttctaaaaggaataaaaaagaaatgcaaatttgtttgctgttagaaaacatcataaaatgttgtgtgtagattttacagtctagatgaaattgattggcggatactcctaatgagttcagggttctctgtataattattttggaagttgaagtaacttagttgagagaaaaatgctattctgtggccagtctgtggccagataccacaccattttatgttgatgaccacccagggatcagaccagacatcagtaagaacggctcaaagcagcccatcacttctactgggggacaaccctgagcatgtacattccagtgtttctgagg

SEQ ID NO: 73466 - DNA, 1903 bp, Homo sapiens
tggaattttaataaaatatcagctggccatttttacagataagttttcacattttgttttcaaatgaataagggtgtatgctttggcagaaattataggcccccttataacctctggggacgtttgtagttggaaaaccataatcataaactcaaaattttgcaaatttattttgaccttattttctaaagtcacactctaatctacagagctagtaacttgaagctttttggttcatagctttggttcaagttttaagtagagagatttttgaaagcttcattaatattgaattaatacacactttaaaaggatgctttttgggatgtttgtttctacatgaattttaaaagtgatttgaaatacataaaaagttataaaagtagaattagttatatttttttgaaagacaattcaatatattacatttgttctttcttcagtgccaaaatagtggttcatcttcacccagctcctcctaacaaagaacctggcccattccagagtagtaagaactcctacatcaaactctccttcaaagaacatggccagattgaggtaagtttctacatgaataaaatcgtactagaaaggtgtgtgtgtgtgtgtgtgtgtgtgtgtgtgtgtgttgtggcttgttaatatgatggaaggtagtattatacaacataccagatttcaccatatttttacaataaaatttttattatatcttaagccttagcagtgagtggagaatatgaagtttaggtttcagtgggaatgggaagcagaggttgtgttcccaaggaaggaacagaggctggaaaatacactaagtcatgccattcgcctgctagcagagttttcagtggtatagtttagttaaaggaacagagtgtaaatgcagtggtatgttgaactatctcagtatctgaaggttccccagctttaaatcaggctgtctgtcttgattaactccagttaatcttaatcacttaagtacttattctgcagtataatagtttgtatgttctgaataagttgctgtacaagaattcttaagataattagaagtgcgtatttattctccccatcaatatcataaattattattaatttttttctatatcacctcacccagtgctcctgacaagtgatcactaagcagatataagtgattgactaaagtttttctcattgaagttgaaaaatatatttgattatttgtgagcataggtatgttttggtcctactttttggttttatattttaactagacaaatgattctctgcttccttcatggagaatggttgtatatttttcctggcactgtgtttgtttcattatagatcgaaaacaatccacatacacaggattgtttaaagtaagtctattgatttcattgtcactcatctctttgttgagaatagcccactttatatagaaggtcagttccttctctttttttttttcccttgtgctttctgaagctgatccaagaaaagaacttcctttgattttctttgatgtctctgagaattctgggcttgctgcaaatgactgaacagacttttatactgaagaaatgttaagtggccgggcgcggtggctcacacctataatcccagcactttgggaggctgaggcgggcagatcacctgaggtcgagagttcaagaccagcctgaccaatatggagaaaccccatctctactaaaaatacaaaattagctgggtgtggtggcacatgcctgtaatcccagctacttgggaggctgaggcaggagaatcacttgaatcggggaggcggaagttgtggtgagcctagatcacgccattgcactccagcctgggcaacaagaacaaaactccacctcaaaaaaaaaaaaaaaaagaaaaaaagaaagaaatgttaagtaat

SEQ ID NO: 73467 - DNA, 1024 bp, Homo sapiens
taacatggtgaaaccccgtctctactaaaaatacaaaaaaattagccggacgtggtggcgggcacctgtagtcccagctactcgggaggctgaagcaggagaatggtgttaacccaggaggcagagcttgcagtgatccgagatcacgccactgcactccagcctgggtgacagagtgagactccgcctcaaaaaaaaataaattaaaaaataataataataaagaaaatacacccattgtaaaaacaaaagctagttacagcttcttttaaacttcttatgttcttccatgcagccaaatgccaccacattactgttttcatttaatttttccttaagttcatttaaggagtaaaatcattattgtttttcattatttttattattaaggcatatggcactgtaatgctataaaacaaggatttctgacaagtgttatggatgttgtttagagtctttcatttaagctattgatttcctcctaggagtgttgcatggccattctcctttcccaaattgtgttcattgaagaacaggcggctggaattgggaagaggtaagtctgtgtatagcacagtctttattcacagaaaacatttcctgttatgctattggccaagaggtcctatcttagacttgatgtacgaatccattcttaaagcatgaataaagctaaggtttgctgtaatatccttgtttattatacatgggtcataataaagaaatgtggcccagttatcattgtctttccgtagacactttgctttcacatccctgtgtacctgtcatttcatacttaaaatcggaaataacctatttgagaaaaataactgactttgctcctgtttctagcctgatcattaagtttgtttctcaagtttgacttgttcaggtagcagaattaaacagcatataataatagttattgtacaaagcaggacatttatcagaataatagggggtacaatgaacaattagaccagggtaacagggatacaatgggactatcccaggcacaccagga

SEQ ID NO: 73468 - DNA, 1034 bp, Homo sapiens
tgctaaccattacaatatctgacttttttgtacctgggaactaatttttgtctcctaggtctgatattgcccctgttgataatgcatgccttagagcaggggtccccaaccccccaacccccagtactggtctgtggcctgttaggaactgggtcacatagcagggataagtgacaggtaagcaagcattaccaccggagctccacctcccatcagatcagcagacgcattagattctcataggagcaggaaccctattgtgaactgtgcatgcaagggatctaggtcatgccctccctttgagagtctaatgcctgatggtctgaagtggaacagtttcatcctgaaaccacaacccctgctccccaggaaatactgtcttccatgaaactggtccctgatacacaaaaggttggggactgctgccttagactgttaatattgtctaatccttttaaaagtaatatatattcagaaaataaatctttttggggaggatagagtggatgtccttaaaccatatgttgataagttaatcttagtataattttttgattatcatataaagaggtcaatttggacaaattttagacttactacattgctagtcacatataaaaattaaacataactgtttatatatgttaaaaattgggctaggcgcagtggctcatgcctgtaatcccagcacgttgggaggctgaggcgggcggatcacctgatgttgggagtttgagaccagcctgaccaacgtggagaaaccctgtctctactaaaaatacaaaattagctaggcatggtggcacatgcctgtaatcccagctactcaggaggctgaggcaggaaaattgcttgaacctgggaggcagaggttgtgatgagccaagattgcgccattgcactccagcctgggcaaaaagagtgaaactcagtctcaaaaaaataaaaattaaaaattaaacatactggctagacacagtggctcatgcctgtaaatcccagtactttgggaggccgaggcaggggggtcactt

SEQ ID NO: 73469 - DNA, 1050 bp, Homo sapiens
ctctttgcttcccttctacccctttcctcacactttttctgagataatgattgttaacagataattgtgttccttttagacccctttcactacttgtgtgtctgcagacacacacatatactgcatatgtaatattataaattgctgtaaatcactttctttcccactcatccaatgtcttagagttctatggtaatccatgcagttctacctcgtcatttctttttaacctttgcatgcattgcagagtatgaatgtgtatcatacctggttgttgtttgcatttttttctaattctgtcaagactatacaaatagcttatgaagtatgtagcattggttctctttaatttgtgataagcctattctaaaagtaaaatgtttgtttatatgattaatttagtgtggtataattcatgaagaagaaaatcggaaccacaatgagtgatatgttattaatattttgtgatgctctttctttctagataaaatttgatgctgggactctccttcttagtacacaccgactgatttggagagatcagaaaaatcatgtaagatacagttttttgcatctgttgtaggttttattttgtttatttattttttagagacagggtctcgctgtattgcctaggctgatctgtaacctctgggctcaagtgattctcctggcctcaacctcccgagtagccggggctacaggagtgagccaccattgtaggttttaaatcaactggagctttttcttcttttttcatttctaataaaacttatataatgaatgcaataataaattttacttttctgaatgacaaaagagtgtgtcccatgtaatttctctgaatggagtgcaaaaacaggagttagcgtgtcgtcccttattcagctccagaaaaatccatgtagttactggatggagaatcatgttttttaaatactagtcaaattctactctatatctaaatgttccatgtgtaacagtggaataattcccccatcagttgtgagggagtctttacaaagagctggtatgtccttaaaaccactg

SEQ ID NO: 73470 - DNA, 2606 bp, Homo sapiens
gtgttaggacttttagaaaatatctttaaattcctcagccatttgtttacactatttttttttgagacagagtctctctctgtcacccaggctggagtgcagtggctcgatcttggctcactgcgaactccgcctcccgggttcatgccattctccttcctcagcctccctagtagctgggactacaggactacaagcgcccgccaccatgcccggctaattttttgtatttttagtagagacggggtttcactgtgttagtcaggatggtctcgatctcctgacctcgtgatctgcccacctcggcctcccaaagtgctgggattacaggcatgagccaccgcgcctggccgcttaggacaaatttcaactcaggtcttttttaaatttaaaattagtaagtcagttaattgttaacattgccctcttcttcctccccaaaaggaagcctccttggtacaggattgattgatcattttgtttgtttgtttttaagtagtagagatcagagagttgtgacatctgaggaccaagttcaagaagggactaaagtgctgaaacttaaaacaaaaatggtaagatgtggacatagcactcttaaactgtccccttttccattttgcctttcctaaacacttttcttaaataattctttcaggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaagtaagtagatataattttctttattacattagttttcaataaagtactgtttgtagatttggattataatttccttgactgcattagaattttctttcatggtttctcttctgtcatatgcaggcaaatttatattgtggaacaatatgacctaaaagtttttgtgtttgagtatgttttataaggttgctttttaaaatctaaggtaaatgcttaataataattgggaaatactttataatctcaaatcaaaaaatgcattcatggaatcattgagcataattgacgttgatatgtttaatatttcttcaagcttgtgaactatatatgccattaaagtaagattacttaaaaatatgattttttcttttaactttatttgacagagttctgtcagcaatttcaaagtaacgtttatatctgcttctaactatagagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgaggtagagtctttatatttgcttagcattttatagtttgcaaattaccttcataagcattatttcattaaattatattgtcagtctttttgaccaggtgatgttggtgatactatgttgacttaacattaactgtgaggttattttaacaattatttaattgcgagatacactgcttcattcattaattgtgagcttattagcctttaactgactacattttgcattgagttcatataaatatacaggttgagtatcccttatccaaaatgcttgggaccagaagtaattgaagatgttttttgttggattttggaatatttgcatatacataatgagttatcttggggatgagatccacaaagttcatttacgttttgtttgtttgtttgcttttgagacagtcactctcacccaagctggagtgcagtggtgtgatct

SEQ ID NO: 73471 - DNA, 1010 bp, Homo sapiens
atattctaaacacactggctctttaatgttatgttaatttaatagatcattttcttttatgtgccatatgaaggttgtcttccttggtcttgatcaagtactcatttttaagacccagcctaaatctcgcttgtgaagcattccctaaccatctccctataccacaggcaaagttagttgtttctttttgtgggttttaataatcctttgttcttatttcatatatagcatttatttcattttataatagtatttgttatatagttggcagcagtatttgctgaggaaaaggaatggttcagagatggcaatcgtgttcttttattttgaaaatgtggccaactaggaacaactttaatgtcttctgattttgttcttaaaattcagccaaaagcttaatctataaatgtattttctataggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaaggtaaacttttaaaatgtaccatgatttgttttcatgcttggagataataaataacggcatttaaaaatctttgagatagcttcagattacagctaccatttattaatatagaaatttcagtacgggcatggtggctcacgcctgtaatttcagcactttgggaggccgaagcagacagatcacttgagcccaggagttcaagactatcctgggcaacatggcaaaaccccatctctacaaaaaataaaaaaaattttggctgggcaaggtgctgtgtgcctgtagtcccagctacctgggaggctgaggtgagaggatcacttgagcccagga

SEQ ID NO: 73472 - DNA, 1016 bp, Homo sapiens
tgaaaaagaaaacttttatttgaatttactttaatctgtgtgttattaataacagtaggttttggctttcaggaattagccagttctacagatactcaggtatctactgtatacaagttgtaatgacaaattgagaaaaggataagtttctcacttcggtgagcttatagtacctctctaaaagacaattaaatgcttttacctgcttataacatacaagctatatagtatggtacatatcatgaaagtacagagtaaaaatgttaacatgtttttgaactctggaatattgttttaattttcagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaat

SEQ ID NO: 73473 - DNA, 1045 bp, Homo sapiens
gcccaagggggaaacttctggagaaacaccaaccgagcttccgtcctaaatagccagcgagcagccacgcagcgtgctgctagggggacgggaggcgacacgccggcgcggggccggctgggacagtggaggaccgattcctcccagccgcaccccggcccaggacccgcgctcccagtccccgcccctcgcagccatggttacggaggcctggggcgtacacgttcttcctcccttccaccgcgcccacgccagcgggcactcccacggagctttcagtagtactttagaagcacttttgtaacgtactgtcatccctaaggaacgtgtggcggttaggggcgtttgtatgtctgttaataacggaagctacttcgagctcccattttccctagtttttatcatggctgccacagctagccaagccctttcgcctccattacgtctttagcggctgcgtggtctcttccgggagcagaggcccggatgacgcgtggatccccgcgatctttgggctggggattctaaacgactgggacttgccggaagtcattctgcactaatagcggcaaaaagccttctggttcctggggcgacgcgcccggcggccgtactattcacttccccagaacgccacagcccaggctttcttcttagtgggcttcccagaccaagaagggaaacctttcatccgaaggtactgaggggaggaaggtggcctgaagttatctcagtgccgctttgtttcccaccccagtcggtcagcccttcctcagcgccctttaacccttgcagatcggatggagaaagctgccagcacgttctagggatgggggcagattgaggagcgggagggagtagtctttgtctaactttataccagtaccaaactatgttaatttaatgtagttttataataaatctttaagtcctgtaacttattctcccaagattgttttggcttattctacggcctttgtatttctaggtgaattttggaattagcttgttaaaaaggggggggattttttattgggctcgcatt

SEQ ID NO: 73474 - DNA, 2607 bp, Homo sapiens
ctggtctttttttattgcacagcttaacattttctaggaatctcaaattctatatggtgtttgaatcttcttcaaattagtaggaggaaatctgtaatggtcaatgtgtaacaattaaactcttcagaatatatgagctgataataatgatcatttattaagttctatagaccaggaactaaaagctttacggtacagagatgctacattagattgcctacttttgggaggaggggcaagagaagtgggggagatattgatccttttataaggaaaaactccaatattatatccgtgttatctttcctccaaatagcttctgacaataagttacttgattaaaaattatgttttaattagaatttgatggcttcttacaaacttttactgacgctccacatgtttgtttttgtaggagctgactaaggctttggaacagaaaccagatgatgcacagtattattgtcaaagagcttattgtcacattcttcttgggaattactgtggtaacgtttcttataaagtatattgcccccttttaataagttacttatacattttacccatgacaaattaaaagttgtctttgagaatttttaaattggtcttttatacaaggtaaagtagctcaaatgtgacagacatgttgagcaacacccatttaaattttatggatgtcgctttttccttcattgggtggagaatgtatacagatttcattcatagttattgggtatgctgataaaaaatagcatcacatttactatttgacagactattaaaatgaaatgctcgtttaaattttttttataaaaaagaatgtggccaggcatggtggctcacgcctgtaatcccaacactttgggagaccaaagcaggaggatcatttgagcccaggagttcaagaccagcctgggcaacataacaagaccacctgtatttaaaaagtaatgtatttctgtattttgtaccttctgaatagggaaaaactgaataccttgagtaaaattacatagaaaatgttaatgagacaaggaggtgaattttgtgacacagctgtattcattgaagagctttaagaaggaagctaaatgttaagccaaaaggaaggtacaagagtaatatttatttgaattctatcttgtattagcttttcctaatttaaaaccatttggcatttctaccaacttgaaaacttagaaatctaaaactgattcatatgttgtgtgtatttgctaggatctataaataactgactaaaaacccgtctttttctacacagttgctgttgctgatgcaaagaagtctctagaactcaatccaaataattccactgctatgctgagaaaagggtatgcagtagctactcttcttgttgagcttggtatagatagtaggtatttaatttgttgaatgagttcattgcaagctttatataagttgtaaaattctgtatttatacattatatagcagagatatgattcaattttaaatacaacttatagttctattattttgttaaccaaagtatgtgataggagatctgtacttagtaaattttaaaatagtgatgattgaagtatttgcaaggtatagatgaaactgatagatttcacattgcttttttttttttttttttcaatcttttggaatttactatatttaattgactggacaacatcctattcagcaaagctgaataggctacatttaatgctatgaaagcgctatatctgtatactttatatcccatcttgtttctgttgataagtataactattctttaagaaacttctttaattcctttgtataattatatttttgagtaagcaagtctgtacaattaaagtcagattccttctgaagtgagttctaaaattgaattttagtaggaattgtactagatcttaacagtatattagaaagtctctaggtttattaacatacacttaaaataaattttttctttcaacagtagaaaatactaagttttttatttagaaagaaggtattttccagattttttgtgtgtcttaatttgttttaaatatattcatgcagaatatgtgaataccatgaaaaaaactatgctgctgccctagaaacttttacagaaggacaaaaattagatagtaagtattaaaaattatactttaataaacttatctatttctgtcttaaataccaaagctgaattttggtaatgttaatttcaagttaattgtagaaacccaatacctgtttttctcatctaaattatatttcatattgattgcagatatgagatcacttaaaatcgattaaattagccttttggcatttaaatcatagatgaacttcaccattagaagtaaaaaaaactatggaaacacctaacatgctctctctgtttagtctggctttgtttttttctaatggagaagtgaaagtttaatttgccttggtcagaagtctgttcattttaaattattcagattgctgagatgtgaaatcttaacattaaaggtttttatggagaagtgaagtgtacgtttgggtaaattatgagagggtacagaagaaacacagttttgagagtattgtgacttttaatgttatattcttga

SEQ ID NO: 73475 - DNA, 1057 bp, Homo sapiens
taagaacttgtattactgagccacctcctatagtggaagaatatcatgtgtggtaaatacatagatgtgtggctagagttgaggatgtaattaagcactcttatctcaattcttttttctcttttgagtcttggatttgttaattttaaccattcttcaaccatactactatgttctcagtttgccttttctgccccttcctctttaaatgctaagtgacgacttttcttccttatatagtagtttatgtatacatttcatgtccctcgtttctgtgtaagtctttgaggataagaagcatgttttatttgtatctttgtatgtgccccagttagggtccccagataaagttacaagatgttcatttaagtttctatttaagataaacaatgaataatttttattatgtaaatatgtttcatgctataattttatttgctaaacttggcagccctcaccacatacattgcacagtgggtgcttagttcagtgaatgaattaaaattggattttggttttagtcccatgacattggcagagaatgtttattcttagttttgcaggtggaaaaacaatcatgttaatggagtttaaatactttccccaagtttacctagttaactaaattcttcagcctggcctaggagacgtagatacacttctgattgccaaccaaactagtgcatctttgcttaggtttttctaagttttgaattggagaacttagattctaaggatgtgtcctaaagaattattatttttcttgtcctgaccctggaatctctgtattttatataccatatatatatatatgtgcacacacaaaatcttgttagattactaactcttaaactatttggggggaagcaaattgaaagaagttttcttaattatgtcttaagggaaataaatgataaaatctttgaatttcctttttcatacagtagagggagacaatattaaaatactgaaaataaaatatctgggttactgaggcttacttcgtggacacttaagagacaacagtactaaaataatttgcttttcatgtattcag

SEQ ID NO: 73476 - DNA, 1064 bp, Homo sapiens
ttaaaagtttgccaataaattgccccagctctttagtctctgggaaagatcccttcatgtcagtctgtaatagtaggtgggatcttacttaccacttaagatggtggtgtctggatatcatgattgcttaagcgtaatgccatctctttaaatctgaaatttctttcattggaaagaattaaactctctgctatgcagaggagacttcagaagtggatggtagtacctatgctgttgagagctaatgatccagcacattagggattcttagtgtaatctgtgaatactcttttgggatattagcaacttgagagccttccctgtacatatgagagcaacattcaagcaaactaccaaagttttaagttacttttaaagtttttttgacttaaatgaaaatagaatggtatgttaatggttgcagtaaaaacctctgaaattggactggtgctaattctagaactatctgcccgaatcatgaagacttaaaacttcatttttaaaagcatgtacaaacattgaaagtgaattaaatgtaaaaaggatttcataggacattagtccctcccttcttttactttttttttttttgtgtgggggtagatagggtctcactctgttgcccatgctggagtgcagtggagtgatcatggcccactgtggcctcaacctcttgggctcatgtgatcctcccacttcagcctcccagagtgccaggattacacgtgtgagccaacacacctggccccttttacctttttaaaaaagctactttaagtggtttattacatgcagctattttaatgaatggattaagtataatttcaagttgaggtcagcttgtctcagctgaagcaggttgttactaagagctttgccttttgctttataaagtcctctttgttcatactgcacagttactcaggttatagtggctttcagtagatgcgaatgctactctgtgctgctcttcaggtgaaacaaggaactttttatagacagtatgttcatagttacaggaacatgaagtgtgaatatagggtggcctgtggccaagtttaatg

SEQ ID NO: 73477 - DNA, 1030 bp, Homo sapiens
ttattaaaatcttagttacaaaagatttcttaggcatcctttaaaaaatttcatttttagaattgttcgtactgtctctgcaacttttctgaaaacataaaagttctgtatacttttcatctagtttctgttatcaacatgaagaatctgcttttaatctaattttgtatagcatatcaaaagtttacactttattgagttattttgctcaaaagaaatccccagattttacattatggtaactgactcagtttttagaaatgtgaattttgttattgacctatataccagaaagacacttattgcatacctgaaattcagtaacctaaactgtttgctaagatgttccatatacatggtcacaaagtttacatattctcgacataattgaaacatgttgattaattacttctgcctttttttacttcatagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttgtaagaatataaacttaaagaaatatatatgggagcaaattttacatattttaaacgagaaaattggtaatgtgagaccaaattgcgtgtactatagctgggagaactttttgaataaggtctgtctgaacgtttctttttgctctaagagtaatttttgaggaagttgaaaacttatggaagagatgagaaacaagtggtttatcttaaataggtattttttatcagtgagttagattgatatggagtcatctcacttggatttatcccagtagctgagtgaacttctgttgtttcccttctagactcatatgtagcctcagtgttagagatgaagaatatagatacgaaacttttcagaatagtgtttgcaagtagaaggtgcacgttattcattggtttaacaactctcttga

SEQ ID NO: 73478 - DNA, 1049 bp, Homo sapiens
agcacaaagtagaggcccttcaagttctcttcagctggtacaagaagagattattttgactggtctttacggtcttcagcaaaagagattataataatcattttttttgggagctaataatattttcaattgaaggtagtttttccacatgcacatctatgctcattagcaaaggatgtagtgcacctccctgactactttaggatttccttttcagattttatggaacttgttaacctctggaatgcctaagtttaaataaaaatattgttttgagtttatattgagctatatattttatctgtataatctattatatatgtattgcatagagtttatattgagctgtatataatagccaatatttggggctctatgcttggaacattttaagaaaaatattctattttgattatatggtccaggaattaatctatttttatttttcattgcagatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaaggtttcagacatggtgaaactgaataaagcatgtcatttgctcctagatagattcattctatctagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatgaagatgtttggtttatttacctttttcttaagtttt

SEQ ID NO: 73479 - DNA, 1143 bp, Homo sapiens
gaatttgtaaatttaattgcactgagatattttggtcgttaccttgcaagtttctgtataaaacatagatacctgagttttaacacactgcaagtttatactaaggataatctgtgaaggtagggcaaagaaggttctaggaaagcccaactccacttgcttcttttatcacgacaggattcttgaaattacagcattggtgggttttttggtattttttttctttattagaaaatctctgttgtcacgtccccatgattactttggtttcattggtttatggtaactgctgtgagagtaaattaatgtgtatatgtttagtatttactctgtgcctagaatatatagatatcatgagaatacaaaaaattaaagacatgattattaacttcaaagagcttataaatgtagcagggaaaaaaaataacattcatgaaggaactgtggaaagattgaatgctgaactcggtataaatacactttagagacaggaaaatgttctgtgattaaaattgtttacagtctaggctgttataaagtatagactatggatgacctgtagatctgactttgttttctcaccatgattttctcaactgtaataccccagatgttggtctcagctctgttaggtgtcactaacatttttatggcaaagcactactctataccctcagagcagggggagtgggaggcaaacgggtcatcatttcagcctccaaaacagtaggaattcagctccttccttctcgtcctttgttgtggggtgtaggggagttactaaggaaagtttcagtaaggtgataccagatggtgcccaaacctgttgttatagcttgtttaagcattctagagttttcacttgtccttctgtccacttagagctactagatacatttttttcttcttgaacactgaaggaaaaggcaaaattaagttttggttggatggatttctaaagttttcttcttaggaaaataggatagtgacttttgtattctgtatgttaaattttctcagtaccattaatcctaagatgaagaggaaggctattgctgcagaggcatagttgaggacgtatagcactataccagagacaagaatgcttagctctagcaagtcttctgtcattgactaccttca

SEQ ID NO: 73480 - DNA, 1012 bp, Homo sapiens
cttaaagatgacactattaaaatagctgtttctgaccaggtgcagtagctcatgcttgtaatcccagcattttgggaggcggaggtgggcagatcacctgaggtcaggagttcaagaccagcctggccaacatggtgaaaccctgtgtctactaaaaatgcaaaaattagctgggtgtagtggcatgcacctgtagtcccagctacttgggaggctcaggcagggagaattgcttgaaccgggaggcagggggtgcagtgagccaagatcatgccactgcactccagcctgggcgactccatctcaaaaaaaataaatagctgtttaaaaaaaaaaaatctggtactatctttagttggttttaaaggatatattatctagaatatgcttacccattggctagatttgctaagtgttgtgggatttgggattttgctggtctgaagggagtttgtaaaacacatgactgaaagcattataaaacataccttgtcaaatacattagattcattataggtcaagggaattttgaaaagtaggctagattgctgcctaagaatcccactctaaagtactgctttgtttaatcattctagataatggaagcttgtaagcctccagaaagttaaaacaaaaaacttctttctgattaagagcctcttaactctatccttatcctctgctatctcaatgtagctattaattgttccctctttgtttctagactccaattttcatttctcaaattttggttctcagtgctgttagtattagtagccttttgtttcttcagaatgtatgtatttttcctcttaaatgtttcctttcccttttaaggttagtcctggaatacatgtttttcttggtcttgtagacttcatctcttctgatttccataataatttgcaccttgatgaatccagaattctcccactgtcttcaaagaatcttgaatagaataatctgctttttgaactctgctatctagtaatctctttagatatctatacca

SEQ ID NO: 73481 - DNA, 1021 bp, Homo sapiens
tttatttcaaaatagctttggaagatacaagcaagggaagacttatggcaaagcaatgcaaataaaaaataacaaataataaaggggttatggcattttagacttgaactaccctttcagtacatttgcatatactaaagttctggaaaacaattgaaaaaattctgttaagagtgtcaagaataaccgctcaggttgagtgtaaaaatattttgtggtcctatcagcatcaacctgccttaatgcttctttggttgtctcttcagctagttcttattttacagcacatgatatatgaagtgatttcacaccatgcccaagatacgggccacccaccagctacatggcatgatgactctgcaggccgaacggcagccttgataattataaggccatgggtaatagccccccaggggttcacagatcttctggcagtgggtgtagctccgcctacattctatacaacagattccttcgtgatccagtctagggtcgaatgtcatgctttccccttcctgctgctgtgaaataaaagataattatttgtgataactgcatagtgggaaggtcatagcatgcatgttatttttaaataagattctgaatttttcactgctacaggaaggtgtaatctgtaaagggtttgatcttgtttaccctgtcattcataattcatgttcactgctgtcattcataattccttttgacaccaaggaatctacacctacctcacctgtcactgactagaaagttgttttgtcttttaaaacgatatcctgaagtttctccatgcctttaatgaactatggttaccacttagtaactcagcttgttttaagtaggaaagcaagaaggaagcattatgataaaaagtagcatttctgccactgctaattctaagtcagtggaatgcttgtggcttcttgcagtaatagcttccagggctctagaagcactttttgaaactcatcaatctaggctaaagacagatttcaattccagttgcactggctctgagaac

SEQ ID NO: 73482 - DNA, 1120 bp, Homo sapiens
agaacaaaacacaatcgataccattattagaaaagaaccaaaggattataaaacagaaatataggtttgggattaaaatatgttaaaagagtatttttgatacatgaacatctcaagaaagatgaatcgtttcttattcgtctttgtagctccctttgcatatcttaatattgtggcacaccacaggcattcaatttctggattgaataatgtgtgttggggagtcacattttattagcttatattgagtagtacaaagaaaaaatgattttaccctgtcctgggtcttgcagtaaaagcctttaataagtgcagagaaattatacttgtgcattgagcagaatcatctgcaaagctatgactaaacaaagtgcgtctgggcacatacagagcagcagaggctgtccccagggcagagaccattctgaacatagtccttgtcatgatcaaataatatctgacatcacaatagctctaatgttagcatctgttgggtattcaaatggacttatgaggtatattttggtaccaacaagaggagtgctttcactcaaatgaaaagcatctttagcttttctcatcaatcagaggaagatgggtcgatgaggtgtttgtggaccaataaactatcagaagagacattattttcaagaggcttttttcattatgaagtttcacctactccatctgcagatttaacaggagtacacaaatagtgatgcctcttccttatagtaaaacatgaaagagcataaaatatttatgttggccaacaggaaattcggcctgaagtgacactttggtttgcagatgtacaccgaaacattgctgcacagcttaatgtctcaaattgcctgtaaatgaaatttttgttaaaaaatcaaaacaaaacagtctccttttcaaaggagatgtgaatgttttatctctaatatgctatggtaacatgctatggtcagaaaacatatgctataataggagaatttgctcatggtcattttctggattaaataggaaattggaattgagaaaagtatgcaaatagatcccacctgttgttgatgagattattaggtcattaaaatttccctcttcttcagaaatttaaatttcaaatctt

SEQ ID NO: 73483 - DNA, 1004 bp, Homo sapiens
ggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaagaatctgccaattgcttttcatgaagctgcctatagtcagacattcacaaataatttgagtatcagaatgaaaccttctttcaagtgctaattatttgggcattattaatgttcatgacaatattaaacctgtaggatttcaagtattgcaaaatgtcacccaagtattaaaaacgtgtgttgatttcataaattatgtgcatctccatatgtattagtctataaaatccctgctctcattta

SEQ ID NO: 73484 - DNA, 1023 bp, Homo sapiens
cagcatattgccaaactataattcaaaaaaaaatgtgttttgatctctgttggagtcaaagataaagcaaaacaaacaatagactgaagggggataccataccacaggaagaccaaaatgtgaatgaagcaacaatttgttcctcttagtttggttttaaagggtgaggattttggtgaactccctacagagtttacttttgttcctaaaacaaaagcaacagatatgctagtgttccccgcaaatgtcaagaaatcagatctgaaaaacaggatttatattccaatcatttaaataaaagattttctgtgttattgaacacataacaccaatgtatccacacactagagcacactgtatgtaaagaaacgcaactttcatcaaaaacatgggaaaatattagcaccctaatgaatactgtctgtgcctttgcatatttcccctttcctattacagaaaaccaacaacatatgtttggggaaaaaattaagccataagaaagtttctaatttgcaaatttggctggattattgcatccatgtgtcagagtaagcatcaagttacacaggaccctgaactaatacttccctaggccagaaacagtttagtgccatttagaacaaatcactgtatgtactatactgagacccattttcatttctcaactgaacaaacattctggagacgaatgagcaaaatattatcaagtgcaatgttactgtcttcaagaagtaagttccagaaattgaagctattaagactgtttgaaagaaaacaaatcaacctaacagcttttttaaaattttctttttttaaatcattgcttgaaaaaactgaagtcaatcttcagcagtatgagtctccaaagcagagagaaattgttttaagttatttcataacaagtatcattatctcacattcttgttaccccattgtataatcaatttgttattaggtcttgactatgcggttatttataacaaaagttgtcagcaaattgctggtctttttcctgtgaaatca

SEQ ID NO: 73485 - DNA, 1050 bp, Homo sapiens
aggtggagcttgcagtgagccgagatcgcgccactgcactccagcctgggcaacagagcaagactgtctcaaaaaaaaaaaaaaagtaagtgaagtaggataactaattttaatagaatcatctcaaattaccttccctcccgctattaaaatgacctcctttggtttataatggtttatttcattgttaagtaaaaatcctcttctttctgtgggcccagcacacccactgaggtggttgtttaacggcacacaatcaaggacagtctaaccagtcaggatggtttcagtttaatgtccactttagtctcagtggctcatttaatcacttggaataatagcggttctcagatgtttaatgtatttctcagagccaaggtgttcagggttactacaggcaaggcagtctcttatgaagaaagaggggatctgattctttcttggctccagccacacataaacggcctcctttccattgcctactcttcatgtttgactccctgtcctcacttctcctccctgggggagcgtgtgttcttatgtgtgttctttaccatgggaacttggaactgaaagggacctctaaggtcatctgtacgtttcatagatgaggaagctgaggactgtagaggtcatgtgacctgcttgaggtcacacagctagtgcggggagtgctggacctggactctgggtcttttgacttccactccagagactttttccttctcttaggcttagaaagggacagtagaggcatcagagattccatgtggcattttaaaatagcgagactttcttttaagatttttctctcttgttttacaaagatgttaaaaaaaatttcccagttctcccattttcttatatggaaggataatctgacattctgtgcagagaattgactatttcccacaaaataaacagtggaaagcaagtagcacaagtatttagggatatcaggggtcctcagtgctccaagcttccaacagctcagtaaacatcccctccctgattgtcatgggagaggaagaggcaggaagaagcagtgtt

SEQ ID NO: 73486 - DNA, 4467 bp, Homo sapiens
tgcttgtatttgtccatgttgtgctaattgaagcaaggaatccctccctcaccaatggagtgaataggaggcaatcagaacaatggatggcaaaagcaggatggcccaaccaccaccaagaacttgtagctttagttatctgctctttgctaaccagctggttctggatagggccagaatgtctgcactataagtgactggatggagacagaaactgaaattcgtggcttaatgcagccagaaaccaaaatacagtgaggaaatttgtacagaaagaaaataagtaggtgaggggagcccaccctgcaggaaaaggcagtgttgtagcagaggctggtttctattccccagcctctgggctgtgggccagcactgttttgctgcatcactgggctgcctgtggctttgtcacaacagaggctaatcctcagggttagaacaataccccaaacaacaaaacactcatggtatccctgtggcatagcaaaggtgtttatgcaaacctgacttaaacctagggcccttaaaccataacaattgccacctgggaggcacctaagcctgacaatactgaggctctctggaagaagactttttataaatataggcagagtagaggcgaccctccctattgaagtatatccagtgacaaacagaaaaaaggagggagagaaagaaacctggatacaggaggagagaaaatttaaacatatgtgcatatacatgtttaaatttatgtaatttatatatatgtaattaaattaaatcataggtccacaatttggcccaatttgaaattcaaaatttactagaaataatttaaacagcaaaaagataaagaagtgttaattggctttagtgtctctatgatataggttctgaattcactttaacatctgttgaaattaacaattcatggaccttcatatacttcaacactggggctcaaattattgttatatctggaggtggggtgccactaactttacacaaggtaccgctataatcttgggagagttactgaatataaaataaagaacaaataggtatgcctcaccttaaccatcaaagctattgctttgggaaataaattcccatggtcatagcacccattgctctaaaatgtctcacagtaagcatggataatctgactcaatcagtaaataataaaaataaaaattagattaagtctttggcacctaaaaattggcttgacaaaatggaactacataacccccctagttaatatcattaatatggcccaatataaatttggattttaaagtatcaaacctcattatataagacctaattagtaacaggatgattatctccactgcttctccatttgacagcccaattttgtgctttcttatacctagaaagaataatagaagattgtagatcactacagtcttaatcctgtggttgcatctgctaaggtccccatactcaacaccaaatattattgaaattactttttaaaaatctaatcagcaatcagtaaatattttgctattataggtttagttaatgcagtctatttagtgcctattttggcagcctctgagatgcagtttgcctttccctctgaagggacccaacacacctttaccaggctgcccatggagtacaccagcagctttgccattgcacacagtctttgcaaggaatgtcttcaatgcatctacatttcccagaagcactgctatgaaactatattgatgacatcctcctgaggtcatttgacacattaattaaggacatgaaaatataaaatagcttataaaaagggaataggcaattgccccacatagtataaagccctgccaccttggctacatttttgaaaattattggtaaatcaagagatgtttcattcctgacagtatcaagaaacaaacagctattgaccttttcaaatgttaatacaagtccattgtttttagtaattttgggattctgaaggcagcatagtccacattttaaatttttacttgacatatttaggctgtcacttgaaatcagcccaccttaaatgagcccctcttaacaaaagattctagaatctgtccagttgaaataatcaggaattccccttagtgcccttagagagtcctttgttttagagcgtttagtaacattccttatgccactggagttgctgacttacttatgatggccacagttagttgtccacggacttctaatgcaagaagttgcctttcctcagacctgtgctatatatcattagagcggtaatagctggccacttactgggttctcctggaaagaggctttaacagactgtgaacctgttaccctccatatccagctgtccattatgccttacatcaccctcaaggttcagtatggctaccaaggtctctttgctacaggatggggccaaatctgggccatctgtatattctacttgcaggagaggatggccttctctgtcctcaatttcttgccatgttttggcactggagaaagacaccacttttccagaccccttggctacccaggaaactcgctggaattaatggagttatttgcaatgagattttgtacacttcacagatggaattgccatcatcctatgtgatggagcccagtggaatgttgctggtttccatctcttaaccaagacagccatgataaaggatggtacccaaggataaggacaattggccaaactttacacagtcatcttaccttactgggtgttctgcccaataaatggccccatctgcacatttttacgtactcttggactactgcctaagggttgcccccttcaggataaagaactttggaaatatcttgcctcacagatgcccaaaatataaatcaaggtaagagatgtctctacatatactaaggccacaacacgaggcttcaccagtacactccttagctcctgtgaagtagttccagacatcacccatgttgacaagacactcattcacttctcagaatatacaatgctgggctcttgaagaagatattcaatggaatttccacttttactataaaccaggcaattggtttcactgtgaggcctaatgagctccccaaataactcctgtttaaattatcaagtggtaaatggaccccctactgggtattgctattgccataggtgttgattaatctcagttcacacccctagggatgggcacttcctccacttatgcctcatgggtctatcaattatcttcagtggccataaagggagctacctctaagttcatgttcttgatgtctactccaccatgtggccctatccttcctggttaatgctgatgacccttccaaggggaatgctttcactctctaaaaatcttagttatcaacaaggtttaaattaacctcaagttatcaaggtactgaatgtggtataagggttaaaattaagatgcaatatgaagtgctgtcttgacaactttgtgcttcacagggccccaaccccaagcccaagtcccctgctctcctcagatatgcccccacccagctagctctcacatcagttggaccagctctaccctatccagtccttaacctaatggatttcacttctctgttggtctgaaaacttattcaaacaagccaattatatccttccactggaaccagggttcaccccagactcttgttactacaaagcatgcttcccacagcctgttcttgtttactctgttcctgaatgcaaccccagtgtggccctacagagcatttagtgtcttcctccttgggctgtgaatatatgtgactaataaactgctgtcattctcatttgcccagtgttgtgtgtttgccatcttcatactatttagggagggggtttcctccctcaccagtgggtgaataggaggctatcagaacaagagccagcagtatttactgatggtatgcatgtgagattaaagggaagaatcaagagtgttatttagatttttcacctgaaaaaatataaataaatgtccatgctatttattgagaagggagagaggagaaacagctttggagaaggaaattaagaacacagtttagagaaataaaagaccatattgtcaaacaagatgaaatgggataaatagggttttgagaaatgattagggagaaatcacttccagttggaggaataaagaggctcacatgaaaggagatatttaaacggaaccttgaagggttgaaaagatttttgtcactagtggtgttggaattatacatcataacagaagaaaatgttaaaccaagtcagcaaggtagagaagcccagaatgacaagtgatttcagcttggctgattggaagtaggagccaaggctataatgttattctgggatcttccttattgaagaccttgagtactaataagtccacattaagagtttactttgatcaggaaggcattagaatatgttgaggtttacccagtagtgattagggttgtgtgttctga

SEQ ID NO: 73487 - DNA, 1017 bp, Homo sapiens
atctggagttagttaataatgtctttgaaatggaaaataaaagtcacaaccctgcttcaatccagaaaaacaatcttctgttctgtgagcaaattatacaggctgtatagagacttaggaaactgaggaaatacgtcatttttcagagaacttaaaagagtcccttcccattgtttattcctagaagcatagaaatggctgacaccttccagagctgtcaacttctgatcttcaaatagacttataaggaactttaaaaaaattcctttatatcattatgaagttaatttttatatattttaatactttcttaaaggaacctaagatcttggttatatagaaatataatttacttattctattttaattttcatttgttaaagacagggtagtgcagtgtttccaaattgttgccagaaatgtaaggtgttagatagggaaccctgagcaacacagaacttggttaaaaacccactctacatccctcctgtttagactctggcatacatgcatgtgtgtgcatgcgtgcacacacacgtgcgcacacacattatccacctacactcaacaaaacaaacaaaaacttcatgaccccttgttactcagttgaaaaagtaggggtgtatggtatattaattgcatgcatctgtaagttattaaagtacatatattgtactatggtatctgatctgtgtcatttcctcttctatttctttttataatttctctcttgctttcatactctttttcgtgtacattaacatgtagagatttgctaagtaaaagtatttctaatctaaattaacatatctatactcgaaaaataacaatcccttcccccaaaataggcatgaatttcacttattactaatggctccatgaaagggaattgaaagtaaatctgtttttgagatgtttgttaaaaccatatttatttctgtaaatattttactttgatttactttgattccaagcagtgttaaagaaccagttttgcacaaattgccaacatatata

SEQ ID NO: 73488 - DNA, 1017 bp, Homo sapiens; identical to SEQ ID NO: 73487

SEQ ID NO: 73489 - DNA, 1017 bp, Homo sapiens; identical to SEQ ID NO: 73487

SEQ ID NO: 73490 - DNA, 1017 bp, Homo sapiens; identical to SEQ ID NO: 73487

SEQ ID NO: 73491 - DNA, 1017 bp, Homo sapiens; identical to SEQ ID NO: 73487

SEQ ID NO: 73492 - DNA, 1047 bp, Homo sapiens
agttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaaaatgctttcttttgtctctctttttttgaaaacattctgtggataagctgagaatagactgtgctatgcagtctgtctaagcatctattttgctttattacatgtaataagtaagtgactgttcttttaccttcagttaaaaagcagttatatggaactagtcgggcaaggtctattgctttttatttccttaagttgccacctcctttcagctctaagttaataaagttaattaattagaactatgagccaggccctgtttatagacattggagaacagagtattctctg

SEQ ID NO: 73493 - DNA, 1030 bp, Homo sapiens
ttaaattgacagcattactcttcctcatatactccaccatgtttttgagacaacacttctgagttcagggtgctgcttgtgaccaagaaaccaaatggaactgaccaacagtttgaggacataaaccttctgattattttgaaccactgaactaacagatgctacatttactatgatgccccagattgaaataaagtaggaaaatttgtatttagagttgaaaaataaaaaagagaacattctgccatttgatagtaacatatttttctttgtctttaacataaaccataccgtaatacttgatgtaatttattctttttgtgcattgtgtctccaccgagaattcttatttctctcagtaacttaatgaattgccaagtatttatggccaatatgggtctccaatatttttttaatttcaaataccacatggattataaagttccacatactttaaggcttctgtgctaacacttatagctcttttaagaggatgtatgtgaaatggaacaactaacagttactgtatcttgtcctccttgtccattttcctgctgtcagaaccttctttagcttaccaggagtactatactctaatttctttcttttctgccctctgtatggtacatttctagtctttgtgttttgtgttaccatagagacaggaggtgctccaaagcccaaagccccgagaagacagactggaagcaggtctttgaggaaacagtccctgctgacaagagaagcctgaggcaagaatctacagcagtaaagggaaagagggggattgtgtggcccaatctgatggtgtgtccacagtctcaggaagcacaagctctgccaatgctgtgttaaaaatgagttgtttacagaaaccaattttacagagacctcagtgcagcctggggtttcataggaatcaaactttggtgttttatttgcaaaaaaataactgaagtgacattgacctattccttttactattttcctcattaaaagggagcagcttctgagaaaggtcctctttgct

SEQ ID NO: 73494 - DNA, 1429 bp, Homo sapiens
gctacagatgacaccccacccccagctctatgtattttcttttagaatctaacacaaccacaggacttaaatgtttgtatttagtatttaagacaaaatggaccctaattttgctaaaagtcataaaagattccagattcaatacggctttgaaaaaaaatgagaggtttgactgactactcaacacaatccaagctgttcttactgtttctacttgttacatagggaaggtaataagcaaatctctctgtcgatatagatatatgaatgtggttagattgtaggcttcctgaaggcagggactgtgtctgtttattctctgccatatccctgaaacataaagcagcatggcccactgttcatacttttgactaaatgaatgaaagcatattctttatcttgtgccttgcagtacaccaaagaattatgaaacattgtcctcttgaatgtagaatcttatgatgaaatatgacacatctgcattaaagtaccgcttttaacacaaagaatgggaagtacatagactctactttgaatagtttatggtcatcactagacttgagtatgaggcaggggcacaaaaaactacaacaccaggctaactaggatacaaaacatatgagagaaatacaatacaagttggcatcgctatgttttggaaaatcaggaggtcatatttgattgagatttgagggatgaaagattattatagacaatgattcagactagggaatagggtattccttgttatacagacagttttatgcagtattatatatagagtttaatgcagtattttatatagagttttctgcataagtacagctaaaaaatttaaaggcattttaagaaactgcactatttcctaatagaagaatagtgtcctaaagcatagcttgctagtgagagaaaactatatgctaaaactttaacctttaaaatagattgaagccaggcatggaggctcacacctgtaatcccagctactcaggagggtgaagggggaggatcacttgagcccaggattttgaggctacagtgagctataatggtgccactgcaccccagcctgggcgacagacaagaccctgtcaataaatgattattaaataaataatagagcaagatttttgtggttagctcatttttgttaaaaaagaaaacaactgaaaaataattttatgactctggacccttcgtacaaattgggtagtatttgttaaaatgtgaggatttatgtataataacatcaaaataactagcttctaatattttccaatgtactagtgaacctgggccataaattttgctgctcttgtcagtagatatacagcaaagataagtatggacagtactctgtaccatataagcagaaaacctggaaattaacattcctggttctctttaactagagagctaactatatttt

SEQ ID NO: 73495 - DNA, 1276 bp, Homo sapiens
ctcagtctttacagggaagctcaactaagagcagacaaagagaaatggttggtgcttttacatgaacccctagcacctccatggctctgaagtcgttactgttttatataccatgacttgtcaaagaccatgaaagcttctggtgtttgcaatgtttttcattgttgtcctagtgctctattctacttcagaaggctatttctgtaatgctttggtgcacatggttttgcctgaggatgtgtgatgatagggtctgctttagaatgttcttaccctggttgtgtaaattgataaacctctgacacaagccaggcaaaaggcttcctattctcccgcaaaactttctatacccctagcccgaaataactcagagattatatttgctacaacaaagtaaatgtgtataaaacataagtatgttaaaaatgaataccatgttttgtccgtgaacacattttatacattatctcaatgggaaaagatccttgagtttattaaatagcagtacttttttttttttcctgaagagcccaaagtgctttcttatttgttcttttcgaacctctgagtactcttgcatgacagtcacctgtgagccgaattttttttcctcttttgagtagaacattgatgtgaatagatatcctttgtgattttattcttacagtgtaagataaaaggtgtaagtgacatctctaaggtactaaataaggcctgtagtaactggcaaatttacagcttagaactagcctgtaatcatattatctgaagttagaattcttccggttccctttgtttcagaaaaaaagatgaatgactgagtgccacattttctggggtttatctacttctttctcctatagcagattccactaacaaatatttataacattattttcaatgtaattttatttgcttatagaatcaaatagcttttgaatcaaaaaggatcttatagatcacaaagtattttgtgactgatgaagctgagtctaaatacacagagtcacatgcagtggcacatttagtttggggattgccaacttttaactactgcaatgttaacttggactatagattttagtttatctcagattaaaaccaaataaaagagaaacacaggaatttcaaaataattgtagcagtcctcacatatcttccacatgaaaacaagatttatgatcaatagaactttattttttcttactccaactgttactacaaaatctttaagcctgtagctgcttagatctcctgcagctccagtatattattt

SEQ ID NO: 73496 - DNA, 1047 bp, Homo sapiens
gaccttttcagttattatttttttgtcagtggttttgattattcaggtgcacttttaccatcaataggtcatatctataaatagaagtctagagacatttttaatatgtttggggaaagaataaagaaattcagattttaaaattgcaggtgaatattgtgctagtgattagcttggccaacatactttgaaacaatttatcaagctgagaaaaagacaacaatagagccatcccttatgaccacaatttctatggcttccttcaaaaatagccattttaaagtttttgtttccttcttcttttaatctctcatgttatgaataatatttagctgaactcccaaagcaactgggggaagaaaatctttggtattgattttggataaaatatgagacatttacttttgtgaatgctaatctctgaaggcttcaatacaatcttttgttctctgggttcttgtgtcattcaaagatttaaatttagacaccaatatgtttttgaccacaagaaagccctctgaaacacctaagtattaaagttttagttgttaatatctataggatttcattattttaattaccatctcagcaattcccagtgggtaataatggcatgtggttgtcctgcctgtacttctatgggcagttcatcgaataatcatccttatgttacactacattgtggttcattgtctctctgaactttttattttatccatatttgcttagcaaccaagttataattgtttaaaatttatcctaacattctctgagttttttcaatatatcatttcaagacactaagaggagatgtcagattttgtcctgacgtcttatcaaaagggttaaaactctacttcctgtattcttagcctcataaaatcctttcttcctataaattccaaaatatgactgatcacaaagcatattaatagatctaaaaatgggtgtgttttctttaaaactgtatttgttggagacaaatacttatactccatcaaaagttttatcagctataattccctcttataattgtttttaaaagtc

SEQ ID NO: 73497 - DNA, 1169 bp, Homo sapiens
ttgttttggaattcacaaagcaatttcccatagaaagaatgttataaatggtggttaggttcccaggctagccctcaagagtctatttaacccataatgtagctgtaacactatgcagttgtaatgaaaaatagcagaaaacaacactgttacaaatgtgcaatgttttcattacattaagtaaatacaattcctcttctgtatagaaaatgcagtctagggcaaattataccaaccagcaaatgtaatatgatctagtgacaagagcaggatggctgaacataggccaagctctttcactaatttgctttataaattgtttaactttactatgcctgaatttctgcatctgtccagccaacttggtaattcttgcctgctcatgctgaagaaaaggtaaagtaatgtatataagaatgcattgaaacacataaagccctataaaaatgcagtgtatcatggcataaagtgctcacagacaaatgaaattagactgaattttggacttttaatggagtgaaaaataaaggagcagagttgatgtttcaacttcagttgcccaaccccatcacctggaagctaggtaaccatcatgttatcctttcttcaccatgagcaagtcgaaaacacatgagttaatatctctgggccttggtttcctcttgggtaaagtgacattgtgcaaattagatgaccttccagttcttttaatctggatgtctgtgtttaacattatttggatagagtagcaactttcatagcataaaaaaatgtcctggaagggtcataattatatggtctgaatttcttcagttttctgtgatcagcttacttaaagcatcacttgcataacatacatacacacacacacacacacactgcttaatacagttttttttcttaatctgccaaatctgtccgccctaaaaccaacttgtcccccaacatctgccaaatctttccaccctaaaaccaatttgttccccaccgtctgccatcaaaatcagcgtggaaaccaacttctgtcaaataatatctccatccaaacctgcagaatagcagtcttctcgtttcttactcagaattttgctttcttccatgaagaagaaagttttccttcatgatttgcctaaaaatttctccttgattctggtgcaccagatatatac

SEQ ID NO: 73498 - DNA, 1056 bp, Homo sapiens
tatcatatcattttacaataattttctttctctttttattaaaaacattatcatttttactgtttttgagatatcccatcacgtgcttcatgaattttgcataaactttgtgacttttttctaagattgggaaatacgctgtttttgttccgcaatgagtttccatgtgagattgcaaataattccgatactatataaagaccatccaagagcatctactttaaattgtctttacaagtaggagagagggatttgcactgataattttcctaattccttggaataatgtcatacacttttaagcctgagttttgacaatcagaatcagacaaagaactgagtttcatgatatcaaagagcttataaaaggacatctggccagcccatactcctacctaacatcttttagtggcttcctgtagttctttgaataaaataataaaataataaaatctcagttcatacaatgtcccagaacaccctcacccacaggcccaggctacctcttccgtctcagtccagtcactcttctctttggtcactactttccagtcataagcgccttccaccggaggccttcacgctgttccctctacctggaatgccgttcttccactaaacctgtcttgctaactctttcttgttctgttctgaaatataattttctcatagtaattttcctgtgactgccttccctctaaaacttaaatcaggtcccttgttacattcataattgtaccctttacttttccttcattgtacttacaagttataattacatatttgtttgattatttgtttaatgcctgcctttgccaatagaatgtaagctctgtgattaaagaaagagttggagtcagaagaaagattttattataatcagtatttcacacttttgacaggtaaattagacccaaaataactcccagggagcaatacacagcctggaaaacatgaaacaaggagcggctgtttggtgtaataaaggaggagcaccaggctgaattttcagaggcctaatagagtaggttatggttgatggaggtggtggtggtg

SEQ ID NO: 73499 - DNA, 1027 bp, Homo sapiens
acatctttaaagacatttatgctgcttgccttcaagtaaatatcagctacaaccaggaatattagactgtctcccttttccctgtaaagtgggcctttaatgggatggccacactttattgatgggaatcctgtgttcaagttgagatcacaggtacaaatgaagcctaactagtaacctacaaaatatatgcactagaagctatggcagtggttcaaagttagaaagatgattagtatattcatttttatcgactgtagcactttatgatgcttatggaaatattcttagtaaattattcaatcaaataaattttacatgagggttttactaacaagtctaaaaaattattttcaactagattcagtcagacagatggattttgttctccaggtggttgcgtattttttgcttgataacctatttggcagcactcttttgaacctgtgaatatttatattttagggccctctcaataattaagaaatccactttcagtaccagatgtttccaatgactgaacaactttgtttcattctacaactgtaactttttttttactttgtttgtgttttcaataatattttcccaagaaccaggaacaaaggaagcatttactaaagtcatatgttcactaagaaactttataaaggctaatttactttattaagcagaaatgtaggcatcccaagagcattgtttattttaacaatcaagcgttttagaagctataaaaattagctagtttataatgttttcagtgacttttcttcttaagttgttgaagtacccaactaagacacaaatttaatttcagaaactatgaaattatgctttcctgtaatgtattatctaacctttggatgaaaagctttaaatttttcaactaagaactgtgcaacaaatgaagagtaaaataacttcctttatagtaaactagaccaaaatcagtgtatcaacctcatacacttattctcggaataaaccctgacctgagacgagattttcattctatagcaaataaatc

SEQ ID NO: 73500 - DNA, 1037 bp, Homo sapiens
aagttaagcgtaatttcttttatgacaagtggctcagtcttcattataagttaggtaatgagaaggcatctagttagaaagctagggcatttcttcatctcacaaatgcagatttgaatgctgagtatgcctgggtgttgtatatcatcttcctaattaaaggtaagaaaaatacaattactatggccaagatggtaaaataaataataacaaatctttattcgttgaggttggatgagaggtttacttacagtaaaggaactatcttaggaaaggaaaacaaacagtaagaagaaaaggttgagaagtttaaggaataggtttcttcagggattgatattagctctaggcttacttaacacttttacaaataatctggagaaaggcagtactcagtcaaatatcagaggttttaaggaacgctaaactttctagtaggaaagaatcaataaattggagcgctgcccagggaagaccttgcagatctgtgcaggtgggcagatgaatacagggtggtaagaatgcagtgatgtatgtatggccattgagttagtatgtttatgtatgtgtgtatgtgatcttcaagcaatggcttttagcctttttgaaagatttccccattcatttgagaatctaatcatagttaagaaacttttccctaggaaagaaagctcataacccccacaataggaagtcatggtcttgaatgagctaaacatttcagaaataattttcttcagttcatttattcagtgagcaaacaaatatttattgagcttcagctatgaactctgacctatatgacgtgctgggaatacagagagataaagacacacttggcctctgacctcaaactgacctaggttacaatttggaaggagctagataagcaagcatttttgcagcaatgtgatcactgttcccacctctatgccaaagtgctgtgtatgtctctagagaggcactggattcagactgtggagggaactaaggatttcagagatggcttgcgagagagcatctaattgatgtataat

SEQ ID NO: 73501 - DNA, 1049 bp, Homo sapiens
tgaaatgaagtggggagaaattggtatgttagaaaaagatgagtaaattgttggagcattgtccttgaatgagagattatgaagtctaggttgcaagaggaggagttggccttattggagcatggacagttcatcggtagaaatgggaagaaaggtagagtctactggcaaagtgatgtaggtggaaagatgtcagcagtgaagggagtttgtagaagttcttgtttcactggcttagtaatttattttcatttcttctcttgcagtttaagaatttaataaaagcttttttcgaatcgtacagtatatttaaaccaccttcatagaaatattaaaccttgatatgaaatgtatcatcagctcttctaagttataaactttggggaatttaaactcccagaagtaccagattttctacttcaatccctttgattccaattccctttaatatgttcacccaattttaactttctaaaaccttattctgcagttttcttcttgatacgttgtaactgtgagaaagtccattttatttctgtgagctttcacatttaacttgagaaacctgttttccagatacttaaccagtttctaaattacttaaccaggtgccagcgtactacatttaatgtaccaagtaatgattactgattgctggtcaatccatattctaattgcttttcccctcaaggtattgttctcttgagggaaattgtcagctgttcaatgttttgagaccagaaacatttaaaaatgcattaaaacttaaacttggagcttagtagaaacgcatttagctggctttactactaggttctaatcacttttttcgtgtaatgaatatgacttcattttgtgttaaagtctgttttctcagacagatggatataaccattttctgaaattattgccacaataactgctaataatataatcatagttaattccttgcatttatatgcatgtgtcaattctacccaatcaaactattcccatggaaaatatgtgttattactataaaatagcaacatatttttgttagtactttc

SEQ ID NO: 73502 - DNA, 1046 bp, Homo sapiens
ggcacattaacctaattcattaagttctttatatttagtagctatgagtaggatcagggagtgtgtttcatttagaccggtaacattctggtgtttataatttataatgatttgccttgattaaaacactattgctgtttctgaaaatttgaatggattctcaaatgctaaacatctgattttctttctgagctattcagggagacttcagaacaagaagaatttagctttgtaatgacaagaactttccatagtaattcctctaaatgtttaggaccttattagggtggtttatgttctgtgatattctttttaaaggaaggaaagttaagtctgagctttttcctcaccaccagcagcgtggcatcagggaggtggccaaggatctgaccttgtgcctttaagactgtttttcctcacctgtaaaactggaataacaattccaaccatgagaggttgtgataagtctgaaacggaataaataatgtaaaaggacctggctagtgcctaatatatacagtagcagctcagtcattgttaatttttctgtcattgtattgttaaaattacaggttgtatgtttagtgatttctgtataggtgattagaaataagttcagtacaactaatgacaaataagattgtccattttaatagtctctctgtctcttttttctttttctttgtttttttttgtttggtttggttttggtttggtttggcttgtggtttttttgtttgttttttgagtggggtagaatggaactccaagggtagcatttcagaagatttatcctcctatacctataattttcttggttgccacctaacaatgttgaggtggatttccagttatatgggaaagccaaccagtattttgcatagataactgaaaacaaaacctaatcatttatggagcttttaaaagttctttaaatacaatatttgtattgtataatcatttgtaaccgaataggagacatgtggctagaaagtaagacttatcccaaatggtctgagtgagtggtcagactgtacacactggcc

SEQ ID NO: 73503 - DNA, 1346 bp, Homo sapiens
gtgaaattttaattcatagaatggaataggctttttatattctgttaaatatggcagctatgttttcaagagaaatatttccccaccaagttaataatcaggttggaattttaataagtaattataaatttttagcagaggaaagacattggtcatcaaagcatatgatgctatttttcccctctctcttttacctttgtaataaggcttttttcttaagttgctttctgctgtttaaaatggtggcattcgtgttctagcaataattgtagaggtttgggttattataaactttgaatatcaattcctccccttctgtgacagttctaccactagggaagtcaggcttgcaaggtctaattactgcagcattttgatatccctagctacaatattggcaggaatttaagctatggtagaattcattggtgacactgttgtaactaaaaagcacagaatctgttttcaagcctgttcaggatggaatcaagtattggatgatgtcaaatagtcttgctgcaagttcagaagtgccttggacgaatctaatatgaaatgctaattatttgcaatagaatgtaaataaggtggcagtaagtcttatttgcagtgactaatgaaagctgttgtactataatcattgagatatagagcaacaggacaattcattaggaaaaccgtagttgacaagcggttaattcatgccagtctggacctttcctcttgcttctgtttacttctattatttcttcttgataataagaagtcccatatggaaacatataacaaggataagaagaaactagcagctaaattttgccaagctatgctgaatatctacagactaagtcttccttagcttttctttgcctatgaaaaacaactgccatattaggctgattgaaaatatagtcattttctagtcagcaaattgctagtctgaaaatttttcatgttctctcaccagacttgagcaaaacttagctatgctgcaaattattgtatttcccagacatatattacatttcaaaatttagccacattttcacttctcagattttagcagtagaacacttttaacaactaaaaacagtaaattgcttgatacagctctcttctatgtattatagaatacagtccttgataaataaaagttgaaactctagaatagcttttcttttctggggcatatattcctcacagcaacaatagtgcaagatgctatcttattttcaactcatatagccaaattttgaacttatagaagaattaaagtaaacaaagtactttctattccccaaaggtgtaaaaattaggaaggtgatttctattatgtgtaattttca

SEQ ID NO: 73504 - DNA, 1099 bp, Homo sapiens
aaaccaaatcttatggaacaatgagggtcagaataagagattaactcgctttggctatattaagaatattatgctgatgttgttctaatctaatccgtaaactaataccccacaaagattcagcatagtttagcacagtgaatcagttctcataatactaggcttttaagtgttttcagtgacataagacaccaggattgagaaagatgatcagtaaagacatctagatgttaaaaatcttcaaattcaagtgaaaccagcagaaaataagcaagaaatctttctaactttaggtacaaacatttttcagctgtgaaaagctaagcaactttactttttggttcttcttaccattttcctttttcattttttaataactatataggactatagataacaagcaaactcgtatgatctttgaatatggcaattatgtctcaacgttgatttactcactcattctgtttctaagctttttaactgtggtgatcagtgtaattacagagctgcctttacggtgagaaggcacaatttacaggtcaaaatgtcatacagaagtagatatggtgtctgtctaattagattgcttaatatttatcagaatggcattcttttttgttgtgctattgcttgactctgggtcccaaatattctttcttaatataattatataattggattttctgtgaactttatagaacattaatcagaattaaacatttaagcttaaagttttatttgctgttggacataaaatcgacagttttttccccaatgtcttgtagtttaatgctaagaaattcattccatagaggttcattgtgttgctccagggagcacctgttttagatgctgggttgctctagctgttcatgcccttgtagactttacatgtccaccttcttctgcaacagcaagtaaataaataaagtagcagcttattatgctgtcaatgaaacaaatgagaagatatgataagcagcagaagcctttcttagtcacattcaagctacagtgaagggaggtcccagaagtttgcaggtaagcaacagtgaatgcaaggaggcaggaaagatctgagctttttagaagaaccagt

SEQ ID NO: 73505 - DNA, 1033 bp, Homo sapiens
ttaatcttgcttaatagttatattttttaaaatttgaaaataaaatgagaccagatggactgaagagagccgcctgcacctttctgcatggtggaattgctattggtttatgacaaatgccagtaagagaaggcagggactgggtcgttgctatcagatgagaactgaaagcagacaggttttgttatcaatcactggttgtcggtgtaagacagcagcggctgttataattgatttgatggctccgaatgacttgagctttagtggccaaagcggattgtagcaactcagccatgcatgacattgacatgaagaggaagtgacatgactcctcagaggcaaagttagatgatttaaaggggtaaatctactcatcaattcaataattcataaactttaacttttgatatgagatgatattgatgagaaaaaaggaaaaaataagcttttatttttcataattgggctttaggtggtttttgttggattagacccacttttcatatcttcttttttcaccctcagtactctgttatccataaatgatacttatatgttttaatgcagaatgtcacgtattatgtatcattcctactaagctgtttgatgggaacatgagtttaaaaggggagccaaaaaaggaagataataagaaccaaatatctaccttttatatatgacctaactcctcagtttgaagaatataaataaatagttttatcaagtcaggtaactttaggaactaaacacaatgaaaggttagaattcctgatgatatcatgcctaattataatcttaaatcaaccagatttctgaaggcatgtatgtattagccaattgggcatgcatactgggaatgcgtagggtgtgtatatgtgatgacaagctggtttccatactaatcatgccatagattctggcctgggccaaataagaaactgtctcctcccaacaactcattggttggtattcacttctttgagcactgggttggaaaatgctgaattggaaagaacatggtgctcatttagtg

SEQ ID NO: 73506 - DNA, 1002 bp, Homo sapiens
cacccccaacaaggtacatctctgtcctcttatctcacctcccaaacaccaacccaacttgctcccccatgttggaaacttcctcctttgccttactcacgaccactactacatacataccacatttgtcaccaagcatgatttattctatctccttaaggttgctcaagtctggtcttccgtctctttgagtgccactgctttatctcaggccaacttcatttccagactgctttgttgcagtaacatcccaatcattctcccttcctccagttgtcctcctgtccatttcattccttcatactatcactgccaaagagatcatcaaaaaatacaaatcttttcttgggctgtctgtgtaagttccagtagtttagaatgtgaattccccacatgattttgtttgtgcctcctaggcttatttcatcccactccatcaccagattccactgcctggctataattgagccactggcagttcccagtgtgatccacacttttcaactctgtacaattctttcaccttctaggaatgttgcctctttatttcacattccaacatttcattaagattcaaaatgtggtgttctctttgaaaatgcgtaccccaaaatctatcatttctttatttctgttgagtcatgtcaacttatgaaggatgaattgtcaaagctacttaaatatcaacatcaaatataagcataaaaagtaaaaacaggacctactgtgtagaagagacatgtcttgatctgcttctttcttttctttcttttcttttctttctccctttctccctttcttccttcctttcttcctttcctttcctttcctttttccttccttccttctttcctttctcttttttctcttttcttcttttctttcttttcttttctctttccttttctttcttttcttttcttcttttagcagcatccatgcttacatcagaagccagcccttttagattactactcatctgtggattgatctaaggtaagt

SEQ ID NO: 73507 - DNA, 2180 bp, Homo sapiens
gttttcagtttcctgctttaaaagtttacttcaaaaacagtataatagatattctcctgtttgatgtaaaattatttagaagacctgcaagattgtagctcctaatataaaatgcttagatatggttacaccttctttcatacaattacagacatccagaggttgattgaatatccaggtgtaatgaagcaacttaactttttacaggttgtatacatttatgtcatagcagttgattgaagaaaaaatggatttgtaaataacactcgtagcaatgaaagtaaaggctgcctcttaaggtgtttacaaatagaaaaatcaagttaggaggattctaatttaatgattaattgttttgctggaattttaaaggaatggatccataatgatatttgtttcaggctattaacagccagaaccttggctcccagaattaagaaatcagttcttgttaattaaacttaaagatgatggcagagatctttgtgccatgaagcgagagcctgatctatggctattttgttccatacttggtataacgcagtacactcttctcagccaaagccctatgttgtctgggcaactcccgttgccatagcaatgaaattcttttgcaggagcagggcgaatgctaattgtagccatttgttgttccttctgtcgatcccttaactagcacagttgtagagcagccagagactctgggtgaacagcacgcagtgcccccaaaagcattgctgctgaaggcaaccggctgctctgcttaaaaaatcatttgagcagccgacagtgctgacagtgccactatgtgggcagaagcacagcttgactcagaccctgacaactgttgatctgggagagggaaagagaagactgtttaaaacctgttgagaaggtactgatgacatggagattaatttgacaccagtccctcagaggtaggtgctaggcatatcgtagcaactgtttatccaggcctgaactcaatattggaatgcccagaggctataggagacagatcaacggttattccttttatttccatctaaaactgcattaccgtggcctacggtaaaaatattcatttggttggaaccaaccaattgtaattcacacaggtattagattcagtttgtactggtaactccctcctctccttataatctcttatttttaaagacttatgatttaactgccaaaagtgacttgaagctgaaaataaactcaacataaacgagagcagacccttttgaaaaataaaaggcaaagtgatacctaccaattgcatgatctttcatgctagtttaatttgataaaatgttcttaaacctggaaagtagtaattcttgtaaaacctaattgctgtaggtatttagagatgaaaaaacttattatcatggtaagaagaaacatgtgaggtactatttatactattatatcctccctttgaaagtgtattggcccataaaaatggtcaagttcatgaggtttttaaaaccagctattgtgtaaacatagcaataaatttcaaggtagttttttaggtataaatttaacgtatgtgccttctaattgagtagactgatagtgcatcctggctgaaatgttcttaaaattcaggagaactaatattgtaggcttgttatatcaagctatttctcactattgctttatgtttttttgtattgagagagtcaaaatcagtaataacaatgacccagtcattaccacagattcctctttttattgaccaagagggaaggaaggtttcaactcaatgtgattttgttttccttgaaagaactccatgtatatttaatgtttgtatcacttgtcctgctctttccagggagatagctaacagagtatcatgaagggccctgaaataaattagtttctgatgatggtgatcctaatacatcacttgtgtgcctcaaacactaaacaaattagtttcattcattaaaacagataccattccataaattctaaggagaaaaaacttgaaatttattttttgaaattttctaagacctgttgttttttcttttaagaaatacctatgaactgtataatactatttttaaaatattatatacttcttatttgtgaattttatatgcaaggtatcttgcatataaaattgtgaattatatatctgagatattctttcataagcc

SEQ ID NO: 73508 - DNA, 1079 bp, Homo sapiens
tatacctgtttcaatgtgtttatttcactgtaagtgacaagtataattatgatcaaaaattaaaatatagatattactcagaaaataccagccattaggcagtgtcacgagaggatatctgcttttctatctcaaaaatctcaatactgctactgctcaaacatgttcaaagcagttttcccccatgcagtacacttttgagtcccaaaaaactcagtataacaaaaacatatttttcagatttgtattactatattatttggagtcatgaaaatcttccagctacattttgtctgaagtttagtgatttataaacactcttgatctcataaattagaattacataaatatctgtgattcatcagagtagaagcctcagatatcgaatttcttgaaaagttttctaatatttgccctttactaatagatttgacaaaagttaggcttcatcaagtttatctatttataaaaatcatttttaaccctgaaattatttctgcttttgttctttaacccaatttgtttggtattagcctcagagctaaaaatacagtatgatctgagctatccagatagtatttaaaaagctggaaagcagaatcatttctgccagagagtaaaatatttgtaattttcattagtagctacttaccactaataaagagtttacttttaaaaataatcttttataaaatgaaaatggatgtctacatgtgttcttaagagagataatttctgttcagacactttacatgtatatattcagacattttataccaaaaccagaactagctaatgtgtttcattctctcttcattccccacttacccacatccccagataattatttaagaaatttgaatgattaaattaaatattattcttacatgctaagagttttttgtttagacctttcccattatagaatttgtacttacccttgttttaaaagagactgaagctttaaaatgactacattagctgggtgcagtggctcacgtctgtaatcccagcactttggaagtccaagacatggggatgcttgagcccaggagttcgagaccagccctgcacaacat

SEQ ID NO: 73509 - DNA, 2234 bp, Homo sapiens
acactttgagaaccacaagatctggatcacctttatctgttttgagtatttggaatcatcattgattaatatcatattttttattagtctttgtgagccatatatttcagtgtctgatcataataatagctattatttttataaggctcattatatggctgtacaggatatgattaattctatgtcatatcctgtatattatcctctatattcatatgtattctgaaccttggccacattagaaatacctagagagtttttctaatggctccaatatggagccttagctccacacattctgatttaattggtctaagatggggtctgggcactgtatttttttgaaactctctttgtgatttcagtgtgcaaaacaaaattgtaagccactgataggtaaagataaaaaatagccccttttgccaacaagtaacagattgtttcatctgtggctttttttccatccatgtgcctagccactcattctctttttttaatcagtgtggtatgtttttggttcttgagtataccattttgttcttctcttaattgaacttcatcctgtttttgatgaaccgtttctctaatctatcaaggtcattttaaattctatttcttctaaagcatttaacccctgcccaactaagtatcatctgcaagtttaatgagcagattttcaatttcctaattgagactgtgctcattaagttttaatattttataattttattgcaaattatttccaccatgtgggtgattctaccttgaccttgccctggctgtgcacattttcttcattatcaatgaacatttatttagtgcttagaagttgtgtggtattgaaacaagttctgtgacttctaaataattgaaaataagtactgaatctgacaccatgtagtttgaactctaaggagaatatgtatataacataagctgtatgagcaatacagaacatataagcatttaaacagaaaaactaaacattgaacgtatagttcataggtctgtaatgatctttactatacctgtatagaaaagaagttaatgatgtaggttgccactttactagctgtgtaacctttagcaagtcacttccttcttgtgcctcaggttttttggtcagtaaaatgggaccataatcattccagccttggttctttgtgaggcttaaaatccagtaatgcatgaaaacttatcagtacaacctagcacatagcaagagttcaagtaaattaagagtcaaatgagaaattgatagtaggaagtattttaggtttggtttgacaagactgataataatccaagtgacaaaaggatgattagtctcagatctaccttcttcagtgactaattaagctaatgtggaaccttccatttttacaaactagagcttatttttctgtaagtaaacagtttcgattttcattctcaatttgctatatttgtaattggaaagggtgcttttgcagatcattatagctattaagtggcagagtcaggatacaaactcagaacttctgtctacaagttggttactgctaaatggtagagcggagggaatagattgccccagacataagaggtgagaggagtgggagtctattttagaaagataagatgccaaaaagaataaagtagctagtatttgaccacttactacgtgtcagacgctgttgagtgtattatttgcattgtctcaaactgaggcttagaaaagttaagtaacttgcccaaaatcgtaaagctgataaatgacagaggcaagaattaaacccagatctgtgacagcaaattccattttctaagtcacttcagtaaattgcctttctttgaatggaatcaggagattactttttctggaacagaagatgccctcaaaaatatcagaagtagagagcagaaagataagttggatacaggagttgtgtttactccctggctgttttgtgacagattagatgggaacaatcagctgagggatttctcttcagtttagcatgtatttaaattggttgaatagctaaaaagtgaaggtgtcccagtaggaggaggctggagatggcctagatgagggttttagaaggggtgggttagaagggtatggaatttatatactttatcttcttttgttctttgatttacttaaaataagtaaatgtcaagggtgatctctttgagcccataaaagctaacgctgtttttgtgaaacacacatttttatagcactttac

SEQ ID NO: 73510 - DNA, 1563 bp, Homo sapiens
cacgcctgtaatcccagcactttgggaggccgaggtgggcggatcacgaggtcaggagatcgagaccaacctagctaacacggtgaaaccccatctctactaaaaatacaaaaaattagccgggcgtggtggcgggcgcctgtagtcccagctactcgggaggctgaggcaggagaatggcgtgaacctgggaggcggagcttgcagtgagccgagattgcgccattgcactccagcctgggtgacagagcaagactccatctcaaaaaaaaaaaaaaaaaaaaaaaaaaggatgacccataataactagctttcctaggtagggtttggcttttatgtttttcaatttttttttaccattatatatagcactgtttcttcaggataatgcaacagatatgaacaattttgaatctttttatacatattgcctcactggtctgggtggagtgaagagattatactaaattatactcctaccagcagcctatggacatgtccgttcatctaattctcaataacactggatgtgtctcagaatttttactatcgacaaaatggtgtcttattgttttgcatttttctttagctgtgaaattgcatatattttcatcctttatttgtaactgataaaattaagggggcaaaggaaccagaaacggagtaggagggagaaccttctcagtatttcttagcaaactatgtcatccttaaggaaaaatcagaaacttcaatattattatttcctctttcttttttctctattaggataaattattattactgtttgtgatgatttttcaatgctgccattgagtaggttttatttgtatgtttttatcattactgataataaatactattaactctgatgtactggagtaatgggttggaaataggtgaatgaaaatcagagacagacctaaatcccagtggcaagaaatagctggaacctcagatgggttcacacctccttccccaaggtttttgggtaatgaggtagcagcttaatggatctgtaaaactaactgtgactaaccttagtctacatgatgccatccaatgaattaagttctcttccaggctattttaacagcaactttagcagatttccctccctctctcccttcctccctccctccctccctccctccctgcctgcctgactacctgcctgcctgcctgccttccttccctccttccttccttccttctttccttccttccttccttccttctttccttccttccttccttccttccttccttcctttttactaaatttaccacatgtatctatttaagaaaaggtatttcaatagtgaaggtattagtagattataacttttttaaagtttatgtttatataccctacttatttctaggaagaatttgaaatggcttacaaaaggagacacataataattatgtaattataagagaaaacagatgctataagaaaagaaagttggcttcttagcttatagccttggttctcaaatttcagcatgcaccagaattacctgtggtcttgtcaaaatacaggtttctgggctcaaccca

SEQ ID NO: 73511 - DNA, 1938 bp, Homo sapiens
attaatatctcttgttctgcttgtgttccatagtggactataattattatgatctttttaaatcgtttgcccattctgaatctctcccttttcttatggcaaaagttcagagtctaagtttataaggaatcaatggacagactttagaagctccttgaactctgtacttttgttttaaattttgtgtttggacttaaaaaaaaaaactggtaaaaggatatgttggtttcctcaaatttctcccaaaataaaaatcccttttaaaagaggattaaagaattacttattttgtcgtttgattactgatttgttacacattgtctctgtttctatgtgttgtgtaattttgcattacttaaaagggaagccatttctatgatattaataattgtttgccatttgagaactaaactttcatgggcatgtcaaattcttggtgaatctacagttttagagacaaataaattgtttaacctaaacagttacaatccaacgaggtggtgctactgtggaggttcactgagcatacagaggaaatgacgtcatgtgtacctgggatagtctttggtcttactggatctctcaagctggaaggagtgcagggctcatctgggtcatacaacttggaaggagcaagaaagagaaagagaagccagaggaggagcgttctcccctaggagccaccagtgacaaagaagttgggaaagaatagtcaccaaagccacatgttcagaaaggccaggtacaaaaaggatggataagcacccgagcacagattggactgaaggactcgggtatcactgcttaccttgagaaacgcagtattggtagaaactgaagccaggtagccttggctggaggaggagtggagctttttttctttctttctttctttttttttttttgaaagcctagatatgaagaaaagaaaaagtaggaaaatagctgaaccaaatggtttgtgatttaatgagcatattatgtttctttgccattcatatgacaaaggctttactgtctttgtattctgaaaggaagtattaatagttctggaggtgtggggctaagacttaggggagcagtagcttaggttaggttcccggggaatgggatatgaaagcataggtgcagagcacctggacagttacaaaggaaggatgtttgaacagaagtggatgcagacagtaattgagggaaaattctgagctcccatctgataacacctgttttctctgagaattaggagataagatctcttccttaaagtcatagtctctggctgggggaaggaggcaaggtcattggggctgacagatctctagggaatgtcagaagaaagtgatcagggagacacaaaataatttttacattaatggcccagttgcagagggagatgattacttatgtagtgatagtatagtgtgtgaaatccatggtaagaaaagtagccaaggtgcctcccgggccctgtgaaaaagggcaaatgatccccagcagcctaaaggttctaaaaagtaatcaccacgtgtgaccacaatgctcaggcagtaggcagactgggtgtgctatagagcaccagccaagcagagtcatcaaattttctgataggataagatattttgtgttttgaaaactgtagtagttacaggaaaataatgaaaactcttttggaacataacaatgtgtggttcaccagtgtttctgctgttgtattccatctgtagtaggcattatggcagggatgggggaccctactgcagctgagtttcttccaggcatgtgccaactgcattatgtgtctgaaatcttttctaagaaaacaacacttggtatttatttataagataccattggatttatattttactttatttgccctccttaaaggtcagttccaagtagccacagatatggaaaccacctgtcagtattaaaaat

SEQ ID NO: 73512 - DNA, 1075 bp, Homo sapiens
tctgtgccttcttaaatcatagctatagtctcagacttcttaggtttctttttatatatagagagagcatcttttctctcagaatagaaaaaaattctggtaaagtatcctcctggacgttggggctaaaatgtccctatatgtattttagcaaactgacctcaagcattctaacttcagtggacttcagaagcagacatctcatgcactgaattatccagcctttgtgctgtggtccaaacctctaccaaaaacactttggttacaagttgtacctgttatcttttgctttggctgtaaaggcacaggcagaaatgaagtatgtgctaaatctttatttattcagcaaaatttattaagctgttgctaggcacttaagatttatagatatcttccaagaatgcaccatctagttgaaagacagactagtaataattgccctacttttggtaaatgccaggttagaggcaacaaaaaattttggcaagaccaggaagtcagaaagactgatccagacttcatgaggacagtttagagctggcttccagaaaggatctgaaatgcaagctgagacttgaaagatgagtagaaatgaggccaaaacccaagggcaagagtgagcctagcagcagcagcagtagtagcatgtatgcaatttttcaggaggtcctttctgaaccccagtctgaaccttgtagaactgtacattctagtaacaccctagtcttcccattttataatacacactgccctgaagatgtttttattcagtgtctgtcacagtactcatgagtttcatcagagtggagacaaggcataaaggagcatatctgtcttgttgactgctgtaaccccaatacttagttggattggtatcaggcatgtaagtgtttataagaatgtgttgaatgaacagacatgtttatgtttatacttgaatggaactgttaatacatattaaggagtaaaatcaaatctcttaatgtcacccaaataatttgatatgccagttgctaaagttccagctgtgaacacagttaaccgcttcccatctcctcccttgaagttatctatc

SEQ ID NO: 73513 - DNA, 1158 bp, Homo sapiens
tattgatctgtgattttagtagactgctgtgaaattctcaagttccaatataactaaaatagtaaaaatgtgtgcatgtacatatttgctatgagattgcgtactcgtatttttcatccttatattattgccttgaggttgtgtcttaggttcttctatcaggtctctagtgaattttttattattataattatctgaagttaacattcaatcattgctgatcagtgttatccaaggcactctttctcataacactttttaaagtagtggacttactatatgtcaagatacaatttgaagtattaaatctgtcatcttgttttaatctcccacatttgccagtgcagttagaaataccttaactggcattttggcaaaatggtaagtgtagatgagcttcatgtggtattattgtggaaggatgtgataaaatcactaagaagatgaattaacttagtctctgatatttatctaagatggactcctgtcaaaaatctctaaccagtcctccatgcccaaccgcatagaactctctgctctgttcagggtaccatttcatgttgattggcttttatttgcttttgtttttttccctctgtgttatgtccttgggttctgcctaccttccacagtcaaaacacattcgttgattgtgggtgctgtttttcaaagtgagattgtcactaatgtttgccagatttataaatgtaaaacaacttgacagattttgtatgagttttttgggtgcagatgacttaagttctggaattattaacatgtgactgagagaaaaacctgtgccaatttctagggaagctaaaataattattaggtaaataagaaaaagacatggatgtaattatcttttaataggtgtggggatccttactgccgaaggtaaagtatatatagtaggtgcttaacaaatgacagtaaaggtaaaaatatactgcagtctcttaaataggtcttttttgttgtttttgtcttgcctttctcttgtataacaatacaaataaaaagagttggaataagagaagttcactgtgaataattaagtaattcctaaatttagggttatgatttagagccattgtgacatattttacaatggcaaaacctgtagagagtagatctatcctgatcttaaggatgatt

SEQ ID NO: 73514 - DNA, 1028 bp, Homo sapiens
tctctagaatcccttttataaaagcactaatctcattaacaaaggctctgcccttatgatctcatcacctcccaaagccctttctcctaatatcatcaccttggaattaggatttcaacatataaatttggggttgggggggaacacaaagattcagatcatagaagatgggttccctgaatagcaattgcccatttcttggtgtttcttactgagttacaagcattctttattttaagaaaatcagaccgagggaatgccaatgtttcaaatattttttccagcttatcctttcattgtttatgtgtacagtttgttattatttgattttttattatttttaatagaaacaaagtctcactatgttgtctaggctggtttcaaattcctaggctcaagtgattctctctccttggcctcacaaagtcctgagggtacaggcatgagccactgtacctgtcctatttgatttttagatatttatattacttttggattttcttaggaatatcttcccattccagaactactgaaaatatacttttccatattctctgctatagttttacactttaatcttttaatgttgaaatgtttgatccacttggaatttattttggtataaataacaaggtgagatccaaataggctaatgctaccacagtagttattgaacacatttttttaatcttctactgatttgaaatgccacctttatcatgaattgacttgtcatgtgtatttgatatgaatcaccaagtgtagtacatgttacacattattattattgttattgagacaaggtctcactttgtcacccaggctgcagtgcagtggctcagctacgggtcactgcagcctcaacttcctgggctcgagtgatccccccacgtcaccccttgagtagctgggactacaggcatgcaccaccatactggctattttttttttaagagacaaggtctcactatgttgcccaggctagtcttgaactcttgggttcaagtgatcctcctgcctcagtctcc

SEQ ID NO: 73515 - DNA, 1360 bp, Homo sapiens
atgaggaagactgactcaattgacagtttattctgaatgagagggtagacttgtgcgtgattagatgacagtgacccagagggatggcagcagtgtaactgaatgacatgtgtctcaaaggcgggtgctttttacatgaggaaaaaaaagtgacagcctgacatagcagctttgatcaaggagaaagcagacattcccatgtcctccacctgtgccctgcagactttaagcacgtgagataggaggggaacaagcaacatctaccagaaggggtgagcagagatcatctgtccagtttccaagtagagcccattttcaattaagagaacgaggtgaaaggagtgtatggtgaagaaattgaggtagtagagagattgttcatgctaataatgctggaggaaataaagatcagaaggacactgttgtctaagaatgatggtgatggtggtttagctgccttcaaagttttagcccaactacagcaatccccagtggctaggttgaaaggaggagtcaggaggccatggcagattgaagtaattctaatattttcagatactcctggtctcaggaggaggagtgtttctggtctttctctctgaggaaggagcatctgtgaatgacctgcatctctcttattgtcagattctgggagaaagctcccgtcgaatttggggaaacgagcttgtgcttgcctgctcctgtttcctgctctgaaagctactacctctttgtgccttaaagcatttcctaaaacacctttaaatataagtcagcaaacctaaggatctgaatagttatcaattttcatgtaacacctctctcaataaaagtctatagtggaaagaatgagctttagaatcagaaagatatcaaatctcccctctgctaccaccctatggcagggctttgggcaccttactttacctttttgagctccaagttccctaactttaaaatggattagataatagctactttgaaagaggggagtgagaattaaattagaaaatctaggtaaaatgttccatacagactctagcacataggcattcaatcaaagtgatagttcctagtgtgtcttaattcatatttaaattttttattctttattttatgtatctcttgtttcctaaataaaactgttcttgaccaggaatgatggctcacacccgtaatcccaacactttggtaggctgaggtgggaggattgcatgaggccaggagtttgagaccatcctgagcaatatagtgagatcctgtctttataaaacaaaattttttttaattacttgggcatggtatagtctcaggtactcaggaggctttagcaggaggatcctttgagcccaggagtttg

SEQ ID NO: 73516 - DNA, 1031 bp, Homo sapiens
gatttgcttttagagaaatggctctgtagcaaaaacgcagatggatcagagggtgttgggactaggaggaatgagactaattaggacacttgcaattttgcaagagataaatgtagaagacctgaactaggatgcactgaaaagagaagacaggatggatttgaaaggcagtttagaggcagaatcaatggggctttctagtggattgggtgtggggagacagggagaatacttcatgaacaggtaggtgatgctgctcctaccagctttagaacacatagattttacatctccaatttaaaggctttttaatcttgggagtgttttttacctgaatgggcctggcatagggtaagaaacacaacatctgcacagtaactattaacttctttcatagaggaaaataaaaacaaatttgttaataaagacaactttgcaagtttttgtagctagattaaccgagaacctctgaaaataaaccatgtttagctcatgaggataagctggaggtggccctttcctggagaatctgaggcatggggttcaggtagggcaatggagagaatgtgtcccattatccccttgaaggaaaacaggtcagtcccactccttcctcttcatctaaaactagcccaaacattcagttccaaggctctaggattctcattattgaagtctgcattcgtttattttgctggcaggtgatattgttgtagtcagtatttggttattgttttttcattaggtactaattacaccttatctaacattctgaaagacattcccaaggctcctgtgtgatttgcttttgtgaccattaaatttctgacaaaagaaattataaaaatgggcattgaaatacttccttcattagcagaattattagtgtgatggtgaaaaaaagtatttctatcaaaactttctttcagcaaatatttatttatcgcatattatgtcatgatactatcctaggcactaggggtacagcagaaaataaaacaagcgagtgtcccggccctcatgggcatata

SEQ ID NO: 73517 - DNA, 1049 bp, Homo sapiens
aataataataataataatatagatcaataagtcatagactctgttctttgattttaagagacagattaaaaaaaaaccatgaagtaaaaaaaaaaaacttttccttgtcttcctatagccaaaagtatgcatttgcaaaatgaccagtctgtgttgaaaaataatgagttattgttattttgataaaattgatatatttataaattgataaataaataataattgataagtaaattaattaaaattgatatattgataaaattaatgataattgtcagagaaaacttaatctttaggcatatttcttgctacagagaattgtgtgatttttagatctattaatttgaaatggaaagtcatgcagttgaacttttgaaatgctagcaagcatctgggctgctgattgtttcagcaaccgatctagcacaaccattgtgcttcttatccttttagcccagcttatagaccccagtatttctatagtattgtttgtatatctttcaagatggaaatatcagtgtgtcaaaaggtcataggtggagccaggtttttctttttttattaataggttctctcttttctttgtattttgggtcattctgacattaaatccttaaagttgaaggaaatctattcattggtgttgaacttggtcgtgaaggttgctcaaagtctaaagtgattatctcaaagagggggaaaaaaaacaactcagtagtatttggcatttgatgatgaataaatataccctagggcagactggggaaattaagcaaagaaattgaatatttatatgttacatgtaaatggtataaataggcattagtgtttagatgaaattagacattattttgtaataggattttaaaatattgtttcctggatagcttccttcctcagatatccaatgtttttcaagagaattataagcaatatgatagtaacagagttaacaatgagggcagccttaacacaggctagaatgccccaaggcaggaagaatatgacagactagcatagtaacagaaaatagatgactgactgtcttt

SEQ ID NO: 73518 - DNA, 1583 bp, Homo sapiens
agaacaaagcatttgatttcttacagtaactcttattaccaagtgagtcatataaccatataacaaatatattactacatgcttatttattgataacttttttcatttttaaaaaaatcacaaataatacagtcaacttttttccatattatatgtagaatatgctttttgtcaagtcatgatttttataacatttgaaggttttatgaaatagaggttactagtgtatctaatttagcacttaattactgaaaatatgttaaatatcagttttttatacttttaaattgatacattgaattttatgcatatgatatttgacaaatatgatcttcaataaagacattgtactattataaaaatatgtgttatcatttctattattattttattggtaaaaaacgaaatatagcaaggccactttttattgttcttttattcatcaagtttttttctatatgttgagattacagtgataaataagaataaaaaggttcctgctgtaatgaagtttaaaattctaatgagtgcttcaaataaccaaatatataaaataatgtcagataataatttacaggaactaaaataagataggataatgagatggagactgcttaggctggtggtagtaacaaaatttggtctcagagaactaaggagactattagtatgtatcaaactttctagtttaaatattgtttaataaaaatcctcagaagttggtaagatttatataattagtgtatgtggtttttggataaccaggcttataagctgtactatatgtgctaatatggtgtgttttttaaacactgtgaggatcagttgaaactttatgtaatttttcttcgcaggtgttatattttagtacagaacatggtactgctcaaatcttcgtagaaatttttagcccgactttctcagccttaaaagaatgtggaagggtgaattattgaatttacattagtgttttgttacctcactgggccaggaactttttgttttagcttattttcatatgtaaggcacatacccctggatgatggaggaagagagaaatcttcacataactctgccataaacccacagggagcttccttccatatattttcatggctttagtattttctccatgcaaataagaactgaattttttcacaggtgtagaaattcttgtatcactatctgaggtagcacagtaaattaaattcctgttctttcttacccatagtaaatcattacttgccctcagcaagagaacaggcaactatttccaaatctactattatttactatcactatcatttcagaatgtgatttttgttaatagaatgaaaataaagataaaaatagtggactaaatttctccaagaagaaaaatgaagcattaaaaatccttctgagcaaccaaactaagaaagcagtctcctattttcatgttatagtgttaaaacatgatgtttttcgtttttgttttctcatttttttttaaatgatgaacctgaaggtctcttaaatattcacatacacagttttggttatttctgttgaatgttttggtattacataaacaagcaagttac

SEQ ID NO: 73519 - DNA, 1007 bp, Homo sapiens
atgttttaaagatgcaggtttaagtttaataacagtcgtatttatagatacataacatagttaacaagggtttctgtgcataccttttagaagactgtattactaacataactcaccattatctaaaagataatcatgtttctaccttaagcatattttcaaatagataactttccattttgcgggatgaatcactggttaaaattgatcatttttcaaaatttttttagcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactggtgagtactatcaaatttgttatttattctatgtatacttaagatttatatgggctgctttattagtatattaatgaacttagtgaaaaaggaaaatacaaccacttgtttctgtaattaaaccatagaacaattctttctttatggtcttctttcccttccatttactaacgagtagtgtagtgtcttcattccagtgttggtcataggtgatttggtcctctgttatgctgttttcgttccagcgtattcacgtttctttaattactacctcaataatcaatctttaataatgtatgtcagttaataaagtaactgtcagaaatggactgtggaaaattctataggacatgtaacccggtttcttcaacaaaatatcccaagggagggaaaaaaagtgatggaggataaacattgtttaaaagaaagagacttaagcgacatatcagccaattgtaatgtatggaatttatgtgtattccaatctgtggtcccagctactcgggaggttgaggtgggaggatcgcctgagcctggaaggttgaggctgcagtatgccttgatcttgacactgcactccagcctgggagacagagtgagattttgtttcaaaaaaacaacaaaaagaaaaaagcagtctg

SEQ ID NO: 73520 - DNA, 1078 bp, Homo sapiens
gaaagtagttggaggcagtgcggtttatttgccagctgactaaatataaaacaaggtcaagaaaagatgatggttttaaaaaatcaatgtcttatagccaattgtctttatatctggctaacccttaacttttctttcttaattcaaatttaggatggaagtcactaagaggcagtcatatccagaaaaatgttgttctcatttaattattcagtttttctgttttaagctacttttacttcttaacatttagaataaaagaaaatctcaaattactgtttgaactcggatattagtctcagactcacctatttctgtgctctctattggtattttttcagctaaaattcttctcctaatagttacaatatgagaatatggtatgttttaaatgaagtaggcttttaaatgaaaatcaatagtgcatttttcatgaaacaaaataggtttaagaactcctttagaccttatttctaaatgtaaacattgttttataggtcttggaaaagtaattttcactttttattacccatgggaatgctaaaagggtgtggcaattatatctgatagcagattgcctattatgtactcacatttaaatgtattcagtcattagagtagaaaattcacatcagaaaatgttataccttaattagactcataaataagctacatgatatattatttatttattgtaggttcatcttgttcatttctctcaagcaagaaatagaattttcattcctgaatatttgcttttcctttctctatcacaacctatcttcttaccccatctcccttatagatacatacatgagtatacatgcacacacacatacagatatactcacttgtctttgaacccatgattatcttctcctacctttcttatgttgaatttttttttttttttttttgagacaaagtcttgctctgttgccaggctggagtacagtggtgtgatctcggctcactgaaacctctgccgcctgcatcccaggttcaagtgattctcctgtttcagcctctgagtagctaggactacaggtgtgtgccaccacacccagctaatttttgt

SEQ ID NO: 73521 - DNA, 1008 bp, Homo sapiens
tagcctctgctctaaaggttgtatttaaagaagcaacaaaaaacagattgagagacaggaagccataggtactatgaaaacaaatgtaaagaaagtacacaataaaacaatgttacataaatttataaattgagtgagagagatttagaatttgggttttctttattttagtcaagggagaaagggagatacagatattaattaactttaggtcttgttaagttgctaaaaatttatttgtgtaataaaaatacaaggataaccagtgaaaggatagaaatatcaagtataaattctaaactgtagtgagagaaatagactaagaaggatacaccaaaaaaaatcaggaaaaataaaggcataactaaagctagacaaatagatggaaacaaacattttataaatcacaataaattttttaaaggactgtaatatcgtataaaaaataaaatctggttttatgctgtttataagagacctccctttaccctatggatatagaaatgtttgaagtaacaggacagttaatgaaatacaaggcaactattaatcagaagaaagggaaactatgttaataggtacaattgactcaagacattaattacttcatgacaacaaaaagcttaattcacgtgaaagatacaacaatttaaaaatggtatgtgcctaataacatagccccaaaatgacattgtaaaaattaataaactatatcgataagttgacagatttaggattatgttaggaaatgtcaacaaagttctttaacttactgataagcagaaaaatatcattaaagacaagcgttaaacaattaacagacttgatttgattagtgtatatagaattcaaactcgataattaaagaatacacattttttcatgcacaagttgaacttttataaaattggttacatactagagaccatgaaatctcaatacatttttcagtgccagttttatttatttattgaccacaatgacatgaaattagaaataaaattaaaa

SEQ ID NO: 73522 - DNA, 1062 bp, Homo sapiens
tatagagagatcctgacttgcctatcattacatagctgccaaggagctaagattctttccaggctgtctggctccacagtctataccatatgtggctgacctgcgttaacatctattaaatgcataactgctattgctgtgtcaaacgggactagcttgaaacctaacccctctcccaatagaagaaaagaaaaagtggccatttttttggaacaatcgtttggtttgtaaataattgatctaaaatatgtatagtttaagattgtcttgggatttaaacttaagtagttaaaggctgggtttaaaagctttttgctatacctttgactaactcatacagtctctcctcagtgtttctagaatctcacgactaatatgtatagatacagcccttcgagttcatttttttgtttgctctatgagagccttgttacaatagctaaagaaggaatatctgttccagactgctgcctcaagccatgtagaacaagggggaaaagtttcaaaatcttgtagcttctctgaggaacagctgtttattttgacagcagtttaactcacttctcttctacttgagaattctcaactgggaattaattttttttttaaacaatcgactgtagataatgtgctcattgggaatggttctattttgaactactgatcagtttcccaagaaatagggagtaagtttgcattgtaattttctttagctttatttttgttaccatgatcaacagaacaaaaccaaaacaactgtcatggtttgaagttacttcttactagatccagtgcccagtgctttgcatggagtgtcccacctcgtctttcagtgttttttttttttttttgaggtccagaatgtgacaggtgagataactgcagggtagagaagctccatgtctttgcagagaagcttcagagttggtagggctaagactgaatggaagcctgcctgactccaaggcctgttctttaacagcttcaggtacattgctgctcagagagtttgcaagaaaagccaaggttgtaatttttaagagtgtttttgataacttacta

SEQ ID NO: 73523 - DNA, 1074 bp, Homo sapiens
tacacgcaatttgcctttgaataggttttacattcgtagggtttcctttaggatactttaatagggaggtcaggtctttgatgtggaatcctttcatttaggcattaaaaatatcttttcaaacatattagctgattaggtggggggaagaaaagaactacacacatattaaagtgagaaggcattgttgcctccctagggaaactggtgacatatttctacaatgaaaaattgttattcttaatagatgggtaagtcatttctgtattttagcaattgtttgtggcgattaaaaagttttgaggtgtgaagaaaaagaaggttgaatttaaagaactggttctttttaatctcaggaaaactttattgctgaggttgttggacttggttataattatttagttaggattagatagccttttaataaaaacactatttttaaaggaaaactaatttacaggaaaaatacacatttggtcacagttctaatttattttctccacaaattcaaagcaattctgtaaattatttttcattgccagaaatgaatttggttaataaatatgatatacctgtatgtgtcacatactttgcaatatattattttaaattttgtaatgttttgtaaagcaatatggcttagtggaaatagtaaagactttgcagtctgagagagctagatttgaatttcatacgagttatgtgtctgaagacttgtttaaccttgagcctcagtttccacattggttttaaaaaagtaatgtgaattccttccccataaaaatgttttcagtattaaatgagataatatatatttaatgtttatcatagctcctggcacatggtagttgctcaataaattattatacagtaaagggttaattcagcaggcttggggtgctcaaaaccttcatattccaaagaacactggcccctgactggctactaagagacctagaaatatcctgcctgataagggcgttttatatacctggggccttgggccaacctatatagatatgctaatgatgtgatttatgttgaacacctgttttgtctacctggggccctggg

SEQ ID NO: 73524 - DNA, 1112 bp, Homo sapiens
aaagaaagcttgacatttgtcattataagtagcctctgataccttttctttcccattgtagataagcttggacaataaaaaacacttttccccatctttcccatctactcactgttccctgtcaagagatgattttgaaaaatgttcaaattatatttaaatcagtccaattttaaaaaatgttttctttttgtctctgaatagactgatgattttgtagtatttccaatggtcaagaattctaatgaaacttatttctgaagtgtggtttatttgtgtgtgtgagcatttcttaaattttgtcttacgttttaaagactgtcttactgaatttcttttataactagattttaaattgaaaggttaaaagtgaaatttatttttattttataatgaattttcttacattattgtgagttgttttcatgaatgttttgtttctagggtgtcttaccttttatatattataattttgtcctttccgggcatttaatatactctcttttagtctctgtagaaacgctggaaaagaatttgaggcagatgggaaggcagcttcaacagcttgagaaggaattggaaacctttccccctcctgaggacttgcatgacaagtttgtgacaaagatgtccatatccttttgatagctaaataacttaagtcactagtcaactagagatacaatttatttaatattttagatgtctttgtgtaaccagagatcattctgtagtgccaaattacagaaagtttaacctttgccttcttgcagggaaatttatcaaagtgtctgtcaatcatgaataatacacaaatgtctgtctgtctgtctgtttgtttatttatttatttatttattttttgaaacccaggctggagtgcggtggcatgatcttggctcactgcaacctctgcttcccaagttcaagcaattctcctgcctcagtctctcaagtagctgggcctacaggcacgcaccaccatgcccagctaatttttttgtatttttagtagagacagggtttcaccatattcgccagactggtatcgacctcctgacctcaagtgatctgccagcctcagcctcccaaagtgctgggattataggcgt

SEQ ID NO: 73525 - DNA, 1041 bp, Homo sapiens
aagaaaaaagttggaaacgggaagagtaaatgaaacaccattggcctaatcaaatagaatcttggttgtggataattgacaagcagacataaaaatgaaagagtataacataggaaatatatgttaccactatgagcaatgcacagcaaggtattggaataatttaaatagttaaaaaggtaagaatatgtgattcttaaatttgagacaatgactcagataatagtgtgtattattatagcatttagtgtgtaaattcaaagtatcacagaaagggaatacgtgagaaggaaaaaaaaaacctactgagaaaatatgcatgagtgtaaatccagactagcttcatcatagtgggagcaaacagttaaagtaccatcactcttcaagcacaaacaagtattatatgtggttctcggaagagttcaatcattggactccttaaacgttgcatctgagaattagattgctaattttttaaaataagaaaatacatttaggttttattaaaagctgttaatgtcagaataccaaatgttattttctgtacaaccaggttaaaaaaacaataaaacaccatttcatattcttacacattatttttaatgtctccttactattttattcttttgaaccaagctaaaattaaaaaaaaaacaactcagtttcattttgttgggcatttagattgcttccaaggatattcctatccttatagataaaacttgaattgcacccattcttcaggattaattcaaatccttcaggattaattcaaatcctaagaatggcagattaccttgaattactgtattcattctttaaacatcattttatatagttcacattgaacaaaaacaatagatttttttttaacctagaattcatttgtacctaaagcaaatattttaaaagttggtttaggtcactctatcttctttttgcactattaaatctttttcctggtgtcatataaaattgactatgaaaagattttcagaaatgatccttaatgtctgttctgctgggtggctagtatattct

SEQ ID NO: 73526 - DNA, 1002 bp, Homo sapiens
agtccctctcccacctagctgagaagcactcactcattggggtagctctatcttcagttaccagtagctggcttcctctgagggcagcctagactttaggcacctctgagaatgagccaaaaatgtgcttctcttacacctccctactggaattctgccctctgaccagacatgtacttctatatccatacggtacaatgaaaagtaaatatttggtctttgccccctggttcctgacacgaagctcctagaagttttggaatttcctgagtgacacatattttgtatgttaatgtagtgactaaagacaggtaggggtatagcttcaggatgaagactggtttctagaagtagtaaacatacgattaaagggttagaactgtgggcttatacccaatgtatgggtgcgagaggggctgaagattgagctcaatcacaaatgccagtgatttaatcaatagtgcctttgtaatgaggcttcaataaagactgaaagaggttgggggagcttctgggttggtaacacatggatgtgcttggagggtggaagtgctggaagggcagtgaaactgtgcaccacccccgtcccaccattccttgtcctgtacctctcttccgtttggttgttcatgggttgtgtccttcataataaagctacaatcataagtatagtgctttcctgatttctgtgagtcattctagtgaattgtggaacttcagggaagggagttttgggaatccccagatttatagcgagtcagtctagagtggtcctctagactggcaactggcatctgaaatgagggtagttttgtgggagtgagcccttctacctgtacagcctgacactaaatctgggtagttagtatcggaattgaaggattttctccttaacttatggagtctgcactaactccaattgtaggacacccagttggtattggagaattagacaattgattggtgttggaacaatgtatttggtgtcagagaaaaaatcaa

SEQ ID NO: 73527 - DNA, 1976 bp, Homo sapiens
gaaaagtgagtttaaggtgccagctaaatattaaggaaacatgtccaaataggccattggagttcaggggaaggatctaggcttgagaaaaaatttggacttttttgaagtccagctaatacacaatcttggaattgtgaggctgacctggtctccaatagcagcaagtgaaaactagtcttacttgaaagtcagtcagtctgtgcttaacatttcccctgtgacaaagtaaaaagcagtaaaattgccctcccatgtacatgtacacagaaccattatactaagggaacattttgaatattgttattaaacatttctgttatgcacctcttatgtaatatttataccatggttttgaacatcttatctaagggaattctgaaatcttataggtaaacatgatttcctttgagatgggcttctcccactaatacactttctcttctaaaaggctgccgcctttaataccctctttgtacttgtaaaggacagggctggctctttctttcaggggatgaaatagctcaacagaattgactgggggcctttaattggttgtattcatttcctctacttgccttctccctttcttctttccatgttccatagcagatgaaggcatttctcttgcagtattatgtaaaaacaacaaaaattaaaccatcattgcatacagtatagtaaattaattaaggaatgcaaattccatttgttattacctggggttccatcaagaatcagaacaatgggaagaaagaagatctgagtcaggtaagtcaaggaaggtacaactacttgatgaggatgactggctgttcacttagcattgctcctttgtctttcttttttttgagacaagatctccctctgtcgcccaggttggagtgcagtgatgcaatcattgcttactgtaacttcaaattcctgggctcaagctatcttcctgcctcagcctcctgggtaactaggagtataggcaggcaccactacccctggctaatctttttaaaaaaatttatagagatggggtttcactgtgttgcccagtctggtctcaaacccctggcctcaagtgatcctctcacctcagcctcccaaagtgctgagattacaggagtgaaccactgcacccggcagcacagtttctttcaatttatctttgcctgttacgaactaagctacaatttatttttactttgattttttttcagtattgttttagttttgtatctttttgtcatgtaatggattttataatggtattctagaatttaggttttgttgtagacctacttaatagtcaagatttttttttatactactgaggtttgttttggaccaccttgtccatacaattttattattttaacttgcatttataaaatgttgctatagctttataaaatgcttttattattacagttgtctaggaagaaatatattgcttggagcctgaaactaaataattttgcacatgaaacaattgattctatgagtgtaggaaggtttgatttagtttgcatgtttaaattgtctatggtaataagttgttctttaagctttccttaaagaaatcaatttccctggattgtatcatgatgtgtaagagtgagtgtggcattttttagtaagcttattatgaaataatgaccaacacctccaggagatattcatagaggatttttttttttaattacaaagattatgtaacctctcctttcttacttgaaatcttaatctagtaaatcatagaggccatggtgttataaaaagcatgtattcatgactgctttaaacttaaatatttatagtttcgattttaacttttactctaaagcttctttaacacctctggtgtataattatcataataataagacacttggaggaaagcctgtgtctttgattttaatgtctgggatatttaatctgttatattttcctgtttcatttttaacgctcttatctggcgaggt

SEQ ID NO: 73528 - DNA, 2634 bp, Homo sapiens
aaaagacacgttaacctctttgttgctatagccttctaaaaatgccagttacaatttgttagtgagtttgatacatattttgaataatcagtattagttattagtttaattgcattttatatcccctgcagcagagtcaacaacacagctaacattatattggttggaatcattatgtcgtggaggttgtaggttggggcctcataatttgtgtacgatatattatttggtctttcaaatcaggagtagaatattagaatgttatgaaaagacactttttttttttttttaccaatatctgcctatatgatgtagttaataggttacattgttggtggtggaaatatttatgataaaataatttagttatagaagacaaccatgtgggatgttgcttttattgactggtcaagggaacaaaaatgttttctaactgttacaagctgtactgttccctcataaattcctatgttaaagccctaaacctcagtatgtcagaacttgactatgtttggagatagggcctttaaagagaggagagttaaaatgagatcattaggatatccctaatccaatctgacctgtgtccttataagaagaggaaatttagagtcacagccattcaggaatgtacatgtacagaggatagaccatgtgaagacacagtgaggaggtggccatctgcaagccatggggaggggcctggagcaaatcatttccttatgcccctcagaggaaaccaactctgccaacaccttgatcttggacttctggcctccagaattgaggaaatgaatttctgttgtttaagccactcagcctggggtattttatgaaggcagccctagcaaactaatatactaacttaagacatttttctcatttgcttagtggtctttggctatagaatacagtagcctatactgaatggtttttcactttatcaaatcagttgaagtagcagttgtagagctgctgtgttggatgtgcactagtaatcaatttagaaatatcaaagattcttctacaaactgaattatcagatgttttgaaataattgcaagtatgcttcaattcctcttttgagtagacatgaaacataaagtagtacatgtataaggatatattaaggcattttaaataaatatattcatgaaaattctcatttaatttcaggattagatctacggcatttcctagattttgttttagaatacagttaatcatactataccaagtttttgttttgtctttttcttttactcactatatccatatatatatatatccataaatatatatatgtttcttttccatttctccctgttttgctactataatagttgtaattttcatataagcaggtaactgataaacattagtaacactctgagttatctcttgacacctttccaaaagtaaggcataggtggatgatgttactttttttttttcattttcctgtgggaataatgaaagtatttagtatatccaagttgtgtagtgctggttctacagatagactgtggagtaaaacctatgttcgtaaagccagcttatgactcctaatggttttatgtctcagggaactaatttgactatctgcagtcatctagtaagtatacttaggaatttacttaggaattctaaagcatacattagtatactttacatttatatttagtaagtatacttaggaattctaaaataattttaatgttaatataagccaaatataataaaagttaaatttatttttaaaatataatttatatatgtttgcatatacttaccaaaatgttagaatatgtacaattttatgttcaataaattaatacttttttcacaaaaaggtatgatgagatataactgggccattcccaaggtaattacaggatttgtgaaaaatatttgtagtgtattgcaagtgtggtatagtggtaagagaccacatatttaaatcctgccagtttatttccagggattatctgtatagagttggcatgaaaagtttaagttgtagacttggatatgagattgtaagagtaatcattttgcagtgcaaatataaactgtgttggaaagcagcagagtggaatagaaagagaatgtcccaaaaatcactagaaggattaaggattctgtagattgacattaaagaacactgggcacagaggaactacttgcagctaaagattgctttttgagatactgagctaggaacatttcctgaatctgctgtggcttgggctaatagatgatgatgaagaagaaaaccacatcaggaagacctctatatctttttggaggttaacaggctgaaagtgtcatcaatacatcattaatcttttcgagaaactaacagtttacagtgtttgcagattttgggccagctacggatttgaagtagctacttgagcagttctgtcagtgtcacctatgaactatagcgaacatcaagtaacaggacagtatcaccagtgatgaccaaggttttagaactctcttacacttgtggctgtaaagcaatatttactgcaccttagttttgcaatatgaagtaggtgaaagaaaatttcagaatagtatattctgaaggacagtttaacataacaaatctgtgtactacaaaga

SEQ ID NO: 73529 - DNA, 1029 bp, Homo sapiens
ttatttgttgttaggtctccaactactacagtagctagtaggcattctatggatatgtgccaagtgataaatggatgaatgccaaggatgtttaaatactactattaaatagactcataggttactctgttttcctaggcattttccatatttttttctataaaacattgcatgctcgattaaacttattccttttttgcgacaaataatgattttcaccaagcagcaagtcaaaagtagtttttcgagtatttaaatatttgtttttcaaaaacgaaatcaactaattttacaacttttagtccttatctacaaaatacagtattaatattatttaagtagacagaatatcaacatacttatgactctgtgttttttctccctcctgttctatttagctaaaggacacaaaatcagcagatcagaaaacaacgctacttcatttcctggtagaaatatgtgaagagaagtaccctgatatactgaattttgtggatgatttggaacctttagacaaagctagtaaaggtttgtgcctttttaagaaacatttcatggctctgatcttcagtgctaaaagactgaaaattataccttttatttgtatgtactttccactttctcacagtgttttcatacccaatatctcattttaaaaataaagagagttgtaggatattatgagttgtcatgattggagctatgagtttaatttgtttagttagatgatgaggccttatattataaaatactttgttttacagtttaaaccttgtagatacctgctagccctaccttctactgctaaatctcctgcactttttggccagggtgatgctctcttgattcaatgtcattcataggcactgatagcctattacatacctgataccagaaccagcaatcagtgtccctccctacttacctgagtaccaaatctatctctgcccaacttgttggtgctctctttttttgttatagaagacaccatactgccagagtttcatttcactctttcctaatgcccaa

SEQ ID NO: 73530 - DNA, 2107 bp, Homo sapiens
ataatactagtttggggttgtaatgttttaagcacttaacatgtgttatattatttggctaatgtctgtctcatggtaagtaccaaacattaatgctgaggatgctactgtcatcctcagcattaatattattcacaggttgtattcttctaaaatggtaatggtgccattacaagatttttcagaattttgtcttgtttctggtgttcactaatgtccacagcatctaaacatctaaatattcaatgctgctttgatacatacctagattataggaacataatgatgcggagtagagttattaatgtgataatattcttaagatgtaagtttcattatttcaaacaggaagggattccagttccttgacttctgaagatcacgaagatgcttagtttttattttagggtttaaatttaaattattaccatgtgactaaataaatggaatattctttaaatgtcatccagatttgtgctgaatacctcaaaaatatccccaaaccttgcactgtaactgcaagggagttttactgcagactgacaactaggccatgatttattacaggatccacttttaacattattttgtctggaatgaacagagtggttggagaaactccatccatcttttgtttatttgacatttatgccacgttaaatgtaccttaaagaaacaatacataaataggaaattctgtttaacggtgatgattactcatcagtaagataaatctcttgacagtaatacaaaagaaatcctgtcaagcactgactgttaaagtttaaataaagcatacttttaacctgaagatatttttaaagcaaatattttattttctttccaagatttagcgttacaaagtttacataagttgttactcatcttcaacaaaattaacactgtattccaagctttacttgttctagctcagaaactgattatgatatgagtgagtatgatatgagtaggagtagaatgtgcctttttagttggtaattttcattaatgaaatgaaaaaaatattgagcaaatggataaggacctaatacattttatgctttgatgcttttggaagactttttaaaagatggttagagagaggggagggagagaatagagtagttgaggcaggaagagtatcttggcagcattgtgaaatttttctagagaatgttagagcataaatgaagaatctctgccctggagtttagagctgcatagtagtttataaatgagacaccatgcatgatcaacaacatgcttcttttctgaacctcttatttattaggcttagtttcaaatttatttacatgaaagtttgagtggtgtctttcaattgttaaatacccattttgaaatgataggaatattgtgcttccctttactattcagtgagtgtactttttaatactagattgttcccattatgctgcttgctactcagttgatgttttcaacaagacaacccatggtagcaccctcctcctaaatcagtgtttagctttataatggtctctgaataactcgaatctgtgtttgacttgagtatttaacatttattaaactaagttgctacaaactacattgttttccatgattctaaattctgaattctcattgcttacaaataaagaccaagagcaatccagttggttgttcttccgtcattgagatttcttgatacgttaatcctagcagttgctggctgtttagctatatcacagatactattggaatactctttctaggctttacaaattgtgaaggtagatggtgattgtcttaacgttccaaacagtctacaagggtgtagactagtaaaaatgggttgccgagaattcagagtaggaacagtgttccccaagtagtcattgctgtaaatgagggtgggtgagataaaggatctttgctactagggtgctttttaacaaaacagaatacaactttcatgttaacttttggtggctgtgcaaagagaaaactgtttgtaaaagtttgctgcttttaatctggccttacctatttaagatgatagtatgaatgaaattataggattgtaacgaaacttaaagattgtatttgacattcatgagtctatatgtaa

SEQ ID NO: 73531 - DNA, 1547 bp, Homo sapiens
ttctaagcaggagtcagcagcttccaaaagggttatagcatggcatgtgtgagtacagtgagtggcctactacctttgcaaactagatgggaaaggagtggggctaatgagactgaggtgataaattggtctagattgtaaagagctttgaatatcctgcctaatgatggagattttatggagtcacactctgtaaggcaagtaatatgatcagatgtttcgtagcaagatatgtctatcagcagtatggaagaaggttaagctgcactgtttagtactgttgccatgaaacatatatggctacttaattcaaattagttgaaatttaaataaaattaaaaacatagttcctcagtcacactcgccacatgccaagtgctcagtgtccatacccgttggcagcatatatatggcacattaccatcattgcataaagttattggacagcgctgggttagagggttacattgaggaggtatttggtgtttggttgacatgtagtgtgagacctaagagagcaacagaggaaaccaaactgagaaggtaataggaaagatggtatgggggtggcagagaagagagaaaggtcaaaaataattcctaagtatctaccttaggcaactaatgggagatattgctactggcatgtttgaagtggttgctcaaaagagaatgagatcaggggttttttgttgttattctactcttgtttacctcagtatcttaaagggcatatgattgaagctaccttattcaattatttagcaaaggtttgagtgtccactaagtagctatcactgtgttttgagatgatggagttccaagctaaggtaacggcagaagggtttgaggtagaatgtagtggggatgtagggaagtacacaaattcagggacatctgaggagttgtcaaggtgtgctggttatgaacttggaagctgaaggagaaggaggcaagcaagaatggcagattcaggctttccctgagaaggaaggcaaagtaagaaaaacagggtgaggggcaagataggggaaagttaatccacagccacacatgtactacagtctgtttcctcgtgcaaaagtgtctgtgatcctctttaggttttacatctcagaattatagttgacacaaaaaaactggctgcatgctcttcctcatgtccttatgccttcctctaaggagagctgttgacagggagactaggtgtgattaatgaggtaggatagcctactgcagtggttggtatatagtaagtactcaataaatagctgttgaatgaatgaaacttgtcataagacaaaaagtagtgtcttatgtttattttgttgttgaaaataaatagacatcctctcattgagatacaatcactgatgcatagtaatttttaaatcttttacaaatgcaatgtagctgttattcttttactacagttagtcggcaaaccagttaatctgtctgcagataaagagttgactttattttcttgcaatgatactgagtattttgatcatccctcttaggagccttctgttgtggaagaaaca

SEQ ID NO: 73532 - DNA, 1570 bp, Homo sapiens
gctactactcccatgtttcctaactctgattctgctaatttagtatgtgtcaggagtcattctactttcctgtgtttctgaagaaagtcaatttagtacaaattgggacctatttactctccctctatctaacacatactgttagtcagcagggtttctgaggacagcaattgctatttgaagaaaacaaaccctctttagacttttctgaatgtgttttaaacatgacccagtatattgcagtattgaacaaaaattattcaaaataatgacatgaatgccttgtaatttgtggcctatgtatcttgttacctttttagaatttagtttaaaaaatgcttactttattgcttaattaaacattatcatttaattaaagctttcttttcattgagcatctaaattgttaatttgggttttgagggatgactctggattccttacaaaaacaagcagggcttttctctcttcctgctatcagttttaggagacatatttcttctttggtactgtcataccaataaatcatcccagattacttgcagtcgtacagtactaaactataccatgcattttaaaggaaatctgctgttttcttttcaatcagatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaagtgagtttgtttttttaaaaacacatatttgcctgaacacttgctcttaaatgtcagccctgattgcattatttaaatatttttttattttgatgtgctcattatcaagaacttgaactgaaccatgaactcaaacccagagtgaactgagctaatttactcaacctctgaactaaatccaaatattaattttcttcaatctgcaaatccaattcaaggattttatttaataacaaaattatatcataaacctatgctttctcaaaccaatgaaatggaacgtcaaaatattattaatactgactcgtacttactcagttcagatacctgtatatatattgaatattgcttaggattgccattaacatttttacctttaactatttaaatatttctctgcattgctttcataagcagactgaaaggagagaaaaatgggacccctttatataaaggggaaattattatattggaaatatatgcaactcggatattattgattttgaagtgtttctatctaaatataattctagaggacatgaaaatggagtaagtttagagccttttttttctcctgtgtctttcataggttgaatttccttacagcaaatatattcaatgttttataaaacagagctctttcctgaggagtgggccatagtaatagggctttattgatctgcttacaacaaattcttctcagttacacatcagaagaaaacc

SEQ ID NO: 73533 - DNA, 1036 bp, Homo sapiens
tctgctattttccattactgctatttttctttcttttccaaggatgccaattttatatccaagtctagatattacagttatttagaagagcggataccgaatagccaaagtgattttttcccgtttagtgaaacactagcactaacttatatgccaccagcatcaccactaccaaataatttgatttactatatttgtccaaggaaaatctaggaatttgttcaaattgttatatgttaggaaattcctttttttgtgtttatactgtcccacttacagtatattgacttacatttatgcattaaatagtcaaaacttagtaatataaattttaatttgtttaagggttctcagtttgtggctttatgctgaaactgtcattaggtcagtttttattctgtcaatattttgttccttgttgtagcattatgtgtcatcttcttatggtaagctatgtggcattactgaagttttatgttttggacaaatggagtctttctaccctattttatcaatgtttcctttttaagtagctctccttggaatcactagccacagtaaagtgcctaaatcattctgatcacttgaatgctagtattttctgaaaagatttaaggttccagcagcttaatattgttataagtttccttgacactgtatttgtttttcctaagttctgacccagaatttccaaaaacatttcatatttttaatgtaattaagagaaaactagttcaattagcttcatgacaatctttttctttactgctcaattgtctgttctattctcattctatttatgtgcttttgaggggtgggggggcaggggagacttctttccttttcttctctctttcttttttttttctcctgggaaggactatgtctgctgtggtcttagctacttcttactgaattcttattaccacttcctttggaattatccatgattttgactgctggcctcattaatgatctctcttagcagttagagaccactgtttcctcaacctgtacttcctaaaacgcaggtttc

SEQ ID NO: 73534 - DNA, 1023 bp, Homo sapiens
ggggcacatcatcagcaaggttttgtttgtttttgctgctggttatcacctctcaaaggacaattgcaatcccttacctagggaattgtacaaggtgattttatatataacactattgcagtttgtttcaaaaactaaccatgagttggggtgagagggatatttggcatttgtagggtatataattcatcagggacatttagaaagaagctagtggccatgacaacgtgtgtctgtgcagtgaaagaaaaaaaactttttgcctccagaccttgctctcatatggaagaaaatggaataatctctaatacatcatgataataaatatatagttcctgtattatgaactaagataaagttaaaatgccagaagtgtgcaggcatattcctttataaaataactctcatttaatcaagggattgagcttatttagttcaaatctccatcaaaatagtaatatcaaatcctgccattacagggaaaaaatcactcacatgctgccaattgtgttctctgtagagtgggaggataagtggaattgagctctgaatgaattctcttatgagcttttgttactctttttcccttgaaattagtagaatgtcagctatattaaataactctgcaattctttaatttattagaactaataaaaacccagcatgatcagaataatatgctatttccttgagctgctaataacttgtgagtttctcaaaaagtttgaaatttcaactgtgacttatattgatctctcttctttttaattgatggcaaaaggtacaaaattttgcttgtgttttatatcacgtgcatgtaaaatttgtgaaagaatttgatatagcatctcaagttatatttaacacagtctattcttaacacaacagccaacgacttcagtcacataatgttctgttttacctataaccctacaatgacttcccacctcagaggaaagtccagaattcttgtagtagtctacaaggctctacataatttgtccctgccttggtatttcttac

SEQ ID NO: 73535 - DNA, 1709 bp, Homo sapiens
aactctcatttaatgctaaaagactaaggatcctggccaaatggtgttttagaggagtgccctgagaggtggtctatctctgtatctttttatagtggcttgtaatgaataaggccatttacatgctgtttttgttggtttaggttctgggcagaggacactgaatactgactgatgtgcttaatttgaaatattcttttccctggacagtccaggacaaaattttcttgtggagaaattggtgtatatttgagaggcaatagcctcctcttttactcagcttaattttctatcactagattaacaaatgaaaatatactttgtcattaattggagtcattgcttgtgtctcttcttggattctttccatccctgtttatccccaacaccttctcgtccatctttccaaaatattacctacttaccaagggttgattccgatggagtagagcctgactttagttttatgactgcatttcttgtatttgtaggctttctttgatcaataagctattaggtaaaatcactgtgttcacagtggcatgctttaactgtgagaaatgatttatgtaaatattcagtgggatcagaagattagctgaagtttggaaagaggcctaaaaatttgcagttgaagcttggtgtactagactttctttgattaaaaattctaggtttttgagtatttgtctccacgttatttaattctgttaagcttcctgttcttcaaagaaatcaaacatttataggaagattgaatcgaacaaatgtcctgtttgtgtgctgtattttgatctaccaccatttggtgtcactgtagggcagggcttttaaactttgtgcagctgaggcctttttaatgaaaaatgttgtaggaaattcgtgcatatctccctgcattaaaaatccctcgctttaaaatacatcatatattcttgttgtaaaacattcaaataacatagaaatattgaatacaatgtagatgtcccccgtatcccactacctcttttcattccacacaaatgatcatttttaacaatctgttgtacttctaattccatttctgtgtatttaccaatgtatgcatgttcacgtgaacattttaaaaaatccattgttctgaaactttttggctgtgtcatatattttgaatatgtttttcatgttgtactgtttttaaattcgtgcattttatttcatagcccatattatgatttttccttttaatcattctcttaatgaaggacacttagttgtagtttctctccgtgcctcaggttttttaaaaaataattctgtatacatctttgtatttgaaggcagtgcattagtattgcacattgtctgggtttaaattctagctgtacctcttcctagctatatgatctttggaagttactcattttttgatacctccattttcttatttatgaagtaggactatattagtttcctgttgctgctataacaaattaccacaaacttggtggcttaaaacaacacaagtttatgatcttacaattctggagatcaatagtccaaaatggtttagcttgggtgcattccttctgagggctctaggggaaaaatttatttccttgccttttccagctttgagaagctgctagcatttcttggctcatggttcagcattgctctgacttctatttttggcatcacaaccccttctctgaccctcctgcttccct

SEQ ID NO: 73536 - DNA, 1020 bp, Homo sapiens
cttgtgtattcctttaatctttattcaagtagttctgttgtttaagtgtgtggcttacttaagtttctaaaggacctctacatgccttttatctgcaaggtatatcaatcatcatgtgtcttcaacaccttttaaaattttctttcacatcagaaaagttagtttgttttagagatatcttcagtttttattattaaaactgtaatcctattggtaaatcttgcaagcactgccattaaaattcccttgatttctattctgtcccttcccatgcctttttgtagcaatatgatgatttcttttatccccctgagtgaagtgttaaaatatgtttggctttgcctgaaatttctgacatttaattccctaaagctgaaatgtaatggatcacattcatccaggtgagaaagctgttcctttggtataggttgagttctctttctcaattatatagctaatcaaataaacattcagtttcagtagtgcttgatttgaatatataataactctgggatagagaaatggaaaattgactgttttcaagatgcagggaattttgcttaaggcttattaggagggaggttacctagaaataaaactgaagattaacttcactggttttctttcagtagtttttaaattatatttttaaaattcaagaagtacatttagtgaagatctttctttctggttttaatttttagaacttaataaagcatcttcctgatcaagagcaattaaattcattgtctcagttcaagagtgaatatagcaacttatgtgaacctgagcagtttgtggttgtggtaagtaccgagtctcagagaggatttttatactgtgccaaacaagagaacctgtcaactgtttttatatcgctaaatgtaaaaaagcatgtgagtaatcacatacatttaatatccatcttacttttttttaacttaaggatattcatgtgaaattaccttgatttaaaatatatattgaaactctggcattaagtgaagtccaaggggcttt

SEQ ID NO: 73537 - DNA, 1904 bp, Homo sapiens
aatatattcaaatggtagagttggcattccttttatgaaaatttcagaacctcctctccttcgtaatcactttgatctaaacccatctcttttctacaatgcaggcctgccaagatccccatggatagtatggcggcattggtgtattgtctagtattcaattctctatttctgggcactgctgattgcacatctctgcccctgtcaagttaggagtcaccaagtgacatgcttggaccagtgaagatgggagtggagttaatgtcactttttggggtggaagcatttcattggtggttgaagaagctccccctggcacccagaatggcattcagagtggtgtccatcatcctgatatagggatcataattaataattaacagaaactggtgtgatgaacatatggtcttcatgagaaataatttgtgtgtgtttgcttagaccacagagattttgtgttttttgttttttgcatgatgtacatattttagggaatttccctcccaaaagaactttgtctaggttcaaagcactgtgttttgaactatgtcagataatgtcagaaagttccgtatctgtgatctaaaagagatgattttattttgaaaaatgttcatgacctgcattacaaattactagtgttgattctaaatagtcttgtaatagttcccgaagaaatataatgtttaatagaattctttctgaatgggtcagctgtggtaagttagcctaaatgtccatctcatagttaaataactttttgaacacggttatttatttatgtattacagaacatgttctacatgggatttcaaatttaattaaaacagctaataaatactgattacctttgtttactagttctgtatttggccctttaatcttcactacaaccccaccaggtgggtattagcattaacagtataggtagggaatctggtgggtgtagcagttaagtgatttcaataagattgctcattttgaaaatattttaatgtttatatagtttaatgtatatctgttcctttttacagaaaacagaataacatttttatggagaaagatcctgtttgccttgtttaatttagctagagtatatatatcctattcatttaattgagaaacatgttttaaagtgtaagatgaaaagatacagaatttataccatgtcatattatgatgtaatccattttaagattattcttctcctctctgatggtagcaggcattatgatttaagctttaagaagctttagcagcctatgatcttcattgtaattatagttttttgtcatgaaatttagagttttgagagtctgaattctgagatgagtcttagaactgttttggaatgagataaattgaaataaaacagtggtcagtagtagaatactgatactaaaatggaaaggttcatttctaaagttcattgaagagaatattatgggtatgtactagattagaactttggagaaagaatctaaaagtcattcatttatctacttgtctatttaaaagtggttttggtttcctatatttttgagttcataaaggtttccagacactaggatcaagagaaggcttaggagttttataagtttcatttgtttatgattttttatatttaaggttgttttctgcaagcaagtacagcttaacttatttctgcctattttttttctcttacctaattgccctggctaggacttcaagtaatatgttgaatagaagtggtgaaagtggagatccttatcttcttccagattttataggaaaagctttcaacttttctgtttgttatgatgatagctgtatgtttgtcatatataacgcatatatttattgtgttgtgacacatttcttctatacctaatttgttaaaattctttatcataaaagaatga

SEQ ID NO: 73538 - DNA, 1057 bp, Homo sapiens
tcttgagaatactgtagtttcagtctgtgtttggttgcaaatgggagtctgtcaatatggaaaactgactacatttattgaaaaatacctgcatataagtgtacctgtgcagtgcaagcacgtgttgttcaagagtcaactgtgtagttatttcccaaagctttaaatcctgtttattgtgttctggagactaaacatttctcttccctccctcaggcctattcagtttccactaactgtcctggtgaacatgtacagcaagggaaaatttggatcaagtgtaaatgcaaagtgtggggagttatcctttctaatgtgcttggttgcagactgctttcctcatgcaaattccatgtcccagaggatgctctaggcttgctgtgtggtggtcagttcctggtctcaggtctgctcatagccaagccttgtgccaccttcagcatgtagcttatattctctgcttaggtttcctgatttatagaatgaggtggttaaagtccatactgaagggccgttctggttcaaaaatttgtatctttcaaattttgatactctttatcagcctcttagaatctcatgagttagaaggcaaagaaaaataacagccattatgcaagtaattcatagatatctccccatttgaagactgtcagggactggtgtttttcattttctaggtaaattattttgcttactttatttttttagttgagttgaatttattatcttctctctgtgtcatagagaagaatgcttgcttatttattcagatatacttattttcatactcttaaggctagtgtaattacagtctatttagaaaggtaatttattataaacattaacatgtaaaatttaataatatctatgctaaaggcataccagaaaaaaacttaaaaggcttaatattttaagtgcctattgtcataagatacatttaaccagggagcaccaacaaaagcagagtaaacacttattagtaacatttactgatttaaaatactcagttatagaaagagaaaactggtttttattaccttttatgcctatactgact

SEQ ID NO: 73539 - DNA, 1015 bp, Homo sapiens
gttatacgtaaaaatagtggaaaaattattattattatgtttttttttttttgagatggagtcttgctctgttgcccaggctggagtgcagtggtgcaatctcagctcactgcaagctctgcctcccggtttcaagccattctcctgcctcagcctcccgagtagctgcgacaacaggaacccgccaccacgcccagctaattttttgtatttttagtagagatggggtttcaccatgttagccaggatggtctcgatctcctgacctcatgatccgcccacctcagcctcccaaagtgctgggattataggcgtgagccaccgtgcccagctggacaaattaatttttatgaatatacatgtatgattccatgactgggaaacaccaacattcaagaagaattcacaggggccagatactagaagtatttcttatggtggtgagattttgagggcacataaaaatttatggatgttttctggagaagttgtgatgagccaagatagatgatgttagaacaggattcagttttccttcagtcgggttttgaactctctttcctgatatcttttactttcttctctcagtccttagatctattcagtcagagctcatctcaaattgtaatgaacccagttaacactaagatatatgtgatagataggcttaacttttcaggattatttttctccctaatccacagcttgtgaatttaaaaagttgtttcatctgttattttgaatggtgttaatattttatttgatttgaactcttgtttttctgctagttaaatctttggttatgagggggtgattatacccaaggagacctcaataaaatggttctttttgtaggggtcgtacttttgagatgagcaaagttgctaattattataatttagaaggtccttggatattaagcagtttttatgaaatattttgatttttaatttcatataggattaaagaggtaggggaagcattctttaggtagcctttgtaaaaatctttattg

SEQ ID NO: 73540 - DNA, 1023 bp, Homo sapiens
gtagatacatatacatatgtattgtttaactagaaaataaaaggtgactttgccttagtcaatataagtcaatatgtatatacagggatccacaacaaacctagataaagagccatttcattgttaacttggcttttgtctgaatattccaaatacatctccctggtctctggtcctgggtaaatggtttgaggcttttaagcataaggatggcttgggtttcctttccagaatctaattctatacattatccatgtgccacctgtctttatgcgacaaagaacaagaagctgaagagagtcagtttctgtgtaggaaaagatgaagatcttcctttcatgtaaaagtctgccctggctttatcactatgcacctttaatgacggagtaattgatatgggctactataagcttagaaatctgagagctgggtattcaaggaaatagaaatgcgattaggttcttgaaacactgaattgcccaagaatgaaattctttgtacaatttggagaggtaatctgggtgagaggtagaagagaaatcgttattttgtaacagcattatctatatcattatataaatagtcaaaccaatgtataagtttgaggtgtgcagtgaataaggaccaactctgcctttgaacacctcttgggaaagaacgtatacattttaaatgatcccagtttggtctgattaattttacagccacttagatttttgttcttcatttgacaaagcaaaattttaactacatgattcctacataaattttcaaatcaagaggtcaaattaaaatgagtgatttgaaatcaagcctcataaagaaatttttttctatttttaaatgttgtggttaagaatacataacaaaattttaccgttttaaccatgtttaactgtacagttctgtggcattagcaacactaacgttgtgcatccatcagtaccatccgtctttagaacttatcttctccagctgatactctgtacccattaaacactaactccccattctctactctct

SEQ ID NO: 73541 - DNA, 1043 bp, Homo sapiens
catgtttagatttttttgaaatccttatatattttgatgtgtattaactagaaaataaaaaggcaactttgccttagtcaatataaatgaatctaaaaaaattgttgcaagatctgtgagtcatttgttttatttttaaagttacagcttagaaatgaccttagcttttcaaagtgaaagaaatttttgtcaagtatattacatacacagggttacattaattcaataaactccattcagaaagcaatatatttgatagttaattattccaaatggtgcctgtgatcaaaagggacactcatttgtaatgaaggaaatctgtataatggttatcctgaagaatatttgctcaaatttgaggatggaagtaattgatgaagtgaaaaatcatatatatcttcttcaggcttagaaggagcagcttgtgaaaagctgagaaatcattatgagtatttgggaaactaagccaaaagagctaagtatggggataagatgttaaatttgataatttgagataaggtattacataggtcaatagaaatacgtgttttatatgttataatgcctttgggcctttgcatgtacatattgggaagaaatagattttttttgccatccttctttgctgccttattctttgaaatatgaaatatgatatttgctgctagtatacattttttttcctaattgagttgcaggggattttatatccaatgagaatttttcagttgttacttgaaaaatctagtgcaacgtagtaaatattttttgaaaatatgtccgctgactcttttagtgcttttacatctcccattaaccacttacaaagcaagatattgtcacaagcacacttgtctaaacatactatgcactatttttgtctctagcgcttgccccatattggtagaggcttctgtgaggcggtcttcctgtggaggtccagacaggaagctggccacaaataccctctgctctgggggtctctaatatctctttagttatttagttattctttggagttactccccaggtggctctccttc

SEQ ID NO: 73542 - DNA, 1020 bp, Homo sapiens
ataaatgattatgttattgtataattttatatcttcacatcttattgttccaatagatcttcacatcttcacatcttattgttccaatttcaaccgagattctttatgagcaagccttaacatttgacttttctgtattcttctatagagagcctaactcagtgatttgggagggagtgagtgagtgaatgaatgaacgaaatagattaagattttctttatcatgacagggaagccctcagaggagctccatattgagagctattacatttccagttgctattattgttctaacagggctttcttggtcctgtgtgtctgtgttcgtccttccccaggaaatggagtgtggtacagtaacagtggtctagaagcaggaagccgatttcttgtcttgaatctaccactaggtagctgtgtgccttggagaaatcaattctccaggccttagttacatatctataaaataagagttcttggtagcttaacattctacaattctttgaaactgctgatcttcgttgacattaagaaataaactgccaaaataaactttttttaaaaaccagaaagcccattttgttcagactcgatagaagaggaaatgtgctaacggtgttaaattgatcatatgtcttttctcataagagaacgagattattacatcggcacagttaaaagtagatgcaacaaatgcttatatatatatggaaaaatatgcaagaatattttagtaatattgatagcaaagatttataaacaacttaaatgctcattaataaggaaaatagctaaattattatatgtagccaaattatggtaccaggtgatatgctatgaagctgttaaaacaaatgttgttgatctagacatatgaacatggaaaattacactgggtttattgctttgtgaaacaagtaaaatgcaaaataatgtatatggtatgagctcatttaattaaggaaaaaaacccttcaattgtatatttgtatacatgtgtatacatcttttttgtttatg

SEQ ID NO: 73543 - DNA, 4026 bp, Homo sapiens
ctgggcctgataaacccatgcctgtagctctagctacatgggaggccaaggcaggaagatcacttgaggccaggagttttgaagctgcagtaagctatgatcacaccactgcacttcagccttggtgaccaagtgagaccccatctctaaaaacaacaacaacaaaaactaagtgtaatggaaactaggtagacgtacagggactagagattatctgagtgttaagagcaggtttcttggacacaaggagagtagaaaatgtggaagtataaatgctatgtcttggaataaagaccttctagaaataggtctaattctacagagtcaaagaattgtacagccaaggaattgggatgaaataatggaaaataaacaagattctaatgtggaaattaaccatgaagccaggtgaaaagcatcggctttggaatcagactacctggttggaatcctgtctccataatgttttgacttgggatgaattttcagtctctttcagattagctttaattttctcatctgaaaaagagagttaatactacttttaggattattaagagactgtgtctgttgagtgcctggtatgatacctgactcacattactctaaaaatggcaactagtattatcattatcatattaattccattttatttttattgcattatggcaaagaagtagctatcaaagctgttatgaataggatgttggactggattctaaattcccttccctatgtaggactccttttttattgatattccagatttcttcagtgatattaatttatttttctgaattgacagtttaaagcaaaaataataaataatgattttatgggacttcatgcaaaacgattgtggtttgtttgttttttttttttaaatacagagtcttgctctgttgcccaggctggagtgcagtggcatgatctcagttcactgcatcctccgcatccggggctcaagtgatgatcctcccacctcagcctcctgagtagctgggtctacaggtgtacaccatcatgctcaaaacaattgttattagtaagatgtgaaactcttctcttcctcctcctctccctcctcctgcttttctgtctttaaattaaatcacaaatttagatcgtgtctgattgtaacacatcaaaaatattacttcttttcatgaaatagtacagtaacagggtcaatgtttttcattggtttatttcaaaataggaaagcgttaagagaatcaggcggtggaccatgcagagttaaagttagaggagattgctgtttgtgataatgacatttccttcacttctgttgaaagctattcaacacgaacatgtgactcttttactaattgtaatgcattacagtaccccataatctatgagaatgttcacctctgcactctgcctgtccagctgttgtctagaacaattatcagcgagttattattccggtatgagctgtgtcatgctcgaaagtgggatgaaaaaaatgttaatgagcatgcatgaatgttggttgatgaaggttaagtggttgcagatatgccctctgcattctttcctatgaatgttcagactgaggcaatgggttctgatgagggattacaaacaaatggtgctgattgacagttcttgatttaacattaaaatggtatctaaaggcaaattctgtgtttcagctgaataatagacacaatgttgttgacccctgggtgcaactcaacacttcagcatccattttatcttaagagtttttttcccttatcgtaccagattttcaaatgttctcatttttgtattacattttattttaaagttgtgcctggcagtggtggtatagttaaaaaaaataacatatccgttatgtacttacatttttagaagaataactttgcaattttaagtatgattgaattaaaatattgtacacaatagctgtctaagtaggtaagcatgggccagtactcatcagcaacatgtttgtttctctttgtgtgtttgcatgtattttaaatgactcaagtgcttttttagcatttgtttatttgtgtgctacttcaaattagctgtctatatactctttaggaacttttaaaatttattgttgtgaacattgtgtttcatatgctatctattgagcataaacttcaaatacttctctttttttggaagaaatgaacaatgtaaagaatggtatcaggtagtgttcgggaggtttttttctctcatcactttccccatcattaataatcttgaacttggtgcattgtatccaaactggattctgtgctttgtaaactgtaaaatgttgtgcaaatatttgtttttacttaaccattttagctgaaaggacaatataataggaacacaatgctttgcaacatgtaacagaagtacaaaaaagtggaagattgttcaatcatcataggattgtaaagttactagatcatagctatcattttctcatttaatagatgaaaaaaatctgagcgctaagtatggaagccataaaagtgttgccagtagagatatcatttgacatatttgggttatttgttgatcattgagaaatattttcttattttttatgtccactatggagacagctctctgtaactcactgcctacttaatgtataagctttcagtaataagccagagtgttcgtcttcattttttcttcgtaagcatatttttaatatgtgaagctttcatttaaattttaattcatagatttttaatctttttttggtaaaattataattgttatggaaaatacttgtaaattaaccttgagtcatgaaggaaacaggacagaaatactcacctgtacctcttgaccctggttctcatgtcaatattcctctgtggaagagggcctccctatttcctagcccagcagctttgtgcttaaggactatttcttctcagagctctgtgattcctattgtattaagtgcttaagtcttagtgctagtgtggctttttttttttttctgtcagcaagtgaaattggatatacaagtcatattccctcaaggctagctgctacttagtactatgcctaggattgcagctatctgctatcagtaagcagggctctcgttttggttactgggtccatcatggcaaatcatgcagccagctgaacagttattcagccaagcagcaaataacattggatgcctctcccatgaaaggtactgtcctagctcctgggatacagtgctgagcagataacttcttgctttcctatagtatataatctaatggagaagacagaaaataaataggccaacaaaaatgactgtagtttttgaatgtgctatgaaagtaaatgagcaaggtatgatgaggggtgtgtttagagaggatagtcatggaaggtcctcagattggaaagaatctgtgatctaggatccatcagaagtttagtgtgactggagacaagggcaggagatgagatttgaggtgtggattttttggaaaatcttcaaagaaacatttgagttgttttgaagcatgagtatatgatttttgaaagcagggaggaaggtgagggccaatccagcagtaggagtggtaggggcaaaggaagcattggtacaatattgaaatacccctagcttagggcatagttatgtagatgttgatgatggtgttgctggcccgcaagagggagtggtggtgttacaagttagttagtggccagttatgagcctggaaagattgattactaagggcaagttctttccacatgttttgcctctctcctttctaaaaggttctaaaaggaggtataaaggataatagccccccccctttttttctaacacacagaaaagttgctagaaacaagttagtgttaaacatagtagtttttaattcaactatgcattaataataaatgtatatatttaaacaaactatcaaaaatcccattgtacacaaggtatgggtagcagtagaagtcaaatctatcaatttttctttccaaatttgagtccttacgattctgcttccttgt

SEQ ID NO: 73544 - DNA, 1026 bp, Homo sapiens
ttggttccttctgggagctgtggctgactgacttagagtacgtctttcaccaggcattggagagcccacctggattctgcccctgtcctccacattccatgtagttctctttctaccttcaaacagttgagcccttttttctcagtatctggaaaatgctgaagcttctggaaacattttattctcccactccttggcttgccaacttcatttcctattacctctctttcaattctttcacttctaccatactgggcaaccttcatgatgtaccccagatatgccaggtatactcctgccatgggcttttccctgccaggaacattcatgctccagatatgtgctccatgagccccttaccaccttcaagtcttaactcaaatgtcgctttctcaatgaggttcccatgctcaactcccaaattaatcctgccatgttttcctttgtcctcacgccatccccattttctctactgtgttgtagttttcatgtcatttatctccttctaacatactgttagctacttatatattcggtatgttgtcttattctctccctactcccactggaatttaagctcctttactaaagagctctttgtttcatttactgatgtatcacaagcacctagaagaatgcttggcacatatgggcattgaatgtttgctggataaatgaatgctttttcatttctttaaagcagaaatgcaataatttcagcctcctcaagcaaactgtcttttttcattttaagcaaatggaaattttggaaggggagtagaaatatttaaatgatctagattccaattaactctgcctctgatgactttagctctgagtgaatagcagactcttgtaaattaggttaaaaaaattcagagaataatgaaggtggttgggagtggaataggttcaggacctagatgctaaaatgattcaccttttttttccttctgttttagcagcaaaaagtaagaaggaggaaagtaaaaattataggtaaattctgtgttgttgttggatgca

SEQ ID NO: 73545 - DNA, 1482 bp, Homo sapiens
gttgtggagtccaccctacaagtgtgtgaccctggcttttacagcgtagtttctttcctctataaaatgggggacataatacccatatcatgaggttattgtgaggattatataatgcatattgtaaagcatcttttgcagtgcccagctcattgtagttgctcaggaaatgttagctgaacttaaatgttgagaatacagaactcatttcaacttgtaaagttttgtgtatcatctctgaatcttccacaatgtaacaagttaaatggcctatgttcactgtagccttgctttcaagtgaaactttctaaatcatgaaactactgtgttaactgacctatgttaatagccacttatggagactactgtaacactagttcataccattaactttagaaaataataatagattattctgtatatctagtttcatttttatgtatgtcttaaatgtcaagtgcttcattaagtttctcgagacagggatttgttgaatcaggaataaatataaagctcgtttttatttgctgattttttttttccatgacttttttcctttcagttgatgactcatttatgggactggggcctaataatatttgtaattttgagatttgaaagctgagattctaaactgcttttcttgttgtgattcagttttagagcatagaactggtgactttgggggtgatcttgaaaagctcattcagtctcataaaatattacttgtttttgctaataattcattatttttgacagttatttacattttcagagattagtgaggatggtagagatggctcaatataattatggaactgggttgaattaaggcatagagagcctttatttgataggcaaataagagtgccagataaagcgtatggctaaattctcccaagggtttgcaggaggcgtgataactcttaatgtttttagtttcatagattgctagcagaaggtttggaagagtgataattttttaggaatggattactcctttttttctcctccatttgtgtggtgcaagctaatagaaattagttgagtgaactatatgccattataccattttgacaatcgcagccttcacacggttcaactaaatacttgtttcctaaactggtgacaaattattaaggaaacacataaagaaatgtctttagtttttagcttaaatgaaagtgaatatttatacttccctactagcttcacaggtaatagatgaggaggacagaactcttgaagtgaaaattattcaactcagaatatgacttatagccccccaaatctgtgattggaaaaaaaccttagaattttacattctgtattagtgtatataaatcagtcttgtcttgtgaatcattgaggaaatttgcctgcagggaatgattaaaacaagaagtctggtggttggtggtcctagaattggttaattcaatatcccagtgatgtgagaactctaggttagcttctcatcta

SEQ ID NO: 73546 - DNA, 1020 bp, Homo sapiens
tactttaacctctaattgaaatttagctttttcttcaattataggtaacaaacatagcagtacctattaagtttccatgagtacaattcacatatactttcaaaatacattagaattattttagttaagttgaaatatcatttaaaatgatcagtatttcaaaattaaggtagttattagacttgcaactagatcttgttatttaattcattaataaagaagcagattttgttgattgcttccacctggaagcagacacagagatgctggagtgtaaatgtgtttttttttaagggtcaggatgcaagaccgggcgggaaaaaccttagaccatggtgtaaacctgataaattctcagccagtctagccaggaaggagctctggaacaaatgatgcctgtgaggggagtccctcgttgggtcctaatggcagtccttactacttgtgccaggctcagccattggctgggggctgcccaggaggagtgtggcctggactcaaaagctaaggaggattctaaaggtgctaacaacttgaagcctgtcagctaaatgcactccttgcggctgaatggaaagttcttcctaaatggagatctgagcagcacatctacattgcttcctcacatgtgtattactatttcataaactgctgtttaatgcattttgatagctgcattcaagtataatttacttcctttgaaatcctatgtatttttgtttatgcatttaaaaatactattttgagaaagggtccacttctttgactgtcaatggggtctttggcaaaaaaggttaagaattaatttagactctctaatttgtgcagtggtgagagtgaagtaacatcaaagacctgggcctgagcctcagcttaactgctgcctatttaaatttatattgcctttttttcttttttttaattcaaagaaccaatacatgtaatgaaatatttcatccaacttagaataatgttttaaggcagtttcaacatcagactgtccatttttgaatctcactt

SEQ ID NO: 73547 - DNA, 1037 bp, Homo sapiens
tttttaaactaatctttgtgaccatttacaacaacgcttctgtgggaaagtaccttgtgccatatctgtagaggaataggaatcctctctaatccttttcctgtgaaaaatcagtaattttttcctgattcacttacatcattttcttttacactttattttgctgttaagtagctcacttcagttttcttgattctctctgttgtaagtttttgggagacatcttagctttctgtattttaaattattctggaaatgtatataagcacttttccagattatgttttttctttttctcatacctcctctttcataccttccactttttcttattggctaccactgttccactcaataactatttattgggtgcatattgcatgttgtgcctcatgcttgacattggggataccagcatgaataaggcaggtgtgcttcccatactcatgttgcttttacattcctgatgaaactcagtcaagtacttagttgaagcataataacaaggagtggaataacaaatgctgattttgattttagaaaagactgacattttactaaattcagcttctgttaagacttaacaaggttataaaaaaagattgtttatctatctctctgaaatttaatcataatattcatatattgaacatttggtatcatcaaaataatgctaatgacctatgtatttttttttttttttttaccagattggaagcatctgttggttaatttttacaggctgttggaaaatggattagagtatactaacaggttattggtgttggatttgtcaagtaaaattaatattaactactttcattattcacaaactgttaatagggattaaagggctttctgaaagtatatgaatagtctaattcacttagactaatttattatgaaaatgtggttccacaattgttagctttctgaagtaatcatattttataacaggtgtgtcatttttgccagatagggcccataaattggtttataaattatttctcaactgaatagttatggcatatggaaac

SEQ ID NO: 73548 - DNA, 1905 bp, Homo sapiens
tacataagtgaaaattgaacttatttcatccaatttcgtgggcctgctacttacatttcaaggctgatatccacacagaatttttaagtattatataaaacttacattttaggtctgtagtgcaaaacacttagatcaatcattaccttttaattttcaaaaagaaatttttcactatagacttatgccacctatatccctgggctcatagaacaaaggaagaggtggcagggagagattgtactggatggatacaggtcagagacctttgtgtagagggttgagttgacttcctaaatgttgactgttagccaggcaccatgctagatgctttatgtatctgtttaacttgagcacagcagccaaagaatgctggcagatattttaaaaatgtattagtattcctttgaatgagtttctgaaagattagaatctctttctaaaaggtaattgtaaattaagaaattattaatgtaaattagaaactctctccaaaaggtaattgtaaattaaggtagttttctagaatttgataaaaacagttaacagatatttttgagtaccatttatcctgactaaagtattaaaaatggtatatttttggtctttgaacacagggagaattttctcagcaagctcaccctagtaaatttgtgaataagattttaattttaccttttgattatggaggatcaaaattttcttcaaataagattagtgtactcttctggcaatcaaggaaaatacatggcagttaaaatttgtgtttacatgtaaaacacttcagaatttcagatttcataatctggagttgattagttttccttttgctttcctagtaggtacaaatggtggtacctaaaaactatttaagtaattctgccatacagctactctctttttctccttactctgattactttcttaattaatgaggctcaaaagggaaacttgttagcatgtctttaatttagctgcaatgttagccctaaatgaaataattggacctttaaaaaattcttaagtcatctaactttagccttgagattcaaggttgaataaaaaaatgatgtatttgctctatctaatactagttagaaagattaaggtgaaaaggtgatcattttttgcatactccatatttccatctctctctgcctttgtactgctggtcctttggcctggaatctctttacttgacttagaggctggcagaggactatgataccttctgtctcaattcaactcaaatgctgctttcttttttttctgtgacagtagatgacatttccagggggaacacaaagagtggggaagcccagggttgtgactccgagccctgctaacatttctcagtggtaagcagagatgagctgtaaaggtgactatttttttgggacttcattttaaagaataattcctagaaagcattatttgaggagtcctaagagtgctttttggcattactggtcatctggcaatcaaggagaatatatgacaattaaaatgtgtatttacatgtaaaacacttcagagtattttataggaaaggccagtcattgctacgttcagagaaacaggattttatatagacatttaataggaaagatcagaaaggaaggaaagagaaagatgtccagagagcttagacaggactggtcaagtagacaggtctacttgtggtcttttattcatggcctggctgctgaggcattgggtccaaatgttacattcacgtatctccctgagtccaacatactttgtttgaatcaattttgtaattgctgcagaattcaaaactatggccgggtgcaatggctcccgcctgtaatctcagcattttgggaggtcgaggtgggttgatcacttgaggccaggagtttgagaccagcctggccaacatga

SEQ ID NO: 73549 - DNA, 1037 bp, Homo sapiens
atcagcatgagaagattgaattggttaaaggtaaaagaaattaatagaggaaaatacttttacttagatctaaatctaattttggatttatatatacataatttctaatgagatttaatttatgcctacataatttaatttatatatacataatttctaatgtcactaatcaaagtgacaataaaatagctttttttttaaagtattgggacaaatccctttcatattgactaagactttctgctttataaatacagtgagagttgatgttgttccagtggaatccgatttgtaattaaattgataattaaacattattgcagtgaatcctatgtttatgaagtgtttctcaaaaaaaaatgatggtgttcttaggaaattttctctattgatagatgttgggaaagtgttaactagttgtcagaagctaatatctagtcagatcttaagaattcagaatcctgcagaaaaatggtttcatggtaacagaaacatggaaaatgctgtataatgtgtcctgcccaccaaaatgtatagtgcaggtgaagattattagagactatgagaaatgcaattgagaagaagctaattaaatcgtatttcaaatcctcaactattggatcatggaagccttttcttcctaataagaccttaacatcctgcagaacttgtatcttattgaacacacttcagggaaaaatcttacagatacgactttataaatatctgctgacagctatgatactcagtgtatgcatagtgcttgacttgggacaggtgaaacactcacctattgatgaatcagtcttctctctgattgtagatcagacctcatgaaatgactgaaaactgtttctggataaaagtaaatgaaaataagtatgaaaacgtggatttgctttgtaaacttgagaatacattttgttgccaacaaaaaggtaagtttaacatcttgattatttattaatttgattttagaattttaacatatactttttatgtatcaattttcagaaaacattattttatgaatcctg

SEQ ID NO: 73550 - DNA, 1003 bp, Homo sapiens
gtgttagttagattcagaaaatactatttgctccataaaatatttctattgccatatcattttgtatatatcagcaaaaactttgttctgatagttttataaggacacatgtaaatactttgctttaggcaggaagctatcatggttgctagacacattctttattttggtgcataaatttgaaaaatgaagaccagaaatgtcagaaagtatatagagaatattgaattatcaaccttcttgtacagatgcactaatacattcaccctagagaatgaaattaagcagagcctcaaccttaactgtgtctttcaacatttttttgcatgtaattttgtaagtgtaatatcgctctagtaactctttttggagaaggctatcatatcagtttttataaggtgtgcttttaatggagattcattttttccccaaggctacagtgatttgactatagatattacaaaaatgctaaaacaaagtttatatttcagctatctttttataggcgaggatgtggaaacttattttttcataagtaatacagttactttagtattagcaagttaatttaataaatgttcttagaatgtactcattatgactgtggttgtttttataatttttatcttaagtcccgaaataattctttttccttatgaattttagtctaggatttatgaaatagatatttcataattcacatattgatattgtagaaaggctttttcattcttactctcataagaacgtaattttttttcttgctgtgtaacagtgaactttgtcttagttgtcaaaaagagaaaatgacctctcaaagatttctgatgctgggagagtgactatgttgacatagtcattcaacatataaaggaagatttgacgaggttggctcatcacttcgttcaacaaatatttatttgactttaattatagatgtaagacactggaaaggtgatgaataaaatagaaaagtttctcacatttatgagctttcaggttg

SEQ ID NO: 73551 - DNA, 1465 bp, Homo sapiens
tctcttgatgaatggaaaactattttattatcctattttaggtaagtgttatctatccaataggtatattggatatgttcaatttctgttgtatgtgtgtagagtgatattattggacaagaacttagcttttggttacaagtgtttttttttttttttttctatttttttatggagcagtagtaacggctaatatttttccatcttcctttcacctcagtaaccctcaaataaatgagaaataaaaaacgccactgaaactttatttcttctgtagtttataactgactgaaatattttgcttacaaattgttttaataggaaagatatttaataatgctggaacaaaaccttgaagtttacgtttgttactctttctttaatgttggaaacccagtctgtctcactgtttgatctcttgtaggtagcttgtatgcagctcatcaatgccctggttacatctcctgatgatttggatttcaggcttcacatcagaaatgaatttatgcgttgtggattgaaagagatattgccagtaagtgccctgcagtctccttattaatatttaaattaaaagagtacttgagtagggggaaatttagataaattaccttgaagaataatttatctgtgggaaaaggcttgagttaaaaaatctatttttgaaatatagatgataagattcgagtgttatttaacactttaaatgttcgaatgctataaatcaagttgaatggttggtttattgtttatatgttttttattcttttgcataattaaaaacaaaatcattcatcataatttctatttcatatctctagaatttaaaatgcattaagaatgatggcctggatatccaacttaaagtctttgatgagcataaagaagaagatttgtttgagttatcccatcgccttgaagatattagagctgaacttgaatatccttttgttctgaagtctagtcaaatcatatataaaattattgctaaatccaaaatactcagccacaaatatttagctcatttctatataaacaacatgaaatcaaaccttcatgcatcagaagaatgttattattttattaatttgtgtgtttttatgaatacacatatatgtaagcgtatgctgcaactaacaaatggattctgtagattggtttcttatatgtatgtgtgcaatctattttgttttctttttatatttgacacttttccttctacttagggctttttagcattaggaatagggcagccttagtcactggctgctctttccctgcatcttgggtgcatactcatgggtcgcatgttaatctgtgggtctgcagacgtctgtgctcctcatgagacccaacaggttcctatcctcacctggggcttcttcatggtagataattaacctgaccaccagctctgttggtcaggcaacctttagaattcaacacagtattcatagccagcttc

SEQ ID NO: 73552 - DNA, 1030 bp, Homo sapiens
tctatcttcaatttccttcgcagcttttaagatttagatcactaataggcatttccaacttatcatctccaaaactgatttcctctctcttcccaagcctgttttctcccgtggtcatttctgtttcaataaattacaatttcatcctttaagttgctcaggcccaaaaccttggagtcagtcttgactcctctttctctcaaagaaatttccatcttttttcacagctgtatgtctagcaccaagaacagtgcctggtatatagtaggcatcaataaataggctttgaaggaatgaagtatgtgagccaatatcggggtaaactgcttctgatgccctaagatggaacctttagttaactagatgctctcaagaagatggaagttccttgttttcttacccttattagcgcagagggaggttggttttgtaatgtatcataacgatttctgtaacatgcaaattaagagagatcatatgctacatttttggaacatcaactagagcacagagattacttccttatgacgaacatctcacttttggttctcattttttgagtatgagtatctccagttgacagaagttgtaggtagtcagtaattgtttttttaatgaatgaatgattctaatatacatctcaatcagaattttgaaagtaggatttatcctattctctaaaacctgttgctcttcttacattttgtatgtctgctaatggtaccactttctatctagttaaataacaaaagtgggaggcctcttgtaaatgcttttcttctacctcattctatcaatttttcttcatatttcaaatgtttgaaccttcctccttgctcaaaaatttacttctacaacagcttctgaacttgaatctattgcctctgttattgtgcccctgttgcataaaattccttatgattttcactatttctggttgaatctgaattttgtgacttgacacacaaggctatgccctctctcctgtctccttgttcaacctcatttcttgacttcttcccgttactcc

SEQ ID NO: 73553 - DNA, 1069 bp, Homo sapiens
attgccttgcgtgttggtgggtgcctatagtcccagctactcgggaggctgaggcaggagaatggcgtgaacccaggaggcggtgcttgcagtgagccgagatcgcgccactgcactccagcctggctgacagagcaagactccatctcataaaaaatatatatatatctatatctatctatctatctatatatagatagatagatatatctatatatatatgtatacacacatacatatatattatcaggaaagaaagtacaaatataaatctaggacttaaaataagcatacattacttttttttcaaacatcagacagggtttctcagctgcaagcaacataatcactctgggtaatttaagcagaaaatgttattacaaaattaaatatgctatgaaacaaattgaacagatttcatcatagcctatatcaattaattacttcacaaattttgtacctaccttacaaaatttctggtaggcccagggaatcatgtgggtggtctgtagctagaagtaatacagaagatacgctgcactgtatcacagcaatgctctaatggaagtgccactcccaactctctgctgtggtcagcacttgtgacaccagggacagacagccttctgccacagttgccccaggagaaccaaaccctccatcgtagtgtccattgttcatgtgtgtgcttgtccctcatgttggccagtttttccttagtagaaaaggactgggataagtattggttaaccaatctctagtttctgccgtcctttaatcttctgttatttttatttctctcctctttttcttttcctttctgtgtcttctgtctactcttgtcagggtcatactttcctggagtatcaagagcattttctagatttcaaagagtttgttgaaacccttgctgttggtcatacgactgattgaattgtgatatatttttggaagggaaccaaaacatgggaatcctagagcattttgggtggatatttggttcttcttctgtgtatatgtcctcaggtctgcagtgatagaatgctgtaacttccttttcctgtggttt

SEQ ID NO: 73554 - DNA, 1051 bp, Homo sapiens
gtggttgagagcatttatatggtgcccaccacataaactgtctggtttcagattcttgctccaccatttcacagatatgagaccttggacagattgcttaacctttttctgccttagtctcctaatctataatacgggttaattatagtacctacctcaaacaattgttatatactttaaaatgagttgatgtttgtaaagtggcttaaatggtgcctgatgtgtagtaagcattatataaatgcttgataaacatcttcacagggttattgtcagggataaatgattaaaatgtaacatgcttagaactgtgcttgatacatggtatgtactcagtaatctacttctaaaatatattggctgcttagggtattgacttctttagtaggataaagcaattgtattatggcatttgtgtttgctacttgcaatttaattgactcaaattttccaatagccttgaagaagttttagaagctttaacttcagctggtgaagaaaaaaaaattgacagatttttttgtattgtggaaggcctccggcacaattcagttcaactgcaagtaagttttgtgtgtatataaaatctgtttttaaatggcatatattacttttaacggttttatgattggtttatatgaaaacattgttatgaagctctgcatgccttttaatattcttttatagcattatttatttatttatttatttgagacggagtcttgctttgtcgcccaggctggagtgcagtggcgcgttctcagctcactgaaagctctgcctcctgggttcacaccattcttctgcctcagcctcccgagtagctgggactacaggcgcctgccaccatgcccagctaatttttttttgtatttttagtagagacggggtttcattgtgttagccaggatggtctcgatctcctgatctcgtgatctacccgcgtcggcctcccaaagtgctgggattacaggcatgagccactgcgtccggcctagcattatttttagaatatagaattcctatttgtactgtgtcataatttatctta

SEQ ID NO: 73555 - DNA, 1902 bp, Homo sapiens
tagtcagttctcatgctttagtaggatcctctgagatgcatgctagataaatagtactgttttattgtttctattcatcttctgtattttgacagttatctttcatagatacatcattaacataacttatcttctaattggatttgacttcctggcagtagtaaataaactttatcctaatcccaatcgtctcatttatagaatgagtttacaactgcattgttttccttataataaataccattgtgattagaatacctgtgcccattgtggcagtttctacatggtatctgctcaaatcatccttcagtttttgcttatttatgaactaagtgctaatatctaggcctgtattttgtaatatggtagctacatgtggcttctgagcatttgaagtgtggctagtctgaattgagatgtgctacagtataaaatacacactggatttcaactatttaggaagaaaaagaagtgaaatgtcatcaataaatgttttatattggttatatgttgaaatggtaatatttggggtatattggattaattttattgaaaatagttttgcttgcttgaaatttttaaattactcatgtggtttacattatatttctcttggacagtgttgatctgtgtgtttgcttatgataatatatctcttaccaaccttccttcccaggaaaaagattttcatggcctcagtgtctggttccgtatctggctgtttgtttcatatgcttctgttggcaaatcccatgtttctgactgcttcccactttctcaatttggctacttaacctgtcttaataattgtcagctgtattgttgtaagatcaccttgagttatctttatttggtttagttttgtggttcttgacataaagtgaatacccttatgaactttttattttattttttttttgagacggagttttgctcttgttgcccaggctggagtgcaatggcgtgatcttggcttactgcaatgtccacctctcgggtccaagtgattctcctgcctcagcctaccgagtagctgagattacaggcatgcaccaccatgcctggctaattttgtatttttagtagagagggggtttctccatgttgctcaggctggtctcaaactcccgacctcaggtaatctgcccgcctctgcctcccaaagttctgggattacaggcgtgaaccaccgtgcccagccatgaactttttagagtgttacacagtctatattttttagctttagtaagtgtaaaaatgtcctataaattttttttaataactacatttccttcagggtattatttttctaactaatttctaacatttgacctcttattttcaaaatattatagtatggcttggaaagaattatgagtgaggagaggagcctttccttattggccaaagccgtggatcccagacaccccaatatgatgacagatgtggttaaacttctctctgcggtatgcattgtaggggaagaaagcatgtaagtgttatcaacatattcccctaattatataataatttaatacagattgattcatttaatgtttcattatctactctaggctagaatttactagaatttaaataaatgttgaggtatatttaagcagctaatatagtttcttattggctggaaatttttgagtaattatttctcttaattgatttattagttatggtctaacatacttctatgaaaaactgatttccttatcatatttaaactgtttttttaactgaaaccctaaattaaaaaaaattctaaatggaggctttgaaaatatacaaatggttctatttcttatgtgattttttttccccacatagaattatttcaaactgtaggtcttctctatccccttgtaaaagcaaacatattacgatttggaa

SEQ ID NO: 73556 - DNA, 1031 bp, Homo sapiens
acagatattattttcaaagaaaatatgtgatgtaggaatcacaactcctttctatgctgaattcacggttctttgaaaatcagatattagatatataaggtagctttttacatatctgttttaagagtaaatgaatgaaagaatcaaattgctgatagggagaggtctttgcccactaagtacatagaactggtttaggaagccctttttaaagtgagaatatagaaattggaaatttcattggtgatggaaaagccaaaagtagaaaaaatctaggaactttttttaaaccaaagggacatttggatcataatttgaatttaagaagaatatcatggttaaattaaggtggtaaatagaagataatattcttactttgtttcataatgaatctgaggaagattgaactttattttctaattaatatactatttttctcttaagagatttttgttgcttgtagtttatatacatggagctataaaatattgccattttatttggtgcttttatctgtgttattaagaataaaaagttaatttaagttattgttacttagtattatagtgtctgaactctaaacctagcaatatgtgaaatttttggtgaagttttttttcccttcaagattggttaatggttgtcttaatctttatttgatcacatctataagtacaaaatttgttaaacctcacttatacagtctttattagcattcattgaatggtgaaaatataagttttaagaggaaaaaaatgtggtaccttatttggtactagtaattaattatacaattaatgggcaaatttgataacattacatgaaagtgaatttcttataacattaaattggactaagagtattttttaaatggaagagaattttaattgcgtaggggaaagaaaagataataaggatgaaaagttagtatattcaaattgaaaggtaattagaacagagacttcagtttggtcagttaactgtgtgtgttgctttgaagagtgcacccaaggtgcgggtgctttgcttct

SEQ ID NO: 73557 - DNA, 1510 bp, Homo sapiens
tagcgaggtagttttcatgtaatccaggcaagctgttgtctagtgacagtaatgttctagttatgtaaaggcctgtgattgggtcagtgggtttatgggacaggtttggtttggtgaacatggagataactcatttaaaacccagtgatgcagtttgtttgtttgtttgtttgtttttaaagcaactgaactttgaaacttaggaaattcttaacatttgtaggaatgtatttcagtggtttggggaattctgctaaagcatctcttttttttaattaatttttgccagtaatctttttctttatgttgatctacatctttcctccatagatctttactcacttgtacaatttgtcttctttggcatagccccaaatgggctgtaattagtggtatgctggtaaatgtttagagccagctctgggtgcgtgggtgggggaggctctgattggtttgccagtttctttggtgtgaatactttcactgtggctgatttcaagctacccacgtgatgtccctaaacatgaaccatggaagagatgggcacagtctgctcttacaagcctgtgcaagcggagtttagcacactattggcatatccatctttgcttctttcacaactaagatgagtcatgaataatttttatatatggtgttattcttatgttttagttacgattaggaatatagcaaatataaaatacttgtaggtatataatatgataacacaagctgcgttactgacaatgtgtaactgtcttttttctgtttttcagttgggtggaaagctttggacatgaagggcttggattattattagacattttggaaaaactgattagtggaaaaatgtaagtattgctaataattattttcaagtaagcatcattcatatgtccaattataattccaacactgctattttttatgtcaatacagccaagaaaaagttgtaaagaaaaatcaacataaagtcatacagtgtctaaaagccctgatgaatacgcaggtatgtacatacgtaattagtatttgtccgtcaccaattttgtaatatatgattttcagttgcagtaaagtgatggtaaattgttctgatgtgttttttagtacatgatggaaaaatattgaattttattgaattctagtttcaactgtcttgcaataggagaaacttgataatgaataaacctcttctggtgctgaactcctcatgtataggttaattatctctccccaccctttcctccctctcaaccctgcccaccccaaccccatcttctttctttttttctctccacccaccaccctttctctgcttttttgtcctactcttcctcttttcttccttccttcatttcctccctctcctaactctcaaaagtacggcgtgagtcagctttaagatcatgattattaaatgtgagctgcaataatacttattaccaaaggttcaagttaggaagatttcttatattctaggaatttaaaatctacaatgaaattaatg

SEQ ID NO: 73558 - DNA, 1459 bp, Homo sapiens
gcgcatgccaccacacctggctaatttttgtatttttagtagagatggggtttcaccatgttggccaggatggtctcgatctcctgaccttgtgatccgcccacctcggcctcccaaagtgctggaattacaggtgtgaggcaccgtgcccggccaaaaatatccctttttaacatgttaagtttgacatgtttaaaagagtatcacaatttgagacatcaagcaaacccctagatgtgtgagtctggagcttacatatgtggagtggagatatttaagtcctgagaatggatgcaatcccagtgtgggcaggttgtatggagaaggaagctaaagatacaggtgagcggtcagaacaagttctgaaggactccgggttcagaaagtgtccagaaataggtgatccagaaagggaagaggaggcagaaacacagactgaggagtagccagtggggaggagaaccccaaatgctggtttctggacctaaaggaagagtgtttcaaaataagggagtgacaaactgcatagcgtgctgctatgaggtggggcaagatgatattattggaactggcaagaggaaggttgttggcgtccttttagaaaatagatttttttggagtcttggtggtagaagccagactgaaatgagattgagtgaatggatggcaagaagtgctgaccatgcttgtgatgaaattttttgagaccttttgctataaaagaaaggagagaaatgggaactaacttgaggggtatctgaggtcaagtgaatggaacttggtgaacacatggagaaatcaaatcagcgagagttcaaagaagaaggaaatgtgaattggccttgaaagctgaaattgtttcagttgttacaaaggcagttctgtggaggggagcattatgagtgcattgccacacaaaagtagcaatgaaatttatagaatcaagggaagatcatgggttttaataattaggactgctctgaccagcattgggtagtagtgacaagtatttagggtggggacaagcggtgaaaagcctgaaatgtgaccataacgtcttttccacatatattgttggcaaattagtctatatttaaaatgaataatttagtgctttcttgaactaatgatgtttaatttgatactaagaaactacttactggtactggtagtgccctttagttaaatattagtgtactaatatttaacacattccaaataagatatttccttttttataatatgttccttttaatagtggacttaagttttgattagagcacataccagtatctatgttttaaaatccatacttgttttactgttttttcatctaaaggtcaagaactcttgtttcttgtgctttgtttttttatcattcctgttaacctggttttattttcattttatttggaatgctttctctagatattttatgcctttcagtatgttatagcca

SEQ ID NO: 73559 - DNA, 1054 bp, Homo sapiens
tggatatttgtccccacccaaatctcatggtgaattgtaatctctagtgctggaggtggggcctgggggaggtgtttggatcatgggtcagatccctcatggcttggtgctgtctttgtgatagtgagtgagttcttgtaagatctcatcatttacaagtttgcctccccaccccctctccagccaacacacacactctggctctggccatgtgacatgcctgctaccccttcaccttctgccatgattagaagcttcttaaggccttcccagaagcagaggagatgctggcgccatacctcctgtacaacctgcagaactgcgagccaattaacctcttttctttataaatcatcaagcctcaggcatttctttatagcaatgcaagaatggcctaatacaataatatgaaagaaacacccaaaagaatgttagagccactgatatcacctgcagtccctctgcagggctaagtagaagtttagcgcatttgaacagaagcctgatagaactttctacaatgacaaaaatggtctatgtctgtcttgttcattacagaagctacttaccacatgtggctgttgagcacttgaaatattgctagtgtgattaggatttaaattcagaatttaaatagccacatgtgtctagaggctaccctattggacaacacatctttagagatcagaaaaacatttcttgtgcacttgttttgagcctttgtactcttgagtctatatgtgtggctgctctctccactgtgctatgaatttctgaggaggggacccggtattgtatcattgtgaagccttaatatgggactcaggagagaagatcagagtacatgttaaatggatttgaatagtaaaaacagaataaggagattaatgcttgaaataaagtaaaatacatgagcctgtactgctcatttgcaagacaggagagcaggtatttcaagtgtttttatgtattctctgtttggaatactagatgaggtgcaaggatttcttttcttaaattgttgcgattccttttagagagaaacatctaacat

SEQ ID NO: 73560 - DNA, 1052 bp, Homo sapiens
gagaggtgaactggcccaggtcagaaacagagtagattaaactcccatgctgaacagtagtgggattgtgcttgtgaatagccactgtactctagcatgggcaacacagtgagtccctgcctcttaaagcaaagcaaaacaaaacaaaacaaacctaattatttgaaactatcagtttactgtttaaaagacaacaacagaaggtagagtgttaaaccaaaacaatttggaaaaaaaaactcattaaactttacagtttcttatggatataaaggtagaatataataaactttctttctttttaattgttaatgcctgttttctgagaatgtaaaccttatgtgtttatggctttacagctatcagtatgaagttattaactgaatattttggtttctttggtttctgttgaaagataaatattttcaatgagagaaattattaaactgcagatactaaagcctctagttattagtactctacatacaaagaatcagtatagtttattccttagattaattttctgggcttgttattatgtcttagagtattgccaagtcggttaagtaaaagatttttaaaatgatgatgtttatcttggtattcccttacatatctatacatgaagaaaggccttaatacaaaggaaggcatcacattgacaatagaagaagttttaatttttatcattcagaaaactttttaagagtaaaactccgtcaattagattgatgatggattaatagttcttttattagaggggcagtatatgtctgaaaggaacaggtacagtttatttcagcttcttgtatattaaatttcataaataataattgatatagtttggatatttattcttgctcagatctcctgttgaattgtaatccccagtgctgaaggtggggcctggtgggaggcgttaggctcacgggagtagatcccaatgagcttggtgctgtctttgcaatagtgagtgaattttcatgagatctggtcatttaaaagtgtatgtcacctctgcccacactctctttcttgctcctggtctcacc

SEQ ID NO: 73561 - DNA, 1059 bp, Homo sapiens
catttcatatcatctcattcttcttcacaagtctcatcacctgagtaggtactgggaattcagcaattgcaaaatcaaagaaaaactgaggcagttaattaatggttattgacttaaatagaaacctacaggcatagagatagatacatatacccaggcaagagtgcatttaactctcttatcactatgagaacgtaagctttttcactatttaggctttatgtagataacagttttctgttttctgtaatttacttgcttaaaattacaaagtaaatgttatggagaaggatctagaatctagtaactaacttcacttaaaaattaaagttcaaactattcttacagttctctgatatcttaatattttaatctctagaggctatatattatgggccttcatgttaaaaaaaatactggttttctctacaggtttaagtgtgatttaaagattaagctatcaccagcagttgaagatgttgcatggggaattttggtataggctactatctgggagaaataaggtatcatttagtgagttggaaaacagtctacagtgattggagtagtgtttaagaatataatttctgactcctttgatatcacaggtattctaggcaaacttttgctttaagcaactaccatatgttagatacttcattaggcagataaagaaggtcattgtcctgattgatattggcattatgctgtatcatcttctttcagagtgtgtagatatatcagatttagtttttttttacatttattattttaaaaatctggtcattaataaatggtagattctttatggttgtataaaaaccattcagttatttcaaaaatcaactggtaactagaaattcaatgtattcttatacattgaataaagcaaacaatgagatagaatagtgagtgaacatacactgaataagtgttacacctgaactgagatgaaatgtagtcatttaggtaggggcaaagtaatcttttcaagacaggtcaaaggggagggttactattacctgtaatagttacctagcaaaagaaagagcatttagt

SEQ ID NO: 73562 - DNA, 1039 bp, Homo sapiens
ttgtctgattttaagaaattgccacagctaccttaatcatcagcaacaaccacgctgatcactcagctgccatcaacattgagggcaagacccttcaccagcaaaaataggacttgctgaaggctcagatgatcgttaccatttttaggcagcaaaatattttaaaattatgtatgttgttttaagacctaatgctgttgctcacttgatagactgcaatatagtgtaaacataacttttctgtgtactgggaaaccaaaaagttcacgtgactcactttttgtaatatctatctgctttattatcatggtctgtaactgatcctgcaatatctctgaggtatgcctgtatttttgttcaagttccttcacagtaccacagaacttaagaatctgacatgttcaccttttctactggcacagatatccttattcattcatgatgttcatgaggggttgtgcttggtagatgtcagaatgtaaaggtttaaaggtaattggaaggaaatagtatacagaaacactggtttaagtagtaatcgtaaaaaaactactctggaaagaattacccagtaaattggtaaaattcccaagcatgtatttccagagctcaacaggaattttgcaggttttgttcatttttgtatttttaacatgtaaaacactgcttgtatataatagatgtccagcaaatgtagaatggataaatggatgtaagtatcttgttttaaccagtagccccaatatggttttaatcaaggattacaaaaattttttaaaatgttttttgagttcctgttttctgagatgcaggtaaagataaacccaacatttatctttctctcaaggagtctttaatcttgtagtcataaaatgtctaaatatgtcactgaaacaaggtagaagtaattaagataaaataggggaaataaacctaaggtgggaatttgagggtcagcactatctcctgccgagggggttagaagaggttttgttgggaaggagcagataggatttgaacatttggaggtggggttgtg

SEQ ID NO: 73563 - DNA, 1039 bp, Homo sapiens
ttttttttgatatagggtctcacactgtcgctcaggctggagtgcagtggcgtgatcatggcttactgcagcctcaattcctcatgctcaagcaatcctttcaccttagcctccagagtagctgggactacaggcatatgccaccatgcctgcctaatgtttcatttttattttttgtagagatgggggtctcattttgttgcccaggctggtcttgaactcctggagtcaagcaatcctctggtctcagcctcccaaagtgctgggattataggcgtgagccacctcacccaggcaagaaaataatttttgaaaaatataatttcgaataccaattatatacttccataaacatatagttccttttaggaaagatctgtaattcagtgtcactttgatacattttggttaacttgatgatattgagatatgtatgaaatcagattgatgattgagcaatctaaaatgaatgtaagctgttgccaatttaagatggaaaaaataaatatctgttttagatttttaagcagtttaaaattcatatggcatgtgccatttctgattttcacaagaattctaatttcattgagggcagggattatgtaatttttaatctcagcctggaatgtagcatatgaacaataagttattgatgaataaaagtgatttataactacagtatatctcaaacacaaattagtctagcacaatatatccttcagtggtggtctagattcactttctcctttgcattcagtgacattgcactggttgcttgtaatcagccatctgggagtatttacatcacatagattggcaaacaatattagactgtttttgcgttactgagaaatggttgttaaacatttaccagcaacaccactgtatttaagtatgaatcatgacctgtgatatggtgactatacaaattaattcatgaaggtgagtgttacattctgtaatttgtgatgtaattgtttcatcagaaattagatataacatttataatatataggatatttttctcacttaaaaattt

SEQ ID NO: 73564 - DNA, 1037 bp, Homo sapiens
tcagttctgaatcctagaactctgaggaatgcaatgcagactgctattgtctgtcctgatgggagaggagtacagcaatcagaaaaggaagatgataaaagagaaatggaaactttggggtcaacttctccttggctacaaataggtcagaacaatctcaatctgtaaataacacaataatgactctgaggttaaggttaaggctagagaataaacacgtaaaatgggaagtattttctgaaattaagtattagccattgtatccataacttttgggtgagtggaagtgagaataaaaattttgcatgtttaagaaaaagaaacatttgtcaaatggaaattctaaatgtattattactgtggttcttaggaataatttaaataataatgtcaattatacatcaatttcaaaagctttagctattgtacatgaagaaataattcaattccatttctctcaaaataaaccatgtaatgatatgttctttgtataaacatgtggagacttaggaatactgacatgggtagtgaaaatggaaaataatttatataataccaattttctagtactgacataaagccgcagtgtatcaaactcaacaattcagttgggtaagtatatggcagtgttagtcagatttctttttgttgtcagtgacagaagcctaacttgagataatttgagcaaaaagggaaattttattggcttgaatatctggaagggaaggggtaaggttggaatgacaccagaatgaagtccgatgccagggcattttctcccttcttcccttggcctctttctggatgttgatgtcctttttgcagactgcagaacagttttctccaaaaactgaaaacttgaaactaaaataaaacatagacatgatcaacttttttttttaaaccctaaaactgtttttatgtcaaattaagcacaggcaaaagacaaataatagatctggtaagaaatatttctaatgatttttacaaagagctgctagcaataccctgcagtgggcttttaggacttggctaga

SEQ ID NO: 73565 - DNA, 1055 bp, Homo sapiens
gattgtcgtcagcatcttagcaggcaacctaagcactgcaacaagcatctcctactgtggcctcctttatcaaagttttcagcattagtaccagaaaatatccctttagaataatgttttcttagcagaaacagaatctgatattgttcctaacagagaacaccatttttgtcttgtttaccaggtcattttgccacagtgcagatggcctgataacatggaccacatttcaattaggaaaaataaaaacaaatcagcagagctaatagcatgctgtttgcaaagcttttaaatgtgacttggaatagcacaaaaattcattttatattcttgtagtaaattggcactcatttagtaacttttatttacagaacttaaagtcttggaaacatctgggtaaatctgtgaataatttaagtgttcagtttgtgatcattgtcaaatagtgtttattaagcatttacctatgtgttacaatgctggatgccataaatatcaccataaatgaaaaatagaggcagctgggatatttacctcataaaggaggtatgttactacattaaaatatatgaaaagtatgattttatatttgaagaatttatgtattgtccatctgagagtttatttaatgttacataaacggattgcttttaatctaaaaaattagaggactagatttgataacatctaagttactttccattttgcaaagttctttcattccttcatttactaggaaatgccacccagttataattcttgcttccaaaaggattcagttgaaaacttggtattttcatcttttttttttttttgagacaacatcccgctctgttgcccaggctggagtgcagtggcgccgcctcggctcactgcaacctccacctgctgggttcaagtgattcttctgcctcggcctcctgagtagctgagattacaggcacctgccaccacgcccggctaatttttgtatttatagtagagatggggttttgccatgtctaccagcctggtcttgaactcctgacttcaggtgatctgcctgcctcaccctc

SEQ ID NO: 73566 - DNA, 1062 bp, Homo sapiens
ttactattttattgctttgttttgtctacttatgtgaaaaaggtgtatgatttatatatacttctcacattaacagtgctatagaagtaatacttctgatatatgatcagaattcagatatcattttaatgcccaataaataagtaacaagataaatgagtgaataaaatgtctttaaataattacttttgtataatgcttatttaagattagtggcaaaatccaagttaagattgtgaccagtgggtaatgtgccaaataaaggtatttaaaatacaacagttttaacagtctttttttcttctttcagaagtgattcattgttgcagaaaatttagaaagtataagacattatgaggaaagaaataaaaatcctaccaaagatgaggcatttatctctaatattaaggttgttttgatttttgaacagcctatataggaatttaataacagtaaaactaagatttctataacagaaaaattaaatatgactttcctgttatgtcaacgttttgacagaagcccaggggctgaggatatcaggtgctgaaacaacacagccatgaaaagagactgcagagcctattgtgctaccattagcctgtcatctactttgaaactatacaagataaggttcacagtaatttaagaaatggaagatcgacagagggggtttcttcggagagagaggtgtcggaatgctgtgatattatttctgaccccttgtgagggactggagccaaatgagtgggcatttgagagaagcactcagaggttgatgtgtatcccttccagtttggagacccagattggaaacttactgtgttcactctgctaggttctaaaggcaagaggctattcgagctgctttggtggcagagcaaagaaaaaggattagacttatggttggaacaagctggacttgtgccaaaacattggtcagatgtggatctttcagaaggcattgactgtgacttgtcttaggaggaattttgtcccaaggggaccccctgcatgtgcagtgacccccaatagggacagtttatgcagggtggactgcta

SEQ ID NO: 73567 - DNA, 1024 bp, Homo sapiens
tagtcacatttaactattcagtttgaatttgctgttttgacttcagcattgccaccctttttgcctattgagttagtagttgagggcactgagtgagatataatatgctttggttctccctttttgtgttgcacttggaggaaaagacatgtactgaggtaatgtgtcatttaggcaaaataaatccttaaaagagtattacttttgtgaattcttcattattcacattgatggggatcttggaggctcacaaacttgattggtcaacatacaaagactcagttttcatttcatgagcaggtatacaatctgttttaatggagactgatgtttaaaaatccaaatgtcactttagtaatttacaatcagaaatattattcttaagaagactcttgtagtctcttctctccttataggctagtctacacaggaagccaaatgatagagagttgcttacttggtttgttggatgatccactgtggagataatggggcgtatatttagactaagatcctgccactgtgcgtgcacccagcatcatgtgctttctttaatgtgataaactagaagctccacgaaggcagagaaatcttgctgcagcaaaaactagataattgtgtttatgtgtctgaatactccctttcctggggagttgcagtggtattttgcagcactttaggtctctggacatgtttgcaggtaccatgcagactgcctcctcctgtaacacatattcacttctcttagagtactctgaaattgataaagtcatactttcttatggcaactaaaataaatttgttttattttgaggtcataaattaattttattctgatattggtgcaactgtgtgtgcgtgtaatctcctgggtcattttactgggaggctcatattatctcatattttgattttccttaatttaatctgaagttaattataatttaagatttgggaatatcttatagttggcaaaatgtatctctcctaaagtatacttcttgtctggttatgttttagagaa

SEQ ID NO: 73568 - DNA, 1021 bp, Homo sapiens
catcatctgtgataaccatttttgtgtatgttttgagtagaccaataatttatactcgtaaagcaatctaagtttagacttataggagatgtatatggtatttataatgtgatttttttgttatcttaaacctatacctaatttttaagataagtttttttaagcaacttaccctaaccttgtctttcttaagccctaataatattctttcttttaattctcatatatgattacattaatgaacacagaacagttcataaacaggggtacaaaaagtcaactcttggtattcacagaattcaatttatggaagtagatgtgtagccttcagtatgctttgagcatctattgcttactatgtattataaaataatggaaagcctaatattgaacatctatctctggaatcttaaataaatcatgctttattttttctggtgaactttgttttctgccctttccccaatggggtcatagaaatatatttttctataacttgttttatttttccctcagttaacttttctgcccttttttctgtcagaaatgacctactgaattcaaactgaatcaaaaacagagcatattggctcgtgcatctgagaagcctggtattggcttccagcacgcatagatctgggttctcaaatgacctaaggatcggttctttctgtatctcttagccctgcttttctaatcctggcttcattcatgtaagttctttctatatctagaaggttagtagaacctcccagtttaacacctgtattttaggtctagtagtatccaaaaattttaggtctctcaccccattgatttttaaaaagttgattatatgttactaagctaatatatatgtatttgtctatacctcatatttgttattttatatgtaatatagattttatttcaaatatatatgaattgaaaatataaataaaataatgtattaatatttcatctgaaaattttgcctcttaaatcagtttggtctctctttaatttttatcatattttaggt

SEQ ID NO: 73569 - DNA, 1097 bp, Homo sapiens
gattttgctacttagttattttgtctttttttgtgggagatcagggagttttcaaaactgtattgctgctgccatctgcctagctcctctagtctctgattttgaatctcatattcttttctttattctatgccaatttatgtctttggttaaaaaacaattcagggttattagcacccccgctgccctaactattagggtagaaaataatgacatttttctatgtaacttttagctgttagctcttggttttgctgttatttcatccataaactttcattaaacctcttaatggtccatgacctacaaatagttttaagtttaatttctatgctatgcttatgcagtgttatcatttccttatgtagtttcaaagttatgcaggatgcatccctttctgaatcccattgatagttgggaaattcagactgcccttcagtactataccccacccctggaaaaataggtctcatctgcttgtatatgtctataaattagtgagtgtgttaaatctatcacagcaggaaatcacttcaagcactgtgaaagactatcttaaagaatttaaattgattgcagatgttagtgcaattaagcaggcctgatgagctcagaatcatgtttctcagatttgaatatgagcgcattttaaaaaagcatagtgatgtactccatgtaaattgagttcataggcatctaagagtttttatcaccttctgttttaaaatggctcagtaatgtgaaaagtgatgtgtgaccccttgtgcagatacttgtattactttggataaatgtgtattatttgtcttaagtatatagagttgacactgaatgattatttcctttgttaattcatttgtctgctgattagtttgtctaccttttgtgcctataattcatttaaaaattatcctatagacagaaaatgtaatgttatttcattccatttttaagaaaaaaaatgagtatgacaagtcaaacgtattggcttagattataggagcataggatcttttttacccttgagttcagatttcttgactaatcaaactttacctaccttaatttcttttgctttattttagctgaaatgtaaa

SEQ ID NO: 73570 - DNA, 1050 bp, Homo sapiens
aaagtgctttgtcttttgctggaaccagtactggatatttgatgtggctatcagaatctgaaaattggttggtttatttaccttttaatttttatgacacacagagcagctctttcaaagcagtggaagatagcttcaggtgcagctgttgtaaaaataaataaatatattgaaattgtgtgaccttatgaatggcagaaatctgcaactgtctaattatctatagttatgtgaatataattttatttgcctgctgtgaattttaaaagttcttttagtaagtgttttacctgttaaaatgatctagaatactttcttctctccctctccacctcttttctctctccttccttcaggcagaactacacgtaaatcattccaaaacaattaatgctgctttagtcacaaattattgatttttccatttgtagtgcatgtagaattgctgctctacttagattctaaaatgaggcattttaattgtgttttccaggaagatatgaatttaaatgaagataaaaaggcaccattgcgggaaaaggacttcagtatcaaaaaagaaatggtgatgcagtacattaatactgcttctaagacagtaagtaaaactgtcaagttgaaaaatactgccgaacatgttttaacatggaaaacagcacatttatctaatgaagtacttaagtttgtgggcaactgtaatcagagggcttctgaatgtataattaagggcacaagtatattatacatttgtttaaattaaaaatatttctcatcttaaaacttttaagctgcttctgttttttagctagttacattgctaagaaacactgggagggggtctactctgtcacctttccttgttagtgaattaatatagtcattgatttttaatgtcacttataaatcacagtgatatctgcattatagaaaagtgagaccgattttactctgtctacatcaaggtacataatagtggcttagaaatgtctttaatgtgagtctccctatgaataaaattatcttgtaacaaattataaatgttggtattga

SEQ ID NO: 73571 - DNA, 1041 bp, Homo sapiens
aagaaactggaggtttttactggggccaagaaaaagatggtttgggagtgggagaagtggcaagatggaagattgaggtcagagataaggattatggagattctgatgatgcctgtggtggacaggttttagataatgaaaaggtccaggtgtggtcattaggactgtagctgaggacagtggaagtgaagcttgcattggcaaggaagccaaggacactctagggcaggggtgcccaatcttttggcttccctgggccacattggaagaagacttgtcttggaccgcaactaaaatacactaacacttttgatagctgatgagctaaaaaaaaaaaaaagaaatcgcaaaaatatctcatggtggtttaagaaagtggtttgaatttatgttgggccacattcagaaccgtcctgggtgcaatctggacaagcttgctttagggccattgtgggtgatagcaaggtgtggagtgtcagaggaatcaacccaagttgatggcagtggaagtgttcagtcagatgttactagccccaaggaaatcggactttagatgataacatagataaataatatggaaataagaatgagggagatgagatagaacagagtttaaatctaagttaaagaaccatggtcaacttacagaattttcctaaacctcagctctctcctcaataaagaggacatacctcaagttactgaggattaattaagtaatgcttatgaatgtttagcacagtgcctggctcaagaatttgaccatagtttaagattacaggagtactagaggtctttgtaaaatggttctgggagaatgggtgagaaggtcagtgcatagagcaggtttggaatgaaaataggaggaaatgtaaacagttggagaagtttgtgttttgaatggaattctgttacctgtgtctgacctacttaacccttcctctcaggacccttggatttgtcttgattgtggtttccttagtctcctttcctccctcaattcagtgtgtatttactatagccgaatattctacaaacctc

SEQ ID NO: 73572 - DNA, 1046 bp, Homo sapiens
atgtaggttctagtgagtgagtggaagctttcacctcactcttctctcacctcctaactgttctctgggccttcttcctcggtataactgttaccagacaactctagtacattccgatgtgatttctgtgagacttcactcaaagatgaatgcggcctaataggactgagctttgtttacctgtacctacctagatgtgatgtgtcttgtgggatatatgctaaattatacatcatatttatgaaagaaaggaaaatgactttaattacctgaatttgtgcctaactttaaagtcaagtaatagaacataagtcagtagcttttaaaaataaaggctcaacctagaattatttaagatagttttatcttattattctagtaggatataaggctctctgtactataatttactttctattttcattaactttttatattttccttggtaagttaataacaatgagtgataaaaagtgtgatgtaccatctgcccaaccacagtttttcagtaaaactatatattcatattatactcttctgtgtaaagtagaaataccagcatggattggggcgactgaatgtaaaatacatccaaacaagttctgttttaaataacttaaactgttcatttagtcaggtgggcctttcttagcccattaatgagttaattaggacttcctgtacttaaattttcagtagtaatacttaagtactatcttagaatctttaaatatttataggatagtttagagagctcctcctcaaatcagcacaaacttgggaataagatcaagagctctcagagttgaatatactaatatgtagtagggtgtacagacttgtatattcattgttttgtccactcattcattaataatttgttgagtgcctagtactcttttagaaatacaaatatggaaaaagaaggtctctgtcgtctgggtgcagtagagaaatggatgtatagacaatcagtagttttagtgtgatatgataggggctggaaggtcacttgatcttagaagacttcatgtgaaggtgacttt

SEQ ID NO: 73573 - DNA, 1534 bp, Homo sapiens
tagtgagtattttaataaatttttttgttgaacaagtgaaagagtcactgttctgataacctgcctggtattggatctcagcctggcttggcgctagtcaggcttcccagagacagagtcttgccttttttgcacaaggtaagggagctgtaatgaggaccttctgtcagtctttctgaccgcttgcctggattgccttgcccctgctttcttcttaattgtacacgtctgtctctcctggattcctcattgaccctcttcacatggacttgctgactgaactactgtctcctcactctcactgttctcttctgatcttgtgctttagcttgtctcttgggtaggcccagaatttagtccagggaaggatcaggcaggtagcctagtttaggcatctgtatctgttgctgtagagatttgagaataagcatggctatcttcaacaggagacaccaaagagtaaattctttcttattcattgttgactgatacagtgtagaaagagcattgttggatttggaatcagaagattcttggtgaaagacagaattttacctcttattagctctgttaccttggcaaatcaattatttgattgttcacttatttaaattgggactaattatacagtttcttcctttctcatagttttggtgagtttcttaagtttaagtatgttgacctgctgcattcagttctgtccgtttttacccctttaaaaaatatttcttgatgtacagacagagaagtggtgtgacacatttgcagctgagccttccagggtatatgttatagatcaatgcagagttgtgagaagggaaagggtagctggatattttgagggctctttaaactatttctggtgtgttagagctcagggcagcatttgccaatgatgctttgatatgtactggcaatatgttttctgattgaagtttgcccccttacaacatacacattgcatgtatgctttcaacgtagaaattcttaatgtgaatagccttttttttggtcagaacttgagagaggcatataagaatagcaatgtgctgtagtcatacatttgaataacagtattttagaaacattaaaacatcacgggaagcattaatgttaaaaacctatccctttaagttgttttgttaaaggtctgcaaaagtacttcatgttttaaggttatttcttgagttactatcagaattgaatttcactgtcttgttaaaggaataaaggattgctatattgttgggttccctaggcagagttaatagactataagcagtgtttgttctataaatatgagcattctctttgtataaagtgcagcttaggtgctagggtaataaataaaggtgaataaatgtttagcttataacttccattgcttatacctgggttttgaagaaggttttcctcatagaggcaaaaaggttgggaggaggggggagtgaggggagacaggtttgaaaaggtaagttggaagacattgaatgtggatgtgacaatgctaaattatccatcagtgtgtccactg

SEQ ID NO: 73574 - DNA, 1050 bp, Homo sapiens
gaaaaatcatcacattaaaatcttttatatccagtgttctttttcattttattttttctatgtgccctcattctcagacagatacattgtgttctaagttaatatacttaatggtaattaatactgttaattgggataatatatttattgtaccatagttaattttttagtttgtgagttttacaaagtaaaaaaattttagtaagtgtttggaactatcacacgcagggtaacttttgtccatctttttgagaaagagattaaaacgattatatataatgtgtttttattggactgtcagaaatttaattatattcaagttaggattgtagaattttgaatgtaccctattaactaaaataaagaagctgttataaattactaatatgattgcttttttttaatttgcagcatttaaatattaggacactgacggatgatatggtaagattatcctcaacttttcctttgttatgaattgtaactaaccatataacgttgatggtgtgctctgctaacatctttgaaatggctaaaagtcacatatattggaaacgtactattcttatagtgctgaaataagaggcagaactggtaaaatacactaaattgttggttttaagttgtaaagtgaatggtggatatgttaattaaaaaaatttgtttaattacaaattgttagtcaactttgaatcattcaaatcaactctcattctttaggaatgagttgcacacttcaaaaaagaagtaaaaatagcaaagacatgtcagcttttcagaaatatgtagttgctaattaaagtaagtcagactaaaatattatgcatatatatttttaaaattttgcttaaaaatgagagaaccgggtatgccttactacgttttttatgttgaaaataatagggcttctcatagtaacactttatagcaccattgtagattcttgcatagtcaagtaagtttttctgagaaatatatttttaaatgtaacttgtggttaatagtaaaggaataacaagaagaacaacaacaaaacacaaacaatgacac

SEQ ID NO: 73575 - DNA, 1049 bp, Homo sapiens
aaaatacaaaaattagccgggcatggtggtgcacgcctgtggtcccagctactcgagaggctgaggcaggagcatcacttgaacctgagatcaagtgcactgctgcactccagcctgggtgaccgagcaagactgtgtctaaaaaaaaaaaaaaaaaaaagtcaattttaatggaattaaactgtgtcagccaaagattatttaaaaatgctaccacatatttggttctgataataataaattgatgcaagcctactggcttgaatctgatggtggctgtcatgttcctaatgatatcaatggacagatcctttgctccattggcctgctagttcagatatgctaaccaatgaaagaaaacataaaatttgcgaaaagtcttgggctacagcttggcatctttttcactgtgtgtggacctcctgggtttgtatattgctttgtgtactacaatttatctgtctttgttacttgtaaactaagttagtggggaaactatttcacatgcctcttgatattcacagcatttagcacagttctctgaaagctctaaatccattttttgacagcatgtactatcttcaataaaagttttgatgcattgcttaaatgggaatatagagaccgatgttctgtgtttctacttttttccccccgactcctatgttcttttgaagaaaaatctataaaggctttttttctctttcaattccagagtgaccctcttgaccattcatcctaggaactgtcattaacagaaaacattgttacccatctgtatgtggttctccttactttttagggagaaaatagaattagtatttgagaaacataggaccagaggaagaaggatgagtttttagcttaggaaaagagccctcatattctttaatatcacaccttaaccaataaccagtagtcttgtggacagaacggttatttattattattttttttttttttgagacggagtctcgctctgtcgcccaggctggagtgcagtggcacaatctcggctcactgcaagctccgcctcccgggttcacgcc

SEQ ID NO: 73576 - DNA, 1047 bp, Homo sapiens
tatataaacttttgattgtatttcttaattcccaagtatggattctagaagtagaattattaggttaaagtgtgaacatgggatttgttttaccaaattgtttcctaaaatggtttaaccaaatttcctttatggtgatgctgaaatataaacaaaatctttctcaaatatatgtgaaagaatgggtgatgctctgtcagtctcaggaacatccaatctaaatttgtgttgtggacaagatgtctaggatgctaagccactctcagaagtaatttagtagttgcgataagcttcaaggtgactctgggagttctgggatctctaattctctgtatagcaaatactgtaaatgcttttcagccttctccagacaatgaaaaaggtcttggattcccataacctagaactgaacctacttgtaaagtggttcagagattcgatttgcttttccctggacatgttgcaaaagagtttttcatctggtagtataggtgaaaagaactgaaatagacgaagaggcatcttaaaatatgtacaaaagctgtgttactaaattagccattatatttttccttttattttaccccaacattgaatgagttcattcaaggaaaaagaatattggagttatgttagaatgaaaaatgacttgttaggttagcctctgtggggtgcaatctaggtcagagtcccaagccacaatatgataattgtttttttctacagaggcagttctttcctagcaggtatgttgcctccttaaaccttgtgttctcagagaaatgcatcttttcactgctgtggacacttgaatgatgccttctccttaacgctgatctctcgttggctctcctttcacgatggaggaattgaggggcagggaggtctggatacttgagtgcatgacagtagagaagctttggatagtgagtaatacatggtatgtttgtctttctgaggttggcagaattgcagttttgaataaatgagcagattaaaagaggctggagagcttttcctaattctcacctgttcctaacatctccc

SEQ ID NO: 73577 - DNA, 1008 bp, Homo sapiens
aaaaaggaggaaacaccctagcaaaccatgtattcttattagtgttagtcaattgacagaaattgcaacccccctccatgcccatttatctttgaggttttgttttttgagacggagtctcgctctgtcacccaggctggagtgcagtggcacgatctcagctcactgcaagctccgcctctgagttcacgtcattctcctgcctcagcctcccaagtagctgggactacaggtgcccgccaccacgcccagctaattttttgtattttttttagtagagacggggtttcactgtgttagccaggatggtctcgatctcctgaccttgtgatccacccgcctcagcctccctgctgggattacaggcgtgagccactgcgcctggttttaaggtgtggttttgtagtcagtgttgttgttatcatttagtaatcatccaattggaattatgctcatctttcttgttaagatttcatttttgaattctttgctccataaataattcagaaactgcttcagcagctggctgtcccatcatagttctggggactgagggaaaggaaggagagtgaggctggatttttgactcattcccagcctaggtactcaccaacccttataagtcacttctgtgctgttcaatttcctgttctctaagatggggataatagcgagtttttagggttgctgggtatactagtaatcgcaaagtgtccagtaaggtgtagtagtagtgataaggtgggctgtatcatatgggtacctagggacccatttagcaatcttgggttctgtctcagttaaaggcccatttggtctaaaggaacagatccctatacaatatctactgtaatcctgaaaggaggaattgtaaagatacacaagagtagcacctctaatcaagctggccgtcacaaaggactggaaccaggaactaaaagctgacagcttttctcagtctctttccctctcaggccatccagtgtctctttgcttctcactaggcat

SEQ ID NO: 73578 - DNA, 1044 bp, Homo sapiens
attagtaagtatcagtagtgaaggatgtatacaatgtgtttcaaaacagtttgcttctaatagtttttttggttaaataagaaacttgcaatctttaaaaaaatatattttatcatgtatgtatcatacaaaagaggtgtaaaacactgtatactcactaataagcttaaaacattaaatatcataaattccattgaaatgttcattttctcccttcttatctttatctccttctaatctttactcttcatttcctgggtttacagggcttttttttttaattcaattttgatttttttaaattcaattttgatttttttagggttccaatttatatatatatatatatatctttccctaaaagtaaatctgtgaatggaattaatactcagtagctttctgatctctccatctttgaggatcatgacagatcttaaatactggaaaggaagggggagactatgaattaatgtaccaagtgtgaggtcattctgtgtgctgagggatgtgggatatatccaagtagctgtggtctaagtacacaccctcttgaattaaagaagactgaatacctgttcagtcatagttctgtcaaaggagttatggtgtagaatttcttgaagcccttagtaaaagccctgagtagattaattgtgagatccataatgctgcatttatttagttaattttattatgaagtatcttcccaagatacagagagtttatcccgtaattgctgcatttttttccgaggttggctgtttatttgggtgtcataaaatgaaactttgtaacattcagtttttaagtaaaagatttgcaaattggtgacattaattatggactttactatagaattaaactgtttttgtttattaaaacctttgattgaattccttgcataatgacaattacaattcttttttaatgaaaaaattgacagcctgggaaatgaacatgaaaaatggagtgcatataatctgcattgagaaattcaatatgactatttcacttctttataaaaggtgacggtctccaattaaa

SEQ ID NO: 73579 - DNA, 1280 bp, Homo sapiens
tagaaaaataaaccaccactggaataacaaccaaaacctccattcatgttttgtctactctgtatttatagtttctaggaagctgggaaaagatggaggtgatatctaaatgctctttttgattttttgaacttgttccttcattgagttctcagcttaagtgatgctctcagttgtcctagggttaaactgtcaagaattgagatactgtttttagttgaaagctttaggcacctaaattttattcgtgtcagaattctacctaacacacaccaggcattgtaagcttcagaaggaggtaaaatcattttattcaggctgctgttctaagaaattgctctgaattttcccagccattctttcctttctatccttcttaataaaacagaaaaacccagaaatttttttaaataaatgatttatcaaaagaaacaatatatattaagtggctttttgggggatacatttagttgctgaaagtagataacatatggcatttaatactcctggaccactctgggtcttttctttgacggtaaaaaggggtgggggtagagatagggatgattgtctcagatttagaacagggcttaattgcttttttcaaagactcatgtctttaattatgaagcaagcaaactgacatacatttattacatggtgaaaccttgcatctcatctagtctatcttgtagcaattgcttctgaacagatgttacctgaaacacctttgtgcagttggtggaatgctaaaatttgtcatgcttttattattgttgtcttgaattaactctactttatggcgtaactttattgctgtgtcctagaatctttatatatttattgccttataaattggatttaaaattggctttttatatagaatgtaaattaacatgtgtctaacttgtttatgctgcagaataatacaggaaaaaactgctacgtattacactaatgtaattgtctttaacttagcacatagtatcctctaaactaggaatcaaatgaatgctaaagaatatgcttatccttacactcttgcttgtttatctcagaaactaatttgacttttagatctataaaatatagattaagcataaccttttacttcatgggatattaaggatcaaagcatgggctttctttgaacaggatctacaaaggtaacttttctttcagtagcagcaggatggcattgaaataccttaccattgggagtaatttttctcaaatagcaaattgaatagtctttattaacttaggggagaatttaagag

SEQ ID NO: 73580 - DNA, 2106 bp, Homo sapiens
atttggtttccagtctctgtgctgtttttcattcttatgtatgtcacattgaccatctcagcatgccatttgttaaatggattctcataaagatgaaatgacatctaaaagataacactcttaagctgtaaaggtaaaaaacacatctaaaacactgtgtttttgggtgggagtctggtatgaatcatgacttccagttaatttagaagtaatttggactcttggtactttgaaactaatttaggttcttgcttatatggtaatttctttagttatatcttccagttcattaattttgttatcagctatgtctaatctgctacttttctgaatatttgattttagcaattattttttattttaataagttccatttgcttatttttcaaatctgtctgggcattcttgatagtcctttgtttcttattcatttatttctttagacatttcctacttgattgttcttattctttatttgacagttctgctgtttgcaacctgggctgtctacattgactcagattcatgatggcttgctctctttcttgtgtgtatttatctttgtaagctcattgctttatcttcacctgtaggattccagagatgcttttctttggagatagtttgagtttgtctgccaaggagcctgggcatgctactgattttggaccaccttcctgttgaactggaaatcttaacatgggcagaagttccaggcacagctctactctgttcctgtactaaagttcagtatcccagtctcaagactgcttcctgagcagctcttcccagtttgcctacctttcactgctcttgattgcacaccagtaactcttgttttttggatggagagggatctttgagaccatcaaagttcccagcaatgcctcagaaagtaattgtacttgtaggtgtcaagtcagtcactgttcttgcagatgtcaagttagttcttggctttttcttgattggatgaagtgacgttatcctaaatcttttcaggtcacccagtcattatctgagcctggggcagctgtttttgatgggaacaagtaatataggttggtgatgtgatggataggagtaatttaggtggccagtgttttgcacacttctgcaaagcagcaagcgagtagtagaatggagtggtagactggtcactccctcctatcttagtgtaagaaagcaggagctctggtacccgctgaaatcttgttttactttgagtcctgttaaagttggcaaattcttgttttctaccaaatgtatagttgcgggcttcaagtcacttgtgagttgggtaaaagagtttgtagcttagatatctcttcccatagataagtataaatagtagaaattagtctattgtaattgtatgatactttggctgtgctacgaatcaattgactttgggatgcttgtgaattaaccaacttggtctcatttgaaaatatcttaagccgtgagcattgagatggtagggatagctactggggcatagaagagagatggaggaggctgagaggacagggcaagtatctgggtggagactttgtgaaggcagataaaattccgtaggaattaaacttggaacctgccctaggccacactcaatacctggacctgagtcctatatcctttgtagaacagaacagttgtcctacagattgtggaaagcctttcagtaatacctgtttctcattactcttggcaacacacaggtagtggtggcagagcaggacatgtggcttctagaagtgtccatctctaggatgtaggtcagtccattcaaagggagcctgtaaattggtggtccaagttgatgaaggagttctttttaattaggagagtcctctaaaagttctcacagacttcagtgtaaatcgtctaatcgtttccatcaaatagattgttaattattgattgattatgtcattgtagtaccttcagtgttggttttgagatttttcttttcttttttttctttttttgagacggagtcttgctctgtcgcccaggctggagtgcagaggcgtgatctcggctcactgcaagctccgcctctcgggttcatgccattctcctgcctcagcctcccgagtagtt

SEQ ID NO: 73581 - DNA, 1069 bp, Homo sapiens
ctcttatgcttttccagggcagggaagtgagtcttatttttctccttatctggattgtcaagaaatgcaccagattgtaggttctctgtaaagtctaatacagttgaccttggaatgcccctgccagtcagaattctctgggcagggcctctgcagaagcttaggtagagtcccaccctgcttcgttatattgttataaatcttcagcaatgttatattgtagcatttgctactttatattgcaacttaactgtttatgtttctcccacctgtctgtgctgcttctgtatggcagtgactcataaaggcagtagtaatctgcggggctaaaaacactatctttctaggaattgtgagtttcatgtaattcctgctaggtctcgaacagactaggcatgaggatctcctaggctttcaggtggcttctactaggtctttaattggggacttactatgttaaaatttagaatcacaaaggtttaaaggcagaaaagagcactggagggaaaatttctgactgaagggctttcaccaactcattttagttcttatatcctgagtttgctcttacacttggggttctctgttaactgtcactgacaaaccatttttcttagtattcaaatctatgtacttagttacttgtagaagctaaaaagaagtagatgctaaaacatggacacactattgttaaatctgttctataggcttcacctaaaatagcagattagggaaatatttagtgctgaaaagtttacaattctgaaaatgtgatcttcaggggggtacagaagatctatgtagaccaatctgttcaagtttacattatttttaagcgcagtttttttccttcttaaggttttaatcttcattagaacccctataaaaatcagtattttaaaatataacttcaaaagtagctacctggcggacttaaaataatttttgttcttcaatggccagtagcacacaaactattagattttgctgatttgaacttgaatgttccagggctttctacagagtagtgataatgtttaaataatgcactaaatggtaccttgtaaag

SEQ ID NO: 73582 - DNA, 1050 bp, Homo sapiens
ctaatacttatttagcacctactgtattccaagcatatgctaggtattacatgctgtctcctcatttattcttagaaaaactctgtagatcagtattttcagtacggtctttttcggcaagggtaaactgaggcacagaaagatgaagtaaattgactagggtcccacatgtattgaaaggtaaggctgagattttcatctagttttcactagtttcactaaaaagtgatagtctctccagctactcatgaaaatgccttccaatttttgtaataccttacatttataaatagcatttcttatggaaacttaaccaagtatgtgatctccttggggttaattctggaaggcctcaccttgagagaccctcagcatggactttgtaggcagcaatgctatgagtgcagtagtcagtgtagtgtttagggcattaggcttcatgtaagccttttgaactgatatatggttttatagccactacctttttgctgagaaaaagaggacagaaatattaagtaatctcacatcttaaaatctgatttattaaaaagtaaccccagttctgcttctgaattaatgtatgaaaatatagaattagaggaaggctgtaaattataaccccaatgaaagtaaaaatatctaggccttcattttatacttttaaatttatgtggagtcatggtttacaaagatgaataacaacatagttaggttaccattgccactatactatgtaatatatcaattatgggatttcaaaggaattatttacaaatttttacttgctcagctgttacaatttttttaataccaaataagcattctagggtgaatgccttcatggattggtttatgtatggggaaaatattttaatattttgaatatgagtcataaaatagaagtttgttgtttattacctatctcacgatcattttaaaatcgtcatgctgtattttgatgtcacagaaaagcaattattgaaataatgctgaaaatactttttgtaactattctacagcaaaaaagcattagtctgtaataatttatgt

SEQ ID NO: 73583 - DNA, 1023 bp, Homo sapiens
agggtcattgccctggatttaaatcttctttctcctgcttattggtttttgtgacttttcataagtcagttaatcttgccagattttaatttccttatcatttaaatactactcccttacaacattgaagacataaatgagataatactaaatccagtacaatgcatatggcaagcttcgagaattatgagcaatttaggatggtatttttatcttgaaagtctaagaatatgtgaatccttattatgtcagctaggtatcttgttactgagagatcttcaaggggattcaataaataaggtaaggcaaattggtaaatcattattgtctgggttttggccccaaaccccatgcagaattctactacttgaggtaggttggtctctggtagaatgaaagcaagctaaaaccccttctctgactgtttctactaagttccaagcccatctgatattaccatttctgagagagaaagccaaaggagagtgaggattggagagcatttggcccagtatttaagaagcaaagagttaaaaagcaacatgttgcggggaggagggtgtcatcttagtagaaactgcctccattaacgttgtgtggtgcctttgaaagggcctcacccatgtattttccaaccaccttggaatctcattcactaggcctgaggctcagtacaatgcactggagcttctccaagacatatcagtaatcttttttggaagtagattaaaggagtgtagagacgagtcttcaaacttcatctcctgaaagcccaaagtaaatgatcacacagtgtgtattattatttttatagttaataagacttagataatgctgttttcagcatttgggaacttgagagtgggaagggagaatggagagctgatagatctgtcatcaggtaagaaagattgtaagtctgcagttagaagaccagctaatcctggacatattgaatttacagctctcattctaagacgcatcagaggccttcagaaaggcgtcgtcctgaagctttgaaac

SEQ ID NO: 73584 - DNA, 1039 bp, Homo sapiens
ttatgatctaattattcttaagactttgaagtgtgttttatagcttcttaggggttagagaatataataaaagctataatttcaataatattatttggttataaagttcattctgaaaaaattcttgtatagcatcttgcagccttgtacatgggctgaagataggtaatgctgactgtgtatttattggtgtcaatatgatatgtttatattactgaaatttttctgtatttgtggaacacatttctttgagatcttcccattttcctttttattaatgagttgagaaaaagttcattttatactatttttactggtaagattggactggagatcagaattgagggcttctttttaggcagtgatgcctttttttttactttatgagacaaaaatataaaaactttgaagcctgatacggggggtgggtatgtttttagagtgtggtttataagtgcagagacatctttttatatgttaatataattgtactaaccaatccacatatgtatattgtggtataatatggaaattaagctcttaattacaaaaccaaatttatgtcttattgtgcattagtcaagattgtttgaaatctaaaattatttattaccctaaaatgaaggctctcttgatccagtgtatgttttaaatatgtgccctgtttagatagccacatatttatatagcttttaattttatttactagttacgtttattgaaaagttacttttccagttttctacttttacttttaaatatatgggatagaattttatttgtgtaggcttttagctattgtaaaagatacaagatacttttgaagaagtattactttctaacgaaaacttgaatctcttttggaactactaagttgacttattcttacttgttttactagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgca

SEQ ID NO: 73585 - DNA, 1061 bp, Homo sapiens
gtatgaccatgcatttaccaacagtgtgtgggttgatgtggtcaaaatctatgtgagttctttaatgattatttcaggttttttttttttttaataaggaagtaagcatggtcaacagtgacatgagaaggaggtttgagaagtgaggagaatgtgtaaaatagtggtctagaagattaggtatatgtgtgtgctagggaaatatggtaagattgctagacagcattaaggcccacttgagtttcacagtcatgatgatctcatggatgcctaattcatataatatgagcaaaaagatgtggctcataaagggcaacaccagttaccttatgggtaatatttaggttgtgatggttctagatatttatatgagtgagtagtaactattttagagcagtaaaaagcaactccgaaaatgctgcttatcctattccttaatccatacaatggaaagaaaattataagtaaatgcatccagaagatgggactatttcactggcaccaaaggaaaaaacacttttggaattaggggatgtaaattttggaaatatatttaatttggagcaggtgagattccagacttttcaggtaattttgttctagtatattaaccaaaatagtaaataccatctgttattgagtgtttgccatgtgccagctactgagataatcacttcatatcaatgatgtcatttaattctccaaatatcccaatgaggtaggttttctaatcccagttttaaagatgaaaaacctgaggctctgtggaaggtggaagttaagtgacttgcctgaaggctaaagatagtggctgggccaagataagtcccagccttgtctagttacaaagcctatgtgcttaactgtgctaccttgcctcctagtctaataaattttgtatcacattaataaatacgtttttctagttatacaagtaatgactatgaaggcatttcaaatatttttttttttgctgggattccataaacccaaaattgaatgaatctagtaatgaatccttggtaattgaagatgtggttttaattttgatttgagttaaa

SEQ ID NO: 73586 - DNA, 1052 bp, Homo sapiens
aataattttctaatgttattgtattatatataatttatatgtaagatgtttccttactgtaatcattttaaaacatattttaaaatattggtcattgtctctaataaaaattgttttagcttcttcttttattatatccatgagaactataaaaatatttgccaggcatggtggctcatgcctgtaacttcagcactttgggagggcaaggtggatagatcatctcaggtcaggagttcgagaccagcctggccaacatggtgaaaccccatctctactaaaaatacaaaaattagccgggtggtagtggcacatacctgtaatcccagctactgaggaggctgagacaggataatcacttgagcctgggaggtggaggttgtagtgagctgagattgcaccactgcactccagtctaggtgacagaaagaccctgtctcaaaaaacaaaaacaaaatctataaaaatattgtttaaccaaatgtttcatactgtacaggtaacaactggcgatgcttttcagttatgaagttgtgtctttcaaaaccaatattatttatgtcctaatcttttcctaatagttttgaaaaacaaatataagataaaatcaaattttcaaatttaatgtcacatatatatttattcaaaaaagacaggccaaataagaaatacagacttaaaagcttttatatgcagtcggtaagaaatgacatattacatgattaatgaaaataataaattagtaatgagagtttcaatctaatgttcaaacttgtttactaagattatgcaatcataatactgaactatggacataattttaatgattcaagataaccttgcctggtagctggatttagaacccaactctcaaggcagtagtcaagtattttaccctaaaatcattttaacaagtagtcttcataatgcttgtagtattttcttctctatagttgtacactcattttcatgacttcccttttattcacaaatcatgtaattatttttattgcctggcctggatttgtgaataagagattgtgactagtaga

SEQ ID NO: 73587 - DNA, 1055 bp, Homo sapiens
agtcttttatttcaaagttttattgccaaaataagacctacccattgtttcgaatggctactaaatactttaatcaggcagacttgaaaacactatttggtttgctatttcattgttttaaaggtttaccttaccaggacctgattgcaccattactagtagcttttctgaccctaaactctctttgatgatgttggcctcacacagaagagattcatgataacacacataagtacaaatagctagacgataaagtgatacacacacacatatatatatggaagattattttgcctgtagctatttcttatattctcttggttctgtcttcatgggtacaatgaagataacaggattgatgggaaagctgtgtgttggttgccctcaggtatctttagcaggtatcgttgtgttactttctcttgttgacctgctcacactactcagtgccagtattcttaggtgagctggggtatattgtaaaataaacaaacaaacacaaaaacagttgaggcaagctactgaattgtttttcagctcattttaagatagcatgtatttttaattggagttaaagcccagagtaaatttttacttttataaagttgaatctccactttggtggaaaatttggttattttctgtaaatctcttgttctaaaattaacttcattgatgggagaaaatgttggacatttttctaagataaatctagaaagtgtttcaggataacatcttcataatgtttaatggttaaatgcattatggacagctaatgaagagagttaagatcttatttatgttcatattagcagcatcatttatttgggtctgttatagactcaaattgacattacaaagaagtaattgtgattcagtgatatgcatatatttagggtttaaaaagtttgtttttctaatacagttgcataatcaaacctttcttgcttctgtgttttgtatcagcataagctgtctgaggattttgtttagttttagtacctctagaagtcagaatttagcgcagtaagccttggcttggatggacttgttat

SEQ ID NO: 73588 - DNA, 1128 bp, Homo sapiens
agatggatatagcttttcttagaatactagaacacatgagcctctttttcatttttgccattattttcttcctcctcaattaattgtccgttcgcttatacatttattaaccataagataaaataatgtgtcatttattgagcatctgctatgtgccaggactatgctaggtgctttgcatactattaattcattttatcatctgtaaatgcaaaatatatattatttccgtttgacagataaggaaataggtttgtatattaatatttgtattaaagcaaaaataacataaggttatttctaaatggtttttgacccacaagtctagtgcctcgtatataaatacctgtttatcaacaagagagccatatctgactttatctaagtagctaaattactcagatacatgtattttcatttaatggatcaatttgtccattagtagtttttttaaccctggcagaaaaatatttttatagtaatcctaacctgagtttcatgatgaaatactgaaaataactcatggttattaatgatttaatgccagtagtataatggtagctttgttgaggtttaagagggaggttaatactggggtctggaatctactcagttaatcccccagctctaccctgtgctagttgtgtgaccttgtcaagcctctttagcttccttatctgtgaaatagggatgttataactgtactctgaggtaagctcatttggttttttaattatgtgagaaattttactaaactagaaatttttttcttttttgtatttgtaaggactagtttgggctttgcatgcattttacatgggactaaacagggcaatctttgcagttgtattgttggtgtgtgtggcactttttcttagaattctcatgatttgttcatttataacagcactagtcttatgctttatgctaactttttaaaaattggcttttctcagttttcttttaaaaggggctttgaaacaccaaaaaattagttgtttgaacactgggcatcataaatatgtttattttgagcttagtcttcaatttaatatgtgttgtatctataaagattttaatgagaacaggaaaacaattgtatatatttgaataattatacaaattata

SEQ ID NO: 73589 - DNA, 1682 bp, Homo sapiens
tgcaaaggctagaacatgactgataataatagctatatatttctaaattagagtggcattcagaaagagttgatcagggttgtacttgtgcagtttcatagcagtttctgagttagcaatttgcagttctatttcattaatgttttaggaaatgatttaccagaatagcatatgtaggtagctgtattataagaatttggattatccatcatttttctgtggtcccttttactactttactttattaatgttgctgactaagaaaactgtacattagaaatgcaggactccaaggaagcaaagaaggagtaagataatgaggtaggaagatggaagaagattttagaatagtagtttgataattttgtattaatagaataaagcattttaaaataattattaatgcagagtcttcatcttaatttgcatatggtatacttttacctttcagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaaggtatggatgctttaaagatattatacactaatattacgaaatgtaacattctagtgggactttatagaagctgtcactttggaactatgagtctttttctactattgtacctgtttaaaatctttgaacagatttatagatatataaaggataaacaaaatatttaatatttttatggatgcctagggacaatctgtcccgtaagatttggttaagttcggtttggttttagcttacatgccagaaaagtattgtaaaagtaattatgtgaagttgagctttattttacttatcatcaactgaattacatatgtttgcttttcactctggtaaaattacactgattcacaaggaagaaaatcagttgagaggcacaaagt

SEQ ID NO: 73590 - DNA, 1066 bp, Homo sapiens
cttagctggacaataaatttatcaggtgtacagctcatttagtgattctgttctgaactacagcaatactttcatattcttcctacttatttgtgaatatttatcctttattatgtcatttattaacctattttctttctctgcagtcaacttagaaatcttttataaaatatttgaaatattttacagaaagaagcaggatagaatcactaaatcttttggagattctggtatttcttttctcctacttttataatcaagtggttgttgacgttttatgaatttgcgtaggttactataacagacatctctggatcatgcacattatgatcagcctttcttctttatctgcataaataattaacttagttgagagaaatatctcctcgaaatatagaggccaccagcttaacatatctcaacctatttctattttaaaaaatatttgtgtgcatatagatgtaaaaaaaccctgaagaaatatagtctgtgttgctgtcagtacatgcaatgtagagttcatatagaattctcttagcccctgagagtattgaaagtgttaatgttggggtctttgagtactttttaaaaattttggtaagaggaaactgtaacaagttttaagtcaaaaatgtacaaaattatcaaaaaacaaaacattcactgtaccaataagaaggtaactgtaactgataagtcatactagaaaaattaaagggctgcaaagctgcagggaaatggttagagaggccttagcacaattacactatggattgtggaatttttaattttttaacttgtgcactatatatgtgcactacaattttttttattgtgaaatggtattgtatctttcattaagatttatgtttgtattgccacaagattttggaaaactcttgttttcctaaatgtagcagtgatcatttagtgaagatttttttaaactagtttgcagaaaaacagtcaaaaaagcctgcatataagccaaaagcctttgtagaaaattagttgcttgtgttgtcttttaaaagtataagcataaatcattaaatagaaagcatga

SEQ ID NO: 73591 - DNA, 1031 bp, Homo sapiens
aagcaagaccatatctctttaaaaaaaaaaaaaaaagaaagaaagaaaaaagaaaagaaaaaattgtcaaaactagtaaattccattgggtatgtgtacatttttaaatggagaagaggcctcctaaaagaccacaatttctactttgtgtcaacatttatattgctcttttattaataggctactgtgttgtctctgaagcctttgaatagtatattaattcattaaaagcttgttattcagaaccttctaaaaaacaaactcttattagtacttaactgctcttgatctcctattcttactttcctgataccagttgataaatcagatgagctgtgatactccatatcaaactccagagctcacttgagagatttcaaagtgagttcatgcaaaggaactctataaataatcaatagatgtatactataagtaccttctcttttaaatcttgatagtatcagaattttaagttagtatatgaactgggttgttagctaaaacagtggaaggagatcagtaattatttattgaatgatggtatattcctggtggtcacctttattactgaaaagtccttcttcagacaccaagcctgtacatgacagtttaatatgatagcttttcaacaaatattctgagttctttttgtaccaaagctactttagaaaaatagatgggtctatatgctcaagggattaaaaggatataagagaagtagaaggtatgttttcttcccttcagaagccacctaatattgttaaggctaccatgacactgagatgataccagtctgggaaccattgctggcatgggtcttgattatagttttacatgataacagcatgttaagtgaatgagataatttaggaagtaattcgggaagcccaatatagacttttcagaaacttctatttaacagccttttattggcatcttttatcatgtctgattatgttcacttttcccagattgtgtaattaggaaattagggtcaaccctcttggtcatgattattaaagagtttatta

SEQ ID NO: 73592 - DNA, 1758 bp, Homo sapiens
tctttcttattgttcttgtagaaaatcttggggatactttttcttccttcaaccatactcccatcaaaaatgactgagaaggttttctaagcttggaaagagaataattctttttaaaagagagctaattactaatatgttgaaccttttgaaatctcaatgtaagcaaaaattcatacatttaagcatattgcacaaaatcagcatttatataacaagatgatatattctctactaacttactgaggtaaagtagtataaatggttgataatgtgaggattagagtttcaaaacatgattaccattggaatgcttattgtgtgcttgacaccatgtataactcttgatgtacattaactgatttaatatctataggatctctataaaacaaatattaatgtttactttacacactaggaaaactacaaatatgggttcagagctgttaagtaacttgcctaaaatctttgagctagtaagttgcagagctgatagtcaggtttaggacttggtgacatcatagagcatgaaccttcactttatctgtaaatggaggtaaatgataccaacgtacttgagaatttttgtatgaatttaaggaaataatgtttataaaaatgtttagcatattaattgattctcaatatgtgataaattgttctgatgagtatcatttagttcattcaatcttagttctcacaaactataagggtgagaatggaaaatgtagtggttagaggtatcagctggtacttttcaaggtgatagaagtattttacatagggtaggaaaaaaaaccaacctatttctttcttttttttttttttttgagatggaatctcgctctgtcgcccaggctggagtgcagtggcgcgatctcggctcactgcaagctccacctcccaggttcacgccattctcctgcctcagcctccttagtagctgggactacaggcgcccgccaccatgcccagctaattgtatttttagtagagacgggctttcaccaagttagccaggatggtctcgatctcctgacctcgtgatctgcctgcctcggcctcccaaagtgctgggattacaggcgtgagccaccgcacccggcccaacctatttcttttaacctattattccattgctaaaagaacttaattttacactaagactatctttattgtcttctaaaattcaataggatcttggttcaagattaaggtacatttcaactacccatttagatgttacccttttagatggtagtcttctaacttccactcagtttgtaaaaataaaggctgacaagtcaccaaaataacttttcagaaatacctgatgtaatattacatagttaatttcagaatataccaacaataatactgtgccaaaataatatctttcattaacacatggactttaactatacttaaatttaaaactttgtatttaggttgggaaaataattctctacaaatttagaataaaatagatctgggaatagattgtaagcatttcatttgatggcaagcacaatatgagtgaccagtaattgagcacctactaaaaatattaaagcaagattagatatcagattgcctaatagatttatatattgcctaatagagtaccttcatgagaactaatagcattgtattccaagtaagccatacttggaatgttattcttagtactaggttatgcagaatggtaactacgaaaatgtataaaggaaaagatgatcaagatgatggagattctgg

SEQ ID NO: 73593 - DNA, 1039 bp, Homo sapiens
aggaaacagacttaagaaaatgtaaatagaagttccagaggccgggtgcagtggctgacgcctgtaatcccaacactttaggaggctgaggcgggcagatcacctgaggtcgggagttcgataccagcctgaccaacgtggagaaaccccgtctctactaaaaatacaaaaaattagccgggcatggtggcacatgcctgtaatcccagctactctggaggctgaggcaggagaatcgcttgaacccaggaggcggagcttgcggtgagccgagattgtgccatcgcactccagcttgggcaacaagagcgaaactctgtctcaaaaaaaaaaaaaaaaaaaaagtagttcctgaagttcagatttgcactttctagtgaaggatgcaaaccaatggagttggctgcctgagaaagccagagagctcccttcaccagagttatttgcaagaggcagagccaccatttgtgtgaaacgccatggatgaattttgtgctaaagggaagatcagagcagtgactgctggagtacctcacatttttgaaactatagctttagtactcagcctgataattgataaaggtttgtaaaccatagttttctttatatttcactgaagagaaataacaaactatgggttgttggacatgaatagggagttaaatgtgataatggtgtttggtacattgggccctgcctgctttaaggcttaaatttttcattcttttcctgtcatttttatatttcttaactctcattaagagggtgaaaacatcagcaaacaactatttttgtatcatttgatataaaaattttttcttatatcaagcatttcttataattatctctcctaccactccaagttttagtacttttttgtggcatcaatctggcctgtattttagcaatttggcataaaggattttttttttcctgattttttttttttttttttttttgagacagagtctcgctctgtcaccaggctggagtgcagtgtgcaatctcggctcactgcaacctccacctcccgggttca

SEQ ID NO: 73594 - DNA, 1071 bp, Homo sapiens
ggcttctttcttttacatgcagactgaaacttaaagatttaaacagcagtgttagaatgcaaaaccgaaagatactactgtcttagaagtattagggcaaagtcacaaagctttcccaagcttcagtattctttatataaagtggaaataatagttctttttttttttttaagactactttgcaggatgtctaaaatgagaattatgttcatgccaaatttaaaaatcattgctaaataataggatttgaccaaattatcttaccatctttgtttccattaggtaaaattgcagtaattggatctataaagatttaaagaatagaactcagtcttcttatttacttttctatgttattaataaggtcaaaggaaagcaatattttgagaaagaagattcaaagataaagtaaggaagagaaaaaataggattaatttccaaagtaatgcaaattattgtgctctgataattcagttggaatttaaactccctacttagtgaaatagatgctttctttttcataagcaaaactgagagctaattttttctctctctaatagggcacatacttcatagctgtgttaattcaaaaacatttaaataacagggtggcagtactcagtaagaaaccagtgtggctttggctgtattttgttgcttctaagtccttttcaaatattatcattaactatactctttatgctatttaatctgcttatcctaatttccctatgctactccttgaactggtagatatacccactcagtaagaaagcaaataaaaataaaatagtttgagtcttactctggtgatctctctatcttgcatgaagctttctttatatgtaaattgtattcctcccctattccaaaccattatttttttctgtctctagatgtaaggttcttaacagtgctggagatttcatcagatggggacagacagctgatgaacattctttggctcttcaaccccttttctttattctaccaaaacacttttccatgataaatacctagaaacatttagaagcccaaatattcaagaaaattgtcattataatgcttgct

SEQ ID NO: 73595 - DNA, 1095 bp, Homo sapiens
ctaaagatataacaaaacaacgaaaatgtagagtacaaaacaggtgtaaatcaatatctgttggatgagtgtggaacccacacatgaaatgataataaataatatcagactgtgagagtgagaggaaaatacagctgccttgcaagttcttttaaaatccattgaagttgcatgttctcgtaaataatgctgctcaagcatttgcttattcaattaatgtaggtgtgtggagttttcagaagtttctgcacatgtgcacagatactaatgcgaaagctggccagaaagccttgtatttgaacatttgcagagaacatggtcatgaataatatattgcgatgctaaaaatctcaggatattggagacaccctgagaggagtgacagtcatccacatatatgtgagaagggtgtagacatggcaaagctaaaaatataaagttactattcctttttagaaaagtgtgcttatgttgagttaataatgaatgaaattctttttcagtccttgaagattgaaaactgtgagatcccattttaactactatccacataaactggaaatctaatggaaagtacctatggttagaagtacacattgacaaatcaaattaaataaatattttcacataaacagttcgtattataaaatacctattctaatttcaaaatacggactgtaaataatcttttaatataagatacctaatattggccgggcgtggtggctcatacctgtaatctcagcactttgggaggccaaggcgggcagatcacttgaggtcaggagtttgagacctgcctggccaacatggtgaaaccctgtctctactaaaaatagaaaaattcatcaggcatggtggtacatgcctgtaatcccagctacttgggaggctgaggcactagaatcacttgaacccaggagtcggaggttgcagtaagctgagatcgtgccactgcactccagcctgggcaacagggcaagaccttgactaaaaaaaaaaaaatacttaatattttatgagacagttttaagtatatgtatatattagaggttttacaaatcctaacagtgagtgatattttaaacttaaaat

SEQ ID NO: 73596 - DNA, 1013 bp, Homo sapiens
ttgttttcctgaactgcaaaactactatataccaattagaagcaaagcggaggggtgaagtaaagatgactattacgtcttccggtatctctgcaggaaagagagtatgatcttcttggtcttctgtgatggcccctatttaatgtaagctcacccagtagaattctgaacctgaggagaaaatacatacactagatatactaggtacagttactgtgaagaaagctatttcacacatataccacatgctgggtttgttggtgaagggaatgaagtggtaaatgaggatccacaaagacttaacataaaaccacccaccattattaatgggtgcaggggtaggacagacttgtgatgaggaaagggcaggaaagcaggagagaagggacaacattgatacagttatcaatcacttgaataatatattgtaacaataagactgtacactagaattcttgcctttttttgtaggaagtttatgtgtacatgcatacaaaatataaaacaaatattgcaatgactaaccttgtagttaagaggagtggagtgcttaatcaattattcagcaagtatattttgaacatgtactgtgtttcaggtgctacaggcactggggatatggggatgaacaaatccagctagataactgactccagataaatatttacagtactctggcatgtagcttcaatgttagcatttttaggtggaaatgttaaaaactatattgtcacatatgaatgatttttttttacatgtggaacgttatatggactagtgcctctaacatgtgtttatatatgtatgtttgtgaatacatgttctggctttatttttttctcaaagatcatatatctagtaatctgtattggtgcttcttgtttttttttgactatagaaatattttaattcatatgctttaattacattaggtaataatactacagtccattttacaagttaaatgtatgagaatgtatgaaatagaaatgataggaaaaaaactaaatatg

SEQ ID NO: 73597 - DNA, 1091 bp, Homo sapiens
catgtttaccacagatatggaacatagatattaaattctggctggaataaatgtttggtttaattggcttctgcctccagatggttctgattttatcaagtccattttcttatgaatatttatcacagtacttcaaggaaccaatgcaatgatataaacgttgaaaacaagagacctttattttatatatatatgttttcctaaattgagaaacatacatatcctgaaaatttagttttctttcatcatcgaagaaaatgtcataattcggctattacagccaagacagactatgtttttttaactcaattatttctaaaacactaacttacatatggataaatgtttatataggaaggtcatccccaaatttcaaatttttatttaagccaaaaatttgtattttaaaaaataatgcatataatgcctcacctgcacattcttgtacaaacatattttaggagataaatctttattgccagaaaacatactattttaattgcaattagacttctgtgataaccatcaagctggtgcctaaatctaaaaggatctttccaactgttctgtggatgcttaggcttaggcaactatcaccaagtaattactataatttaaatgaactacgaaattgaaacctgctaaaatatgtagacctcaggaatcaaatgtgtattaacacttgttaattaaatattattggttaaaattaatttagaaattattattgggttgatatgaccaaccaaaaaactatatgtaaatcacttcttaatactatgaaaatatgaacagtttggtaaactaatttagaaccaagcaacaggatatattaagcttaggaagatacagacatttaaataaaggttggtatagaagtcacatgatagttgctctgtctgtagtaaccaatttctaaataaaatcaaaaatgtggcattctcaccacttttcacagtgacaattaacttggtgtttttacgtagtttcaattccttgcttattctgatttttataagtgactatgcaatgtattaccacataaaataaaacagtagtggttattaaaatcagtacttaaattttcccat

SEQ ID NO: 73598 - DNA, 1052 bp, Homo sapiens
cttcagtgttcaattattttgtgtttatttcatatggcatgaaaggtcttttaatttgatttagataagacctttcaaaaagagaaaaagccaacataatgcaaatatcattttttaactgctacctaacttgacaaaaaagatctatttatgtaagtatttttctttatcaattaaagtttattaatttgactttcattgcttacactctaatggccattttcctaaaaatactatttcccaaaatgtttgttttctacagtatcagttactttggatcttatctttggcaaaaataaaaataaaatattcacaaacaacatggaggttgtttgaaactttatcatcttgattaatggtttaaggatggtgagttgttgagtttgcacttaaaagatgaatggtgatatacagatgcaactggattattccatttgacaaaattatatatgaaaaagttatctgaaatctttagtgaatattctccgaagttattttccaacagcatagcacaagagagagaatagaggcctggtggcaggtgaacctgggtccacattgcagttgccacatctacgatttgtataaatatagaccaataaaaactacccaaatcagctgggcgcagtggctcactgtaatcccagcactttgggagaccgaggcaagtggattttgaggtcaagagatggagaccatcgttgctaacatggtgaaaccccatttctactaaaaatacaaaaaatagctgggcgtggtgtcaagcgcccacagtcccagctactcaggaggctgaggcaggagaatcacttgaaccagggaggtggaggttgcagtgagccgagatcgcaccactgcactccaggctgggtgacacagcgagattctgcctcaaaaaaaaaaaaaaaaaaaaacccaaatcacaatattgtttgatgtactatgtgaaatcacataacagtaacattaatacaacttctggcacataagaagtgctttatttgcatttcccttaccatgtgttaccatactcccagtttcacttttggtaa

SEQ ID NO: 73599 - DNA, 1035 bp, Homo sapiens
tttctcttcaagaaaagtacaaagggaacatgtactaagtagttataggttaaatgtgctatcctcaacaaaatgtctagtatcaaacctctcaaatatttcctagatatataaatatatgaaaacacatacaaacggtgttcgcagccgccaccgcgctgccgtcgctctccaacgccagcgccgcctctcgctcgccgagctccagccgaagagaaggggggtaagtaaggaggtctctgtaccacggctcgtacaaagcagactgcccgcaaatcgaccggtggtaaagcacccaggaagtaactggctacaaaagccgctcgcaagagtgcgccctctactggaggggtgaagaaacctcatcgtaacaggcctggtactgtggcgctccgtgaagttagacgttatcagaagtccactgaacttctgattcgcagacttcccttccagagtctggtgcgagaaattgctcagtactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaatttttttttttctcttcttcctgttattggtagttctgaacgttagatattttttttccatggggtcaaaaggtacctaagtctatgattgcgagtggaaaaataggggacagaaatcaggtattggcagtttttccgttttcatttgtgtgtgaatttttaatataaatgtggagacgtaaagcattaatgcaagttaaaatgtttcagtgaacaagtttcagcggttcaactttataataatcataaataaacctgttaaatttttctggacaatgccagcatttggatttttttaaaacaagtaaacttcttattgacggcaactaaatggtg

SEQ ID NO: 73600 - DNA, 1327 bp, Homo sapiens
actcaagtctggacaagagaacaacactccatctcaacaaaaaaaaaattgtgccttgtatgttgagaagtttattataataaatgctctgtatttcattgggatactcacaagtaaggagaacacaaaaatgcacaagtataaaacagccgcaaattgttggattgtcttcactaataaattaaacataacaatctactgtatgccttacccaaagaataaatctcatatttactatttaaacacttgatgtttatacaatgtttgtattttttttatagtttaatgtattttaatagcaaacttacaggaacagcacagaagacagacaacattaaaaacatgtacttgcatgtagtacaactcagaaaagtatagtgaatggatggaatctactgtatgataaaaatgctacaaacaccatttagttgccgtcaataagaagtttacttgttttaaaaaaatccaaatgctggcattgtccagaaaaatttaacaggtttatttatgattattataaagttgaaccgctgaaacttgttcactgaaacattttaacttgcattaatgctttacgtctccacatttatattaaaaattcacacacaaatgaaaacggaaaaactgccaatacctgatttctgtcccctatttttccactcgcaatcatagacttaggtaccttttgaccccatggaaaaaaaatatctaacgttcagaactaccaataacaggaagaagagaaaaaaaaaaattttttttttgagaatgaaatgtttcccatcatagtggattcttaagcacgttctccacgtatgcggcgtgctagctggatgtcttttggcataattgttacacgtttggcatggatagcacacaggttggtgtcttcaaaaaggccaaccagataggcctcacttgcctcctgcaaagcaccgatagctgcgctctggaagcgcagatctgttttaaagtactgagcaatttctcgcaccagactctggaagggaagtctgcgaatcagaagttcagtggacttctgataacgtctaacttcacggagcgccacagtaccaggcctgttacgatgaggtttcttcacccctccagtagagggcgcactcttgcgagcggcttttgtagccagttacttcctgggtgctttaccaccggtcgatttgcgggcagtctgctttgtacgagccgtggtacagagacctccttacttaccccccttctcttcggctggagctcggcgagcgagaggcggcgctggcgttggagagcgacggcagcgcggtggcggctgcgaacaccgtttgtatgt

SEQ ID NO: 73601 - DNA, 1017 bp, Homo sapiens
agtacttaaattaaactgaacatttgggagcaatcccagtatgtagcatggtggtagaaaattaatcatgattttgtgatagattattaagctgttcatttgaagggggtctttcatagaatcagaagattaactctctggtgggtatatagtagtacagaaaaaagcccaccctatatatcacaagttatgttaggactcattttagaggggaatgatttaatgaaagacaacatgcatttatataaaaatgtgtatgagatcaaaacatcactagcagattttcagtttctcggaccttactatttttttttaacttgtatttattagtttctatgtttatttttatataatactatttaacttaaaccatgtggttactaaatattttaaatggggcattttaacatgagaaaaactaacaattccatattcgaaatatttaggaataaaaaaattactccagttagattaagagttactgaggaaatagtagccacaattttgaaggaaaactctaaatgtgatgacattttaaaatagcacatgcctcttcatttgccctagaagcacttcatgtggtggcgaaaaggctttaactttattcagtcattttatcgtttgtacttaagcttcttcaacactatttgatctatatacatttctgggaccataatcaggcatcctaccatttaactagattttattccctaacatattgcctttgctttgtcagtttgttcctctggaaccatgctgacatctcaagataagtcctatcagtcttgggctattgactgaatttgattgtgaagaagccatcacttagagtagagagaaacagggtgaggtgttattgctaagaatatactttatgttatggttctaaaatccaaaagtaaataagatgggattggcagctcttccttttttattaggcataagatagattttgagagctctttttgtcttgtcttcttttcccttcaggagtcacaaacctggtagttttgctct

SEQ ID NO: 73602 - DNA, 2246 bp, Homo sapiens
tttgctcttgttctctctgccttgtagcatgaaaggtctttttcatttttaatccctattactagaataaaacacagaaacagacaaactaatgaagtctgtggcaacaggtctgccataggttaatgtttcaagtagcagtatgttttttgtgctcttaactattattttaggtgatataactattttccactgttagcctgtggactgttaactgtacattcaaaaggtagtcctgatgtatagcaaaacatgaaaagcactgcattactgtgataaaagtggttctgttttatggggaatagttgtttgttaatgacagtgcagtattgacaaatttatcttcatgatgcctctttttccatggttttattgtaatgaatcttactttcttgttctaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaacatgcaaaattcctatttacttttattacataaaagtaattttagtgcttacctaataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatattaggaatctcaagtatggctttttttaaaaaacctttttaacatcttgatgtcaaggattataagtatggcttttcagaattgttttgtttgtcattattcttgcctttaaaattttaactcatcaaagtgaagattagaaataaattttagaaaatgtagaatagtattgattctgttcctgtaatagaatctcagtggagtttttttgcaaaactaatatggatttcatctgattttattatttcttaaattttagattttattgagtaccatttatatgattgtacaagcattcactctttactagcattttttgtttttcagacaagctgaagtggttttattaagatttggtaatatttaaatagcaaccttctctgcctttttttttttttaatatagaattttgaccattttgactttttaaatgcctggcatctttaccaaccaagtaaactggaagatctgttactggtagaacaggttgaggagacagtaggaatttgtaaaaagtcatttgatttataatcaacactacaaatactatgtgttatttataaaatcataaagaacacttttgtcagactccaaaatttgtatatacttccaggccataagagttgatagtattatttatgactttgtagattaagttatttatgtatgaaacaaagcaggaaaatatattgagaagggatcgtgtttacagaggacttctttaa

SEQ ID NO: 73603 - DNA, 1094 bp, Homo sapiens
agcagttctacttctagaaatttatcctaatgaaataaaatttagtatgtacagattcttaccaatattattttaatgagagaaacatgagagcagcctaacttttaaagtaacagagtagttaagtatagtgtttccataaaatggaataatatgcgactagttaaactgcattttaaaagaatactaaaaaataagcaagtgttcagaattatcctaagtatggtggatacatgttagatattaaacaagtgctagaatatatagcaagatgtaaaaggcagttatgtgaagggaaggtgtaagtttatatttatatttaagtttctaaaactaagtaaaggcaagaaagtattacatgcagatttccaaaacctgggatgctatgctaattccttggtattgtgcagtgatatataaattaatgaaagtactatatgcatatttttaaatgctgtaagccttaagttttttttttttttgtatcttttttcagttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggttggagattcctattagttcattctaaataaagatgcttttatttagaaaaatgattaatgatgaagttatgggaaacatcctggttaaacaaggttaaactaacatgcaacaccactagaagaccaggagctcaatagtgtatgttcatatcataaaaattactactactaggccgggcgcagtggctcacacctgtaatcccagcactttgggaggctgagttgggcggatcatgaggtcaggagatcgaaaccatcctggctaacacagtaaagccccattctctactaaaaatacaaaaaaattagccaggcgtggtggtgggcacctgtagtcccagctacttgggaggctgaggcaggagaatggcgtgaacccaggaggcgcggagcttgcagtgagccaagttggcgacactgcactccagactgggtgacagagtgagactc

SEQ ID NO: 73604 - DNA, 1018 bp, Homo sapiens
caaagtgttgggattacaggcgtgagccactgcgcccggctcaaattgaacttctagggatgaaagtgaatatctgatatggaagaaatgggagggacctatctcatgaacatgataaatactataagaattttcagaaagacttagacttaaattaatgggtgactaaatattgataacttgtccattcttcccaaaataataatgtagtttttatacagttaatcagaatccagttggaatttgtttttagaattgatgaaaaatgttcagttcatccgaagaataaaatggcttatataaatgaaagatgacaacggaatgtttaccctactacatgcaatataaagttagaaattaaatggttgcccttacaaaagatagacatgtaacaaatttgtaagtatatgggaatttactatgaataaaggtggcatctcaactgggtggggaaaacttaggtcattcaataaattttactggggcaactggctcatttctgggaggaaaagttagatcctattttccacccaaactctagggagataaatacttatggggggttttgggaaataaacttcaaagtgctggaagagaatactggtggatataatcttttcatggggaataattttctaagcataatgccaaggggaaatgatataggaaacaatagataatatgttgacagttgacttaaaatattctaaatactctctgggaagcaatcttaaaacaaaattcagtggaaccggtgtacttacaacctgtaatggaagggattctgaaaatcactttggaaaccaagtttctctgtttgtgcttctcatgttaaagacaatgagttctatcaactacaataaaatgcagtactatacaaatgaagtttaaaaaatataaggtttcatttttattattagattcaacagacatgattacgctgtcaaattgttataaaagtttctaaacacttttaaagccttaaatatgtacattacctttttttgactattgtatg

SEQ ID NO: 73605 - DNA, 1130 bp, Homo sapiens
gatggagtaacagagattagatttatgcttctacttgaaacaaccaagaaaactcaggtaaagcatacagaacaatggttttcaagacactggacatcaggcatcagagtacagtgatcccttagagacaggaaacaagcaaagtgatttcttgggttgccccagctcactgccttcagagagttccaggcctcagtatagcagggagaacccagtggacacactgaagtgagtaggaggagtttagaagacctgggagaccaaggcaggtagagtttgaataacagtacctgagaggggagaactgcacagaaagaatgctggagatctgtagaagtgtcccccttaagtattcagagcattgattagcagatgtgtgaggaaagtactcagaaagctgggagggaaccatctagaaggattagagtgaaccgtgcaccgtgcttacacagggctgaggatagtgcctgtaactaccagccagaatggaaatctttgtaattcataagacattggatacagtactcagaattcttacctcaatcataaggggaataattagccctatcctaaacagggctctggtcctgcctaacagatctaagaagtaatatccgaaaggatcaaaccatttccagataacggtatctcattataaagctcaagaattagaaatacaaaactatccggtacctaagtaaaattctaagtacatggcatccaatcaaagattaccagatatgcaaggcagaacagtatgacccatgatgtgaaaaattcagtcaattgtaacgaacacccccccgatcacacagatgttagaattagcagacaagggcatcagaactatactccatatctccaaaaagtttagtagaggcatgaaagacatttttttttttaagactcaaattgaactgctatttttgtttgtttgttttttcttttgagacagagttttgctcttgttgcccaggctggagtgcaatggcgcaatctcggctcaccgcaacctttacttcccgggttcaagcgattctcctgcctcagtcttccaagtagctgggattacaggcatgcgccaccttgcctggctaattttgtatttttagtagagacggggtttctcc

SEQ ID NO: 73606 - DNA, 1054 bp, Homo sapiens
attacaggcgatttgtgaaaataggaagtaaaaataggtgtccatttgaaaagaaggcttaaagaagaaaccacaaatgagatggactaagaaaacagcattgagttatatgaagggaggataaaaggcagaggagaaaagcaagaacaaaggcatgaagtcaggaataagcatagcctttatacgtgggggggtctaccatgaagagaacaaactggaaactggagagagaagggagagaatcaactgaaaaactgttagaagcatcatagaattcatcaaggtgactggtgattaaaaagtttaatatgtagtgttccagtatactgatggtaaccacttagaatgtacaagggctaagtagaatccatttgtgaagacagtcaaaaataaagtgaagattcaatatggtagattgagcacttgctgaaactctaagcatataaaaaaataggaaatagtaagaaaatataattatcaggatagacctgttcaaaagcaagaagggaagtctccattgattaggaagagagaggtttccccccaaaagaaaggagcagatgggaaccacagcaggggattgtcgggaatagaatctgacaaagcatgctaccctgcctcactgaagttgggagtcagaaatgtgccatttgtcacagccagagattgagaagcaccatccatgtgttttttggatctggaccaaaaatactacaaggcctgatctagaggcctaaagctagggtacggcttcctatcttagaatgggccaccagtccaggacacctaaaataaatctatggaagatgagttttcagccaagaatgacaaagcacctaaggtagatgaaaaacatgagcaactaacatggaaaaggaaaaagagggaaagtggtagtaacagggaactcttttttattgagccctaccgtatgccaagcaccattccaaaggactgcaaggcagtgtcagcaaaacaaatggataccattctaagtgtatcctttaattctcacactaatcctttaaaacaggtactcttattatcctcactt

SEQ ID NO: 73607 - DNA, 1066 bp, Homo sapiens
ggcaggcaagtcaggagctgggaaaagaaacctctccattcagacaggaggaaaggccagggaccacaaagagcgtacctaccggtgcgtacaaaacgaagcccccagtaccgactccagggagctccgggggccaggccagcttccacgacaggcatagactctttaactccccgcttccgcgctgtcttgggccaaccagggcacggggcttgtgagcgactagccaatcgtgtcgtcccgccatccgcgaaccagccaatcgcacggaggccgcgtaggaaattcgaatggcaactcctcgctccacgttccgcgcagaggaacgtggctccaaattcaaatcaacgcagcctcacgccggcggcgagcgcgaggggcggagcctgcccggcgtgggccgagacgcgctgtgtgattgcctcggagagaggaaggcgctccagttccgggtcaggcccttctcccgcctccctcggccttagccatggcgagtagcagcggtgctggggcggcggcggcggccgcggcggcgaatctgaatgcggtgcgggagaccatggacggtgagtttccgttgcgctccctttaccttgcgtgccttcccagagccaaggcccccaggcgggaatgagcctggggaggacttcaggtccccttagtgccccaaacggcatcttccaagatctttggtagggacctgccagggccgcagggctgatggccctatcccttgagagttgtctccgccgctgcgtagtttgtcgcgcgcgctaggcgttgcggcccctagtcagccggttgcgcaccgcgtccctctcgcgcgaatgccgcgccccctctatcccgcatcccaggtccgccctacccgcccgatctcctgcggtgacagcgtcacgcccaccccacccagtacacccgttccctcctgcgtgccgcgtcccacccgattcccgcccggggcgcttcgggggtccccaaggttgggatcccggcggggacaggggccaggtgtttggtcaccgctatgcctcctgttcttcgcacttaagtaggcacctttaat

SEQ ID NO: 73608 - DNA, 1075 bp, Homo sapiens
acatgagatgatgaatttaaaaaaaattgtagctataagtcctttagttgagaagagatctgggcctgttgtaacctttagtttcctcagaggcagatctgaattcattcatatttgattgctgcgtataagccacttcacttctctgagcttaatactttcgcaaaataatatcactagtaagttactgctatagctttcaaggttgtttcgaggatcagttgagaacatttatatgtgatactttttttgtaagctgtatcatagccccaagagtgtgaggttttgagttgttttttgtgacacatttgtcgagtacattttaatagttaaaattaatatctatgggactttgtaattttaacatgcatactcttgatttctttttagttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccagtaagttattcctgactagtgtttacaactaattttaaatgtaagtaattacaaataattttaaatgtaaacatctgtctttacaaggtaaggaggaaatacattatggagcatatatagctgcaatatacttttttaaattgtagtgttcattataatctagtggttaggttaataagttagctagaagatttttttttttttaagttcaagaacatacgttagcttcctgcagttgtgggtgtagctacattctgtggttgacgatatagctactaatacattagagaagaagctgcatcatctaatattctgttctcacttatttggcaaacattatttgagtgttgctatgtgtcagatacagtgctaagcagggattacactgtgaacaagttaggatcattaggcacaaatccttaaggaggttatactccgatgtatgggtcacaaactttctgttaggggccagacagtaaatatttaagctttacaggtcatttggtctctgtcacaa

SEQ ID NO: 73609 - DNA, 1912 bp, Homo sapiens
attttgaaatttgcacttttctacatggttgtggcttctgccattaacttgtttcagtttgtctttttgatgatttggggtaaagcaaaatgctgtttcattgttatctatgtttggggaaacctaaaaccccctcaaagagttacgtatgcactgaatggaagggtatccattagcaacagagcggttttttagacatcatccaactgtaacaattcacttggaatctgaattacattttctagaattctacatatcacccagtgcagtcttatttgttgatgtgttgtttaggtttcaaggcactaatgtactgcagatttagttttttattacaaagtgtaaggtcctattattcttttgtagttttagggactcttgtttatatgttttatagtctgattttttaatatttgaaaaaaatcaaatacatggtatgaccagattttaatttgctgtcctaaggtagacatgttgttagtccaaaacaaaggataatccttttccctttgacttaagaattcagtcacacaacgttgcacacatattgagatattctggtaaatacttactggcttttctcctccatcttctctttgcttggtaacatgatgaccattcaatcataaaattaatgtccacccagagtgttaataggaagggaatagaatgaggatgaagcatgaaaggattttaacttaaatttaaataatacctttgaggccaggtgtggtggctcacacctgtaatcccagcattttgggaggctgaggcgggcagatcacttgaggtcatgagttcaagaccaggctggccaacatagtgaaaccccatctctactaaacatacaaaaacattagccgggcatggtggtgcacacctgtaatcccagctactcgggaggccgagacaggagaatcgcttgaacccaggaggcaaaggttgcagtgagctgagatcatgccattgcactctagcctgggggacagagcaagactccatctcaaaaaaataaaataaataaataagtaaataaataatacctttgaaagagaaggtgagatgaatatctaaaagcaaatgagtcacagtgactaattttttgtttcacacgaacttaattatgcttaattattttgtctcatttcttcaatatattgaatgatggacaattattatattgatcagtcaagagatacttattgagtactgtgagggactgtaagaaacactgaagaagtacaagatactaagagtcaagagtcaaaaatataattagaccaaagttgtaacacagtgcttctgttcttactactaaatgatatattgtctgcaaaggtttataaagataatcttggtgtctcttagtacatagatttatcatatagaagaatggaaaagagtgggaaaatattataatttaatttaataatataattcaatgaatggttatggcttctaccaaggatagtcaatatattcttcacagagcatctcgtttcatccttagaaacaagcagtgtctttcagtatctcttcttacatattagccctctacttcaattcttcccatccttttcatgccaccatccacacagaaaattgtaactgaaaagcataccagtgtaagcaggtgagtcttggccatgtaggtgaccagtcctgaggtcccctctcctttgccaccctgcaaaggctcaacattcaggccacacctatacctatatgcatcatactggtgttcagtggtatgctggtcaggatgctctcccctgtatgacttcttagaatcttgtttgatctgactctagagtatttggccacagtgatttttacagtttccagcaatcacctgagtatttcatgttcttgaagtccctctgatgaagtagcaaaaggtttctgaatgcag

SEQ ID NO: 73610 - DNA, 1489 bp, Homo sapiens
ttttatttcagagttaatatttttgactgtttagaactgtgaactatcctcatctattttacagtaaaagttgattctaaaattattgccatgataaacttgttataattgaagagaaaaactttggacaatttttagatgtatgttgaattaaatacttcttaatttgtattaagggacaaagtttatcaaatttatattgttaaaagcaatttaatatcaatgtaagtcttttgaaataaagtatcattgcattcaaactttgaatggaaaagagggaggtaagcctaacagctaactgctgaatttcagaatactgcctaaatgttactaaatgttacaagataccactagtattaattataaagtgagcttaacatttgccagttttcaatgaagggagattatttatttgaaaggttattttttaaaatgttcaataagcttaagtaatagcatggttatttttcttctttatctttgtatagaatagataaagatgtggaagacaaaagacaaaaagccattgaagaggtaacttaaactgttactgatcattaaatcagttaaggatcaattctgcatgtacatcacttcttttaggaagactttcttcaattccttcactgtcctatctcccctccaagcccttcacagtcccatctatataaagcacccttctgtactgtcctaagaccaataatttccagctatcccagtaccttgcatagcacttgcatactgttgtaatgatcagtttagtgtttctgtcccctagacgcaatcttttttggccaatactgtacttcatcctttcattctcaggacctagcacaatttgtcttccttgtgccttcaaaatgttgattagcacaaactttgtttcaagttggagtttatgtagaggaagtcgaatattctcaggccttcagagtctagattggcattgggaatggctttgtctttttttgttaatactttggatttttaagatattcatgaaataaaatctcttactgttaaacaggaaaggtatatcataatgtaggctttctaaaaaataaaaataattaagttttttgcttttttatgtctgttgaattgcctttcttagcatctaaataaggttattattattattattttttgttttttgagacggcgtttcgttcttgttgcccaggctggagtgcaatggcatgatctcagcccactgcagtctccgcctcccaggttcaagtgattctcctgcctcagtctcccgagtagctgggattacaggcatgcgccaccacacgcagctaattttgtatttttagtagagacgggatttctccatcttggtcaagctggtctcgaactcccgacctcagatgatccgcctaccttggcctcccaaagtgctgggattacaggcgtgagccactgcgcctggcccagcatctaagtaagggttacttaccttgttctttcctcagaaagtctttat

SEQ ID NO: 73611 - DNA, 2145 bp, Homo sapiens
ctcagactctcaaaatttccaacattttgaaaaaatactttctttaagaatccttaattttaaagagaaacccagcaggtaaacttaagaaaatttgtttcttttcaatatatatttttgaaaatagaagaaacatatacatatagtaaaaacaaaaagaaaaaatataaaataaaaagcctcctgtttccccatcccacttcatgaaggtaatgactataacatttcttatgtgtactttcagattaattttacttatttaatagcatatgtccttaaaatattttcgacaaataggattatcattctcatactattatcgttctcatactgcatcctcctttttttgcttcatgatttttcttagaaatttttgataaccagcatatacagatttttacattctcttagcaacagcatagttacctagcccctgttgacagatgtttaaattgtgtttattatttttctgtcacaaataatgctgcagtgatttgtatatatatctttatattcttgaaatggacctagtaagtcagaggctttgtgaattttcagttttggtagattttaccatattgccctcctaaaaggttataccagtttatactcctgattacagtgtgacactgcttgattttccatatctccaatattgattattatcagaattcttaatttgttctactcctattactttaaaaatgactttttttttttgtatttctttacttttgagtgaacttatacatcactttgtaagtttataggtcctttaattttttttctggtaattgtctatatctgccccagtccacctttaaaaaaaaaaaaaaaaagaatcttttcctcttagattcatgggtaatttagttaagaaaattagctctttgtcatatgtatagcaaaatatgaagaaaatatgtttggttacttgcaaaacctagggaagggaaaacactgtggtagaaatgaaagaggaaagaaaagtatacaaatgctctatctcatttgaatatactggccagtagtgtgctggtgaatgtttaacaacttgctctctggtcgtggaaggagtacgatttatagcgattcctgctatccatagtgtaagtactccaaccatggccagtttcaagctactgatgtgacatcactgaatgggaaaggaagaatagtggcacaccattatatgtaggaattccaccatacagatacaaaatacattattaacctcaagagcatagacattgataaatatataaaataattagcaagtggtgagttttggatatttgttacctttatttttaatatatttaattgtaagtttacataattttatttttaatattggttttaacaactggtgcacagaattcttgaaaatttaataatcagatcttgagagccagaacaaacaagccagcttcagtgccgtcattcatactggcctacttgcatgtctctgtcttaatatattccttcccttttcatccttttttttgtaaccccatcaaaaaaacctgggaaagaaatttaaaatactttgtctatgattaatcctcttagtttagtttgcaagtttcaaatttaactggttgatttgaagtattaagattcctctttatatatactttaaatttcttccatttttcctttggtcatttgtattaaaatttttgcatacagttataaagttagtatatgacatgtttaataattacttggaaaaacacaggtaccgtctcacattttgggtggaatttatgcctaattgtatgactttaattttcctagtttttcactaaagatgtcatcgtaccctctccttggactgatcatgaagggaaacagctttcacaatgtcattccagtaaatgtgagtgtactaaaaatgatatgaataaaaatcaaaaaagtcggtgaatataaagcaacatatcatgaagtgccagtatatctgctttgtaagaagcttgctttaaaattctggataacatagaatttaactccttttagggttagaattaaaaatttgactaaaatttattgaattgttttttagctgttatactctgaatttaactttttcttcatgactattgtgaatgtcagttataatgatggttatagaggatccat

SEQ ID NO: 73612 - DNA, 1050 bp, Homo sapiens
attggccccattttataggtaagaaaacctagttttagaaagatgagagcatttgtccagggttacagagatgataaaagtgggaaaacctgaattcaaaattctcaaatcagatgctgtattcttagccattatgaattagtggtagcacgcaatagtagatggaaatctggattgtaaaacctcctacttttataaaccagagaggtgaccttgatcaaattattctctttgtacctcagtcttttatttgtgaaataaaaggattgaactagagttgtccatttacatccccccagctctaaaattgtgtgtccaaggtggcattctcatagatactagtttttcacccccagattctttactgttggattttttcaacagatgaatcaaccttcttaagtgattttttaaataacatttttgtattccaagtatcctgttttagttcaagtgatgcaggatcaagaagatgcttaaaaacactttagactctttgaaatctaatcaagcccacgataacagtgcagtggttaataggataggctccagagctgtgctgtttactgtgttgttgggagacaattctccataggcctcacatttctgcacacctttcatgaagtggcatggacaagttctgttccaaactatcttttctagggtgtttgtcttggaaggtagagatagtgtgtcccaccagagcagagggtaagtttgttttgctgtccagtatagtaaagatgatgtctccctctggagcagatttgtttgcagtctctcttaaaagaatgggatttcctaagcttggggttccttagctatggtgaaaacccattgtgtgtccaccagccacctgggtattttaatttagaatcttttaagatagagagcactcctcccatgattaggagagacacaagatggaaataaaaattttattacttacaagtcctaggggtacacagcatacctgaacaccacacagggaggtcaggaagagagagaaagggacccatgggccaacgcctttattgggtccagggcatt

SEQ ID NO: 73613 - DNA, 1033 bp, Homo sapiens
tccatcaacagatgaatggactttttaaaatgtgatatatatatatatacacacacacacacacacacacacacacacacacacacacacacaaaatggaatactattcagccttaaaaaagaggaaattttgtcatttgtgacaacatatatgaatctagaggacattatgctaagtgaaaaaagccagccacagaaagacaaatactgaatgatttcacttatatgtagaatctaaaaaagtcagactcttagaagtagagaatagagtggtggttaccagacggtagggaggaggggtggtgggggagatgttggtcaaagggtacaaagtttcagttagacaggaggaataagttctggtgatctgttgcacagccaggtaactatagctgataatgaggtatcatatagttcaaaattgctgaaagtggattttaaatgttcccaccacaaagaaaagtatttgaggcaatggatatgttaattagcttgatttgctcttgtcatagtgtatacatatattgaaacatcacattgtaccccataaatgtatacaattatttaaagaaaaatgtaaaaaaaatattgcttggtgactccttatttgctgtggtaatcctttagttttatccttgtattccctcaaaggtaaaaaaataatagaaacataccaaaatatatacttatatatgcagattttttttaatgttgcaaaataagtttccactttcttaattttttactttggaaaaagtaatgctaaagcaaatgaagagtataaaacataggatttttcacttaaaatgtcttacaggcactaacataaatagtgactctccagttggaaaaaagctgaccattcattctgagaaaagcgatggtgagtatgaacacaatttgaaaagaaggatgttccatattaagctacattgaattctaaacccagttcaggtagtaacactttactctggaattgaaattgtttcctttttttttttttaatttatttttgtttttttgagacagggtc

SEQ ID NO: 73614 - DNA, 1069 bp, Homo sapiens
aaagcattcttttgaaaattggttaatgtgagaaatctccccccagatataggctggcttccttttcaagtgccagtaccagagccaggagttaacttttactattaacacgtttacaccagttgcggagagtgtgggaaaccacttctagaaaggtggcagggtatgtgatagaatgcagaaatgaataattccatttggctggaacatcacggggagatgattgactgggcagcacatgctgaattgtatagtgtatactttcattgatttatcccatgtttgaatttgtttatttatttgcttgtttccagctgcttgtcagacattgctgtctcttcctgtggattttaatttagaaaatatattaggtaaatactgtatttgtttaaacttttaataacttgaaccaaaggttttgtttggctggctttttgtaaatggtaacatgggaaatatgtggcagtgcctctttctaaagaagtggggaaactgccctgaaatttctctttttcttgaacatggtttgaactagccttattatcatagtgaactttattactatagacagaaactataaacattttattgatattatactaacaatgtagcacttaaaaactaaggaataatttaagatgtaaaacatcaaatatgcaattaaactttgccctctttttgggaaaaaattcaaacatagtgcatgctggcttcttaaaagttgagtaacagaagtataattgccctttaaaatgactagctttgccttttctcctattattaaatataggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggtgagaagtatactaaaaagcagttggctaatatgctgtcaagcttgaaccc

SEQ ID NO: 73615 - DNA, 1029 bp, Homo sapiens
gacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcaggtaaggtatttaatattctatagccccttcctcactgccttggtgttctttatcctttctaagattatagtataagaaagataatggattaaacatgaggactacagtattatataatattttttaaaaatattaataccaagtgatatgagaagagtaaatttattttaattatgacagataaggcatattttatattcacattaactgatatttgtatggagtaggaaaaggtaagagcagaaaagaaattagcctgctctagagaaatcaatcctgctagagtcaggcaggattcatcactgtttcatgtggatccagtcccccaaaacatgcaaggtctggtatagtatttgcattctaaaaataaaatcatttttgtttttcctttatgtgatttaggggggataaaaagagtttagagcactggttttttttttgagatggggtctcactctgtcacccaggctggagtgcagtggtgtgatcttggctcagtgcaacctccaccttctgggttcaagcaattctcctgcctcagcctcct

SEQ ID NO: 73616 - DNA, 1045 bp, Homo sapiens
accaggagtttgagaccagcctgggcaacacagcaggccctgtctctacaaaaaaataaaatgcaaaaaaaattggcacataaaattaaagactgtcctgactagtgcctgaaattatgatgagtttcttcaagtatgaatatataaccaccacctggaaggttcagtaaatgccctcatcaaatacacgctacctttgcacactttgtagtatgtaagatacttgtgtattcagagtaaccaaaatatttaaaggttattggatgttaagaaaacaggcttaccttttagtgttttaaatttcatatagtttctcaatagtactattgtctaataatcaaaattattttatatttctaatctaaacaatattaagctttcactatattttctccgtaccttcatattaaatgcttgagatttactctcaacttcacatgtttgtgcatcactttctttgcagtaactttctgccccaactgtatccataatattgcttccacaattctgcgtattatagccactatccatctgacaggagaaaaaagaaaaaaatatattgtgaggaacttaaaagtcaaatatttaaataagtaaaccactataaactctcattcactacatctgaatgatcctaacatgtaatattgatcatgttgaacaaaattcaaaagtaatgcacaaatataaaaggtagtcctgcatagtactgattattgtagtcattttacaattccttccaatgaaatatatcttgtaacttccttaagaatcagtgaacagcctactgacacaatgctttcctgttattttgtgatcgtacctagtagacaaaaatgagtattacaactaacttcaccttccaacgcattttccaggcttgtctctaaatggcttgaggcatgctgcctttaaaaaagtggattatattatatttacacctagttgttcacaataatgccacatatataatggctctagatgttagttcagcttttcatgttaataaaaattgtagcatcctaagatacactgtttcagtgca

SEQ ID NO: 73617 - DNA, 1042 bp, Homo sapiens
atgctacaatttttattaacatgaaaagctgaactaacatctagagccattatatatgtggcattattgtgaacaactaggtgtaaatataatataatccacttttttaaaggcagcatgcctcaagccatttagagacaagcctggaaaatgcgttggaaggtgaagttagttgtaatactcatttttgtctactaggtacgatcacaaaataacaggaaagcattgtgtcagtaggctgttcactgattcttaaggaagttacaagatatatttcattggaaggaattgtaaaatgactacaataatcagtactatgcaggactaccttttatatttgtgcattacttttgaattttgttcaacatgatcaatattacatgttaggatcattcagatgtagtgaatgagagtttatagtggtttacttatttaaatatttgacttttaagttcctcacaatatatttttttcttttttctcctgtcagatggatagtggctataatacgcagaattgtggaagcaatattatggatacagttggggcagaaagttactgcaaagaaagtgatgcacaaacatgtgaagttgagagtaaatctcaagcatttaatatgaaggtacggagaaaatatagtgaaagcttaatattgtttagattagaaatataaaataattttgattattagacaatagtactattgagaaactatatgaaatttaaaacactaaaaggtaagcctgttttcttaacatccaataacctttaaatattttggttactctgaatacacaagtatcttacatactacaaagtgtgcaaaggtagcgtgtatttgatgagggcatttactgaaccttccaggtggtggttatatattcatacttgaagaaactcatcataatttcaggcactagtcaggacagtctttaattttatgtgccaattttttttgcattttatttttttgtagagacagggcctgctgtgttgcccaggctggtctcaaactcctggtgtcaagcagtctttctgcctc

SEQ ID NO: 73618 - DNA, 1463 bp, Homo sapiens
gagacagggtctcactatgttgccagggctagtcccaaactcctgggctcgtgcgatcctcccaccttggcctctcaaagtgttgggatgctttttgatgcagaatattgatttataaaatactgtatctttactgtcccttcagagttcagctaaagaaacgtgcttttaggttttaaaaacagtcccgataattgcatcctccagtggtcctacttaaactgaaaacaaggtattgtcttctttttcacagcaagaccacacaacacagaggtgttggatgaaaacagcaagcccttttcaatgcagcagtccatagaatgcctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataaagacctgtgttatcaatgtgtcattttcttctttcctccataactgtaccttgaaaccttactgctgacctgcagaaaatgtgccgcgttatgtacctggctcatcttcaacacactaaccatgaacactaatagccattaggggacatggctacagatactacattggaaagttgtctt

SEQ ID NO: 73619 - DNA, 1119 bp, Homo sapiens
atggcagaaaaaggagaagcaggcacctttttcacagggcggcaggatgaaaatgactgccagcagtggaaatgccagacgcttataaaaccttcagatctcatgagaccggctcactatcacaggaacagcatggaggaaaccgcccccatgatccagttacctccacctggtcccacccttgacacgtggggattgctacaattcaaggttagatttgggtgaggacacagagccataccatatcagcccagatcaagtagtgacagagtagggatttgaatacaggttatagtcactattgtgttatttcttgacttttgtactattaaaaaactgtagccagtgaggcttctacccttagtacccagaactccttttaggtatagcaattgtttttaggtaaatttatattgagtttaacacctgtgtgattaaagacaactttccaatgtagtatctgtagccatgtcccctaatggctattagtgttcatggttagtgtgttgaagatgagccaggtacataacgcggcacattttctgcaggtcagcagtaaggtttcaaggtacagttatggaggaaagaagaaaatgacacattgataacacaggtctttattcccttttgaatgagacagtttttaaaagttgatttataaatacaaaaatacattctccaaagatagtatttccaaactgttatatacccatctactcccaacatggatataagttttttaaaaaaatagttgtatataacatacatatctgccccagtgttacttcacaggcctatgccctacgggaactccactctcccagccccactttttctcttggttctcccacattcttattctcccacatccctacccacgtttgagctggaaaggatgtccctaccctaggcatgaggtatattttattctgggcaccacacatttgccccatagataacaatacacgtgatgatgtcactagtactacctttctagtatttacatacttaaaagtagtaactagaacagttatcactggaactaagaattttccccacagaggtgaacagaccaagaactaaaatttcaggaaacctgtttaatttcttttgtatctt

SEQ ID NO: 73620 - DNA, 3547 bp, Homo sapiens
attgcttttccttggattacctggttaggccctatccttcccatctagaagagagctgggagcagtaatgttggactgcagggcattattcgatcatgatggcattggtttctgattttggatcagacctttacggcatgcatgcccagcttctccagattcataggaattgaatcagcttctcactcctctgctccaagccttaatctgtaaatagggattttttccttcattgtcttatttcttccaaagacctaagagaagagatgtatatttgactcatctccctagggtagaacaaagcagctaaatttgatgaatccgaacattgttctgacagaactgtagtgaccagtacagttttgtttctggctactacttctactttgaagggaaggaaaataacaaaaacatgatgtttgttcagtcagatcagttatattttgaagacataatggtactgacttagaaatgtttaatatggtgctcttccctcctttttgtttacagaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaaggtattttttccttatgaaattaaaggagatagaaaatggttaattttgaattttaaaagcacatattagtactgacataccatggttcttatttttccatctatctagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccaggtatttgccttttgtcgatactgctagaaaaaatgaagttttgttcatttttaatttaatttcaattttttgtttatttaaaaatttttaagacaatttaaataagttgtatgttattttacagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgaggtacggtatttctcatgtttgttttcttttccggggggcactttttctttgagagttcataaatggtacctataaagcataaaattattttttgtaccctgaagaatttatcctgatctccaaatacatgccagaaaatctacatttaattttgccaactaaactatggttttactcacaatttctcaccactatatgtcttctcatatgcaattgttgtctttgatttctttcttttataccatgtaaagttttgccctacatggaacaataaatgactctttataactcggggaaggaactttttttttaaacttacttctagtgtttcttatttgacacacatactccctattctccttaggagaaccacagccctgagagaatatttgaacaataaactggccaaaatacctttgtgttcctctactagactaaaaatttcctatttattagtggggtgattaattaatcaccaagaatttaatgaacatatatattagaaataccttaatgaaggagaaagtaagcacataagtaggtcatatttatatgagactactaggtttgtggcctttgttatgttgaacacgtagatgcttactaatttttatatttaaacttctactatgtaagataaattgtaaaggattagaacaaagcctcaaatgtaaggaagcaattaagaatgataaaatgtgttttgtttagataccctcacttaaaatagaagatacagtgttccatgtatttgataaagttaaagtgaaaatcatgttagactcatctaatcttcaacatcagaagatccgaatgtccctggtagaaccacaggtaaggccaaacttaaaatttccttgttgtgatggaacaaacagtacatattttgtcaaagaagggacgtagttatttctgtttaatgttagagggaaccctgtaagtagtgtagaaaccaaatatttgcatagcaaatcctgttttctcactgatttctttaggccacgggattctagacatctgagattctgttcaggtctttggtgctaaaataaaaaggtcttccattctcctgcctagtcttttctatctagaagttttgaactctgcattttgaagatgaagtgtaggtgtttcacctaagatactggttcttaacttttgtccttccccaacacacttgaaatcaactctgattctgtcaatcacagtggctccccattgggaaggctgttttgtagttaaaaagaacacttcctaaatgacatgcttctcacctgttgagaccatgtctagcttttacatttttgaaccactgctactttgtaaaataccttctgtgtataaaacctttaattagccccctttcccctccctaccactacatccttttaaatttgaagctggcagtggggaaggggaggatgaggttgagatgtattctatcctttaaatcaccttatttccccccatttgcattactttagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcat

SEQ ID NO: 73621 - DNA, 1247 bp, Homo sapiens
acacttagcaatcaaatattaatagccatcactacttgtaacctattagtgatactaggttatcagttgcttctcttttggttcagtctttgtggaagatacttttgaactgtggatcttctggtgttactaagctacccacagcagcttccccttttgcccctctttattgtcccctgccccaataactgttttctgtagtaaattaaatacaatcaatccccttctttatttgtaaaagtgattaaaaacctgtgtagctcaataaaaactcatcgtttgggtacagaagatataaccctcagaagcacagggattcagatttccttgtgttgctatcgtcctctcttgttaaatgcattttaaatctactgagctgttcatgaaagctctactgagctgtttatgaaaatagaacatgaaacagcagatggtcataaagccttcagaagagcaactattacacacttgctgtagtcattgtcttttttaaaagaataatttctatacttttgtcttttattggcttgcttgactataatttttctctttaatttttatgtagggctttgactctatcctctcctgaagttcgattccacatggacagtgaaactcacgatcctatagatctgcagaccaaggaacttaggtttgtaatttttttgatgggcattagataagatttttttattttaattgtcatgtctactgtaagtacaaataatgaaaacgtttatatacaaaataatgattagggtcatgatttctactttatttggcttgcaaaggacagaaaagtaaatttaagctcagtttttcttctataaaactgcgtttagtcgcataatagaaaaactttcaatttgaatttgtttgctttgatgtgtgatgtattagaacttgactagtaatagttagagtaagataaaaaaaattaccccaattaatttctaaagtagaatatactgtagtgcaggggttcccagcccctgggctgtgagctttactacctgagctctgccttctgtcagatcggtggcagcattagattcccattggagcgccagtcctattgtgaactgtgtgtaggagggatctaagttgtgcacttcttatgataatctaatgcctgatgaaaccatccctccctccccttgtcgcatagaagagttgttttccatgaaacccgtccctggtgccagaaagatgggggtaggatagaataatagatagtaggatagata

SEQ ID NO: 73622 - DNA, 2000 bp, Homo sapiens
taacaagtaaagtattgtgaaagtcaaggggaagattaaacttagtctattagtgatttattgtcagagttcttctgtatacttttttccataaaaatttagtttctcttttctttttttagtattttaaaaacaccttgtagtttatattaagcattggagaaaggtccagtcatagagtgtgtcaggtatcaagtataaacttatacagaccagagatttaaaactttcagaggacagctaggtcgttagtgtagagggcttaaacttagattaattggcatgaagtccagttttccttcatagctttccttctttaacaattttgtataagtgcttttatagaaacaaaccttttatttgaccttttctcaattctcctatttacaaaaagcagaacactcttttctttccttgtttaattaatgttatttgagaatagaacctcacataaatgtatggttatggctaagtaatctgtggttctatttttatcttttgcagaggattgacatggttccagagttgcttagctctaacttgtgttccttaaaatgtgacgtggacaggtatttctgcatggttttttttccttgaagacattgtatttactactttaacctgattcccattaacaaatactctgtattttccttcacaggctggcattttcatgtatttgggaaatgaatcacaatgctgaaatcttaaaaacgaagtttaccaaaagtgttattaattcaaaggttcgtttcatggctattaatctctaatttttaaactttttggtacttttttgaaaaaagctaaataaattttttaaagattcacatgtacgtatatatacacatatataaaaatatttatatatttgaaaagagatgttatgtataattatatgtatatttacttaacctaaaatagaaaaaacatatacatgtaagtacctgagatataaacatagtctaaaaaagtccccagctgcgggcacgtgcttaaacatgtacagatgcacttaaatttacactaaaactcatttggcccttttgctacctactctcagagaagaatgcagaacaggccaccagagtcttattgccagctttcttgacccagctagtaccaagccaaagtaaccagccccagccctactgccatcacctaaatttgagattcctgcccacttcttgagaatttttcagtcaagctagatgctcttttgaacatgtaaagtggatacagacaaatgtatttcagtttgggtgggaggggaagagtctttctaggcagaaaaacaagggctaggtctgtgccctcaggatagaatgggggcactgttatagcaaaattttgagggttttttttttccaattataagcagataatttttgatgtgattcagaaattagttcatgttgcagttgtcctgtattcagaaacttacaaagaatatatacttgaaaagaccaactagtggttttatgccctaactcaagaaccctagtaattgaagctgttcctacttataaatggttagtgttttaaaagtcagcaggtacaccacttctttcttcacattttctcacagaaatgatgtttaagtcaccattggattttagtagaactagcctgagatcatgtttattcataatggagccaggttatctttcttgtccttttcctgtttctttgtacttctcccaaaaatcccttatgttctctcttattttgccctacatctttcttcaagatttgccaaaccccttatcttctaatgatctgttttccaagcttaacctgttttttctggccctttggcatccttcttgctgttctgctaaccagtggttgcaaagaaaacagtgttagactggtaaataatgatgtgtgaattatttaagccatcacagtttgtactttaaaataagaatgacttttaattctttaagacttggtcagtataacaaaattatatgaaaacaaacctagtgaatatataa

SEQ ID NO: 73623 - DNA, 1074 bp, Homo sapiens
gttccccatcagcctttttcacaggctgttcttagttttctgccaaagatgccctggagcattactgaaaaggtaagttgaaagtaatttgtagtgactttataaattattatatcctgcctagttttgtttaatttctatatgtgtttttaaatatgtagacaccacgggccctcttttcctgcattttgttgggtatagcattcttaggaattatagaagaagtcatttgcttcttcattgaagggtaagtttttctatgtggcagacactttcatatgttaaatgtttcaaagggaaggaaaccattagttacaaatcatacgtggtgtctctctgctccagtgcaggaaaaagaaatgtggttgtcatcaagaaaatacagctaaattgtttttgtatacatattactgatttcacaagagctattaatatgttgtagttgtgctttggaaataatttatttgtttatcatttcatgtcttctaggacatgaaaaaccgagaagacctgaggcatctgtgtatttgtagtgtagacccaccaggatgtactgatatagacgatgctctacattgtcgagaactcgaaaatggaaatttggaggtattcatatgtaatagtgttcttacctaaatatagttctgttctgagttcattttcttttgaactagaatagaatttgcttgttaattactcttgtgaagtataattgtagctgcacgctattggccatatgtcagaagttgaaatggtagaggtgactgagtcttttttaaatttagctaaactttatcttattaaaactccattaggtacatttacccagtcaagcatattgacatccttttatttttatctttttaaggttggtgttcatattgctgatgtgagccattttattaggccaggaaatgccttggatcaagaatcagccagaagaggaacaactgtgtatctttgtgaaaaggtaaatgtattgaatttaaaaatttaacagtcatggacacttaaggattcttaaacggccatgaattagctaagaaaaatacatggaataatgtggctttaaat

SEQ ID NO: 73624 - DNA, 5121 bp, Homo sapiens
cctgtgaaattgtattataatttgtcaacaaactattatttagtgtctcaacctaaagtataaattctgatcttgaatttttctttttaggaaataaaattgtattagcctttttcttgtccccttaataacataattttcttcttttccaagcaaattgtttcttaaaaacttaattataagaatcttgatttcttctctgaggtgtacatctgaatacattcaagagaaaagatataccattgactttttctagtttagtggttaagcatttatgtgctaagagttttcacatatccttgtttctactgatttccttttatttcgttttttctttccatttagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtaagtctaaatgtagaagtacttagtgcatgtttgcaaatgcgtgtaaaaataatcattaggcctatagtcagatgttcactttactatttagtattttcgtagtcctatataacttcatgtgatatttttgtatttttaaatttcacatagtttttaacctaaatatgttgtgcccagtggctgttaattttcccctcactatttgcaactggtttagcaatgaaatctcataaatatactggaacccctgcttctgcttaggtatgatcacatcaacagatttttgggttttgttttttaaataaattgaggccaggtgctgtaatcccagcactttgggaggtcagggcaagaggcttgcttgagaccaggagttcaggaccagcctgggcaacatagggagactatagctctacaggaaaaaaaaaaaaagccgtgcatggtagtatgtaactatagtcccagctactcgggaggctaaggcaggaaggtagcttgagcccagggattctaggctgtagtgatgtgtaattgcgccgctgcactccagcctgagagacagagtgagactctcagtgtgtctcaatgaatgaaagaatgacgtgtatactgtcgcaaacaagactatccatttttttcatatctaaggaaaaaacacttatcaaaaacaacataaacttattttttcaggtgaagaatatgtaaagagcctaactgctaaccccgaactcatagatcgtcttgcttgtttgtctgaagaaggggtatgtttttgttttgtttttgaaaagtaaaaatattaaaatagccactttggaatattaggcatatagttaccaaatttaaaaattggaatgtcggtgggtaagctggatttggaatagttgtgttataaacaggagtggatgtcataggcttattgaaatgccattcctaaaggagttaactttctaaaatagatatattcccattaacctgagtagggcctggtacctggtagcactgtttggttgaggaaaaaatgaacggagtccatggctgatttgtgaataaagagtagctgctgacaaatgaagtggcaggcactgcagacagaggaaagaagagggaggggagtgtccagatagtaaagacctagaacttattctgtaggttagtaatttttcaattgatttataaagatctccctgaagggctgctatgaagaggaaaggattctgagatcccttccttatatgtcaggctaagaaaaagtaatggtatatgaatgtggattggtggagcaggagagaatgattggaaatggtatttgtttgtaagaccactctcatgtcagtgtgtaacattaagcattttatccaggaaagattagaggcagagaggtgagtaaaggagtcattacaatagctgatgtgagaaggagtgctaagggaataattaaattctgagcattcattttcttatatataaatatataatgtttagcaataataacttcatagtgttgttataaggatcaaataagatgataactgtagcattaatacaattttcatcctagtgcctggcacataggtatggtaaatataaatggtagcccttgttatagaaataggttttaagtgataggacattatacataaatccagtctttacacttctgtcatcccttcttacctttatgatactttatgaaaccaaaaggaaatgagaagataaaagttgggtttgatttttgaaatacagatttagtattgccctaatatgtagccacttagttatatatgactatttaaatttaatatgtattaaaaattcagtttcttggtggtactatctgtctttcaagtgcccaagagaaacttgtgtctagtggctaccatattagagatcgcaaaatgaatacttccttcatcatagaaagctgtttttgttagcactggcctataagaaacactgctatcttctctcctattcagagttgtgtatatcataatgtagatttcaaaaattctctgatattaataatagttgtgtattgagtgaacagaagacttattagcggcatcttttggtttgcttctttcatagaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagaggcaagtatataaataaattccttatacactaaaataaagatgatattttatatattatgaacacttaatggtaaatactatttgtgtaacatatgaggcttcacatactttaaagcaaatagtaacttttttctttttttttttgcagtgctcacaatttgtcaggtagttttttaaatctttgcgcatggcatttcatttaatattcaacccaacctataaaaactaggtagtgtactcttatttgaccaatcaggacttgagatttagagagcataaataatttttccaaagtctcttgttaccagtgtaagttatgatggagccatgaacacagcctgtgttttctgacttacattttttctacctggtattgagaaattaaagttgtggaattagggacacaatagagaaagaaaatctataaaggagaaatagagattccatagagatattcagagtgtatgtaaatatctgttagatgatcttccctttattatattgccattaaaaataatttgggcacgtgccctctgttgttttaaacagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagacagaacgaatggtatgaatctaagcaggatttttttttgtctgtgtagctttgtattattaatatgtcagctttggaaaacaagtttcattgctttcagatttattgcataaaatcatagttctgtatatttaacgcatgtcatacacatggtttttttctcttctatgtagttttcttttattgtcttaatttgctcaaataaatgggtttaaatgcaaacagactgttagtatgagttaatacaagtatgaaactgaaaatctgtgacagtcaagtatattattagacttagtgagatttaagtaaatatgtgtttaacattttctgaaatgctttaagtaatgttttaggaaatgttttagaaaatgctttaggtaaaattcccttaacataatagacgtaattctgggccattatatttgggcaacttatctgataccatatttattatgaagagaatactttcagttatttcttatgatatgcgctaagtctacttgatatggcctatttctgtattttataattacaatattataaatagttggaatgcatgtaacagttttttattcttctttttccatcatttatattcattgctctggagtctcactataaaattatccatggagagtccaggcctttggatagtgttaagaggtgaaataccataggaacttttgtaatttctaatagcagaccctctttatttgggtttttattttttataaggaagaacctttagaattaataaataaaggtccaaagggaactagtcaccataccacatagctaatttgtacaaactagtactaaaaccctaatctaattcccagacctgtgtgtgtattttagtcagtaaatcctcatgttaatcctgaaaagtgttgagttctaacatacgtattcagttatatttatttatttgtttttgctttttgattgttttgtagtactttattatcaagagagaatgtctgtggtttggtttggcatgcatgttcttgtctagaatgttgaaacatcaacattctgtagtcttatgtcataatttactgcctgaatggattagtatccatgtatgcattttgattttgaaaggaaattgcctgataatacttagaggaatataactgaacattttaatttttatatctcagcttaagactgctgtaagcgagaaaatgttgaagcctacaggtagagttgtaggaataataaaaaggaattggagaccatattgtggcatgctttccaagtctgacattaaggaggtgagtaaagagcatttactatgtaataaaaaaatgataaacatttaatagaacttatagcctttcttttgcctccatcctcagattttttttgtgtaaaatctttattcctaatttttgctagtcaagaagacatctctttacacctgctgataagagaatccctcgaattcgcatagaaaccagacaggcttccacattagaaggacggagaattattgttgctattgatggttggcccagaaattccagatatccaaatgtaagcttaaagtattaattttatgtggggatgtttaattaaaattttgtgaatagtatttctgcttttaataaaaaca

SEQ ID NO: 73625 - DNA, 1072 bp, Homo sapiens
tgttgtagttttgtaaatatttatctttattactgataagtgagagcactacaaattacaaattttaattgtaatttggatttaagactgcttattaatttaatttttttcaaggttcgcttctatgagctagtgaatccattaagaaaggaaatctgtgaactacaagtgaaaaagaatatcctagcagaagaattaagtacaaacaaaaaccaactgaagcagctgacagaggtttgtatggttttgattgctggtgggaagaagcttcggctttttctgtagagtccctcaggatttgtgataaggcatataaaagtcagtgattgaaaaatgggactatgggatggtgactgctacagttcaataatgggaaggaggttaaattggaagtagtcatcttaaacattgacaagacaagtctgtgttattgacgtatcctatagttgagcttttattgttgcaagtcaattttataatcaactgcttttgaaatcctaatatgggctatatctgaaaattgctgtgtatccttagatgacgcatatgcatgtatttatttagtaatttgtctctatttttaacatcactttgtcaggaaatttaagcaagaaacaagaaatgtaggccaagctatgcaggggatctcttgcaggtgccataagaaagaagaaaaggagaatatttttactttgaactaagttgactcgtaggttctggtttgcctaagactgttgccattattcctgtgaataaatattaatagcacccctttattttcaaaattatctcagcctagacgatgaatatagtaatcataaatcaacatttatatagaagggtggactaatcattaacttggttgtattattgaccagatatcctagaatactatcttgtagttatagtctactaacaaaaaaataatggtagattgattcattctaccatgtaacagttggaaatgggtggctgtttttcttcaaatatttcgttattctaaaaggaaaacacttctagtttacaaatgggggctgctgcagttcttcattacaagttagccttgttcgtg

SEQ ID NO: 73626 - DNA, 1737 bp, Homo sapiens
gcacccaccaccacactcagctaatttttgtttgtttgttttttgagatggagtctcgctttgtcgcccaggctggcatgcagtggcacgatctcggttcactgcaagctccgccttctgggtttacgccattctcctgcctcaacctcccgagtagctgggactacaggcacacgccacgacgcctggctaattttttgtatttttagtagagacggggtttcaccatgttagccaggatggtctcgatctcctgacctcgtcatccgcccgccttgacctcccaaagtgttgggattacaggtatgagccaccacacctggcctgaagttactaacttttaataagacatgatccaaatttttcatatgacattattcaaaagatcttcataaagtgattcaacaaatattttattcttcaactcatacttatttaaggttggatattttaagataaacaacattagtcttattaatgactttatgtaattttaaagttggatacaatataagctttggggaaaaaaacatgactagatggtattcacccaagaattttaagggacttaaaggatgaacctgaaactgcagcacatgtataatattgctatcaaacagagcacttgaagtaggtgtaattgcttgaaagctggtaaattgcctgcctgagtctagaaactaaagacctccacacttaaaactgataaagcactcttttatgcttactgagcttgtgtaatgcatgaagattaggatcagtgaatacttaggcaagttaaatacttccccttatgggggaaggtcaacagagtggtacaaatggacaaattatatttcacatatatataaagagaaaatagagaacaaattatatagactttcaaaaagccattgacaggttttaaattctagcttttaaaaattggcaggcttttaaaaaattacagtgaataacataacattaaatttaagactttattttcatgtatacaattcagtaaagaatactcacattgtgcaacagatctctagtacttttgtatgttgcaacactgaaaactacccactagacactgattctccctctcccctcccccagtcattggtaaccattttttaactttgtttctatgattttgattagtttagattcgtcatatgagtagagtcctacagtatttgcccctttgtgattggtttcaattagcataatgccctcagggtttatccatgttgtagcatgtgacagaattttcttttttttttttattgtactttaagttctggggtacataggcacaacgtgcaggtagtgttacgtaggtatactcctgccatggtggtttgctgcacccatcaacccgtatctacattaggtatttcacctaatgctatccctcccctagtcccccaccccctgataggccccagtgtgtgatgttcctctccctggtccaagtgttctcattgttcacctcccacttatgagtgaaaacatgtggtgtttggttttctgtccttgtgatggtttgcggagaatgatggtttccagtttcatccatgtccctgcaaaggacattaactcttccttttttatggctgcatagtattccatggtgtatatgtgccacagtatctagtctatcattgatgggcatttgggttggttccaagtctttgctattgtgaacagtgccacaataaacatgtgtgcatgtttttatagtagcatgat

SEQ ID NO: 73627 - DNA, 1088 bp, Homo sapiens
ttccatttgtcagtaatttcttccttttcattactgagtggtattacattgaatggctctagttatttaccatttaatgggcatttgagttatttccgattcagagactttacaaacaaagctctgagaacatttgagtatggttttttgtgtggacatgttttttctcttgagtaagtacttaagtgtggaattttttacttctagaatttcagtttggttatttattatagcttttatttctctatttgtttacttattatgaacatattttcctttacaccactgagaattgttaaaataggagctttaaaattcttgtctgctaattccaaacactgggtcaccttggagttgatctctgttgattgtcttttcttttagaaatgggtcacatgttcctctttcttcagatgtcaagtaacttaaaattgtttagaccatcgagtaagtgtagatgagaacattgtgagtattatgttgttgagactctgcattttatgtacctctaaacggtggtgatgttcttgttttagcaggaaattacttggttgtactcaaacagcatactctgtctattgggcaggtgttcaaatttcagttcaattttttttggtattattggggctgctcagagtctgtcctacacatatgttgtttagagggtagccagatacttaagcagaaattacccagagaattcagtttcccctctctggctatctctgaaatttcctcctcatttagagcagctgcagttcccataaataccaaagattttctcatgcaccttgatccatccaacctggcacagaatgggactggcctcaggctaagggctactaaacaaaaacaaaaaataccaggaaactcacctaaatgctgaaaatgatagcaataatgacaactccatagtggtttactaagagaaactaaggtatttgttaggcatatctctgagttttgagaccagcaattaagaaaacaaattttccattttacttaaaaagtttattctctacagagagttcatgaatctggagaaaataaaattactctcagtctttccgttttactttatggatctt

SEQ ID NO: 73628 - DNA, 1047 bp, Homo sapiens
gccttggccttgaattttattgatctcatctctagtgattgccttttctccattttaacactcagtcttatagcccacatttggttccttgccatccagaactgatttacttctgaagttaccaattcactttcatccactaaacatcttatttcctatattttttatgttttaccattgtctgctttcaacttgtctttaacagaatttccaatccatataatttgtttctttatcaatcctttcctaaatttattttcttcccttgccaccatgttatcagtcttaaacttttttttttttttttttttttgccagtatcatctaattcctctcccagctttctttttatcaaaccagactgaaaaactctcaactctttatttttctagctgagcactactggcaaaaatcacacaagcagtaacaagcactgtcagtttattgttatcagcctcaaatggacccacacaattggtcgtaattctattatttctagttctctcatttttcgcagagattacttaaggcaaccagccactcttcttacatctccagttttccacgtttcttgtcgcattcagcagatgacttggtatttcatttcacagagaaaatggaaatcttcagatgagaactcccacagtgtccttccaacaaatctactcacatctgcactcattctggtttgtttgttcttagtgtttataatggaaagagtctcgccctcaagggatgggaaaatcatatgcctctagaaaccaggtggataatataaatttgtgaagccgtagggtaagattaggctgtggcctgtagcaaattgataagagctatctaaattattcaagttgttaatactctgtatcagctggaaaaaagcctgccttgatgaacatggcctctgatctaagactaatctgcacatctaagctgtggatcccatctcctaaagcccttttcaggagtatgcttcattcccctgagtatgcccccttttctccaacagtaattcatcttttgctgttgtttctcaccaatatttga

SEQ ID NO: 73629 - DNA, 1052 bp, Homo sapiens
ttctgagtaacacaattggaactgcatgtttaatctcttcattaattatttttcattgtagatactgatatccatatgacttttcatctctaaactgtaaaatcctcaagaacaggaagtgtgttttattcacttctgtatcttcagcatctgatagtaactcagtaaatgtttttaaaaagtcatttaacatttgtagtcattttatgttttagcctagtaactaaaacatagttgttgtgttatttatttgaaaaacagtttaagttttaaacaactgagtttacagaccactctgtgaacttaagattacttgcctttgaatagggaaaaattactaaatttaaaaattgaggaattttttttactgtttaattacaaggacaatcacagcttaacagaagacttcaatacagaatttgggcaactatgttaagtgtttagtctgaaatgtgttattattcctttggtttatagacatatgaggaagatcgaaaaaactactctgaagttcaaattagatgtcaacgtttggccttagaattagcagacacaaaacagttaattcagcaaggtgactaccgtcaagagaactatgataaagtcaagaggtaagtagttaaaatggctgcagtagtagttctctatttttagggtgcatcaaagtcacctgagtttttaccaacaatcagttgttaattttacttttaccttattcttctttgcacaaatgcatgcagttttggcagtttgttgggtttatattgtatttttatattggttgtttttgttttatttagatgtcactgctgtcttaaaatgtaaacagagatagaaacccagtaaaatcacacgtgtgtaaatattttttcagtgttatttgatgattatttttatgtagtggaatcaatttaaatacttaacagttttccctgaagtttttttcagctgtttcttcctgacaaaagacacacactctttcaaaaaaaaaatgacactttctgaaaatatgtttcctaatatttgctacttatagcaaataccttttttta

SEQ ID NO: 73630 - DNA, 1038 bp, Homo sapiens
ttcatcttgattaaaaggcaaaagttttgatctttggaagctcatggctagttgtgtaatctcccagttagtcattgttgttatcttccagctccccttaactgacactaaatgtattctttctatcaatttcagttccttcctactgtcctcacaactgttaagtagatgacttttccagtaccctaacttcatacttctttgagccctacatgaatattgaccttcatctcagatctacttaatttagtcatactaattttcatacccgatcttgttagccaccaaaattctgccactgaaaagtgctgttctacctccaaatcaccattctccagtcttccatcttgcttgtacaactattacactttgacttaatctgtcatatcttatcaggacctctaattctttgtcccttctactttctcctgtctgtcaacctgtgtttccttcccattccttcctatataactgagacttcaaggttcttcatttcaatgattctcttgctcgtatcccaaaccgcacttttattttgattctccacaatatatctttcacttaaaatattttatgggacatttattaacctccccaaacctcagttttctagtggataatatatgaataattacacctatctcattggattctcgtaaggaatacataaattactatatatacaaactggttagccaaccctttgacccatgcggagaagggtggtgtgacatagagatagaccatactggcacctacactggtgtatcctgctcttagatactcaaccaagccaagcaggtttatatagtgtacactttgggtccccaacttctcagatgggtccttaagattgtcagatagtccatctttaagaaagaacatagataaatcacgcatttgaaataactgaaatccatgtttaaaatttagaaatctccgagaagcaagggataatgctgtggctgaaaaggaacgagcagtgatggctgaaaaggatgctttagaaaaacacgatcagctcttagacaggtaagc

SEQ ID NO: 73631 - DNA, 1649 bp, Homo sapiens
agattcaatagaagaaaacattttctgaaataaggaatctgcaatttagaagaactcatcacattctgggtagtgggaagaggatgggaaacagcaatgttgtaaatctaagtgaagttacagaacatgaatgttaaaggaatagaattagaagtatctgcgcaaaataagtaagtcatttactaaggaaaaaataaatctaagctgcatgcagtggcatgcctatagacccaggtacttgggaggctgaggcaagagaatcgctaaagtccaggagttgaggaccagcctaggtgacatagtgggatgcccatctcaaataaataaattaattaatttggttgagctcaaggttttcttccataataatactttatttatttagcaatatttattaaccaccaagcaccattttcaggcactgtgattaagggtttgacaagatgaaaggctctctgtcttaatggaacttgtatttctgtgatgtaaatcagaaaatatacaaataacaataatttttagagagtagcagttatttgaaatatatgaaattgagtatgattcagggaggtttgcagtctgaaagatgagaaggaatcagtcatgtgaggtcccatgaaacatattacctataaggccttcctgaaaaacctactggaaattgtaacttcaccaaagaaggaaagaatcaaagaactcatggactgagatgtcagggtaaagaagaactggaagtgaacgtttagtgtaaaatgtaatcttaatgacctttgtcattttggttacaaaagattgtaatcataattgttaacaagaaattataacataaaaataatagaagtagaggcgaaatagcagaaacttgcaactaaaattagggaattgatggtaagagaaatagtgtttgtacatatataatgttctcagatttcatgaaagaatcaatagttttatgaagaaatacatgttttaatatataatttaaaactataaatggaacagactatatattttgcatactaccagagggaggaaaaagatcaatcacaggctatataacaaaggacagacagcaaagcaaacaccaaagaagtaaaaaaacagagaccataaattaagatggaagaaggctacacccatcttttctaatagcaattgtaaatgtgacaaacacaccatgtatataggaaaagaaatacagtttggattaaaaaataaaattttttccacattaataagtgactcagggccagggcgcggtggctcacgcctgtaatcccagcactttgggaggccaaggtgggcggatcacgaggtcaggagattgagaccatcctggctaacacggtgaaaccccatctctactaaaaatgaaaaaaaaaaaaaattatccaggcgtggtggtgggcacctgtagtcctagctgctgaggaggctgaggcaggagaatggcgtgaacccaggaagcggagcttgcaatgagcagagatctcgccaatgcactccagcctgggcgacagagtgagactccgtctcaaaaaaaaaaaaaaaaaagggactgaggatttttaaagatggaaaaaagacaaagtaatacagaattaaaactattctgcaataatttattaaggattgtcttaaaataattc

SEQ ID NO: 73632 - DNA, 1066 bp, Homo sapiens
gagatcacgccattacactccagcctgggcaacaagagcgaaactccatctcaaaaaatatatatatatatatatttttttaatcccaacttgcagtaaaatgtcattgcatttcaagttttttacccagaagatgttaacctgttagttaaaattccttttgggaagtagtgtgacaatagcagaatttaaaagtaaattattttcacataatttttttacatttaaaaaaagtaaggccatcaatacatgcttagagctgcacagtttttaatagagtaacctacataagtacataattttattgttgcaaattaaaataaagttgttctgataaaataatatttgtcctaatttaaaaatcatttatcaagaacagaattgatgactttgatatgttatcattatttgttatattacatagcatatttcatgcaaaaagcctttgagtccttcagaataatacatgtattattatactttttaacaagaaaacctaacatgatatgatgcaatcccttatacatttcaaaaataaatggagcaaattcaagcaaggatatactttaagaaatatgtttctacttacaaatgggctgtttaagattacatattagccctttctaatgtttttatcctccctaatttgttataacctcctttattttcacttctgccatcttttttaaaggaaaaataaagttatttcacattatacactttaatattttccagttgaaaatgaagatgaggctgaaagggttcttttttcctacggctatggtgctaatgttcccacaacagccaaaagacgactaaagcaaaggtaaaatcaatatatatttattttatttatctactcaagatgaatgtaattacatttgtgctttctgataatgtgctgagttcagtgacaaagtcctttattcttactctgcataaatattaaatttctcacaaaataaaacactaataatcatgtatttcatatatatttaaataaatttagtggtttgtagaagtgtgcataagaatttatgtagaattagattcgatgataaggacc

SEQ ID NO: 73633 - DNA, 1015 bp, Homo sapiens
cccaatcagcaatgttatacagttgaaccacattaaaattaatttctcaaaggtagctttgaaggagaaagaagttgcaaacacttgaactcaaattctgttctctaaccctaatctcctttccttccagctctcctagttctttcattcccactaaatttgtactttatttggactcattacaagtccctgtctcataaagcccttccatatttttccaatctgtcaagcccctcctcgttttacttttcttcctgcctatccttggactttgtcagccatctgagtactagaattcaccatctctctagattgctttgtggccaaatttatacagcaggcttttcttgacaatttctacctttagcatattatcttacaatctgataattagcctataaatatttaatggaagaaaggcaagagagagaaaattcttaggttttgcagtaacaatactgaaaaattcttgtggaaatctgtgtgactcgtcctgcttggaagcattatgaattcatgttattgaatatcaactaggcccttaactactgttgcccagtgtttttatttttctgtctccatcctatttcccattatctccattgcagatcacttctaatcccaaagctatcaattctattatctgtctccttttttcagtatctctccttaccctttttctcctctttagtacccccttcaaagtatgtgtgtgtatgtgtgtgtgtgaccaaatgccaaccaccactgacacacatacatacatgggggaagtggtattggcataggcaactttcaaaagttaataccctatctttgtgcttaatttattcttctctcctcccatgtcagctacactctcctcagtggtcattaatgacctctgaatggccagcattttcttctcagagcctatacaatttgatctatctgtggcatggcattatggatattctagaaattctgtcctgttttggcattacaacacaattctccctggctctcgtcctgtaac

SEQ ID NO: 73634 - DNA, 1021 bp, Homo sapiens
gataccttttgaaagtaaggcttctggcccttaactttgtttataatactaaaacctttagccgggcatggtggtgcatgcctgtggtcctggcgactcaagaggctgaagtaggaggatcacttgagtctgggaggtcgaggctgcagtgagctgtggctctgcactctagcctaggcaacagagtgagatcctgtctcaaaaaaatatatgtatatattaaaacctaatatatgtaactactttcatgaaaaaattgaactaaaataattgagactgctgctgtatattttgtgcaactaaaataattgagactgctgctgttatgttttgtgcaattgaaattagatttggtatgttttaaacagctcattctagacagaagttaactgaaattcataaatgttcttagttattccctgccaccctttccccacacacacacttgaactgttctgcactttgaaacacaaagcaacttgtcagttcagtttattcagtcagggtcagttctgtgaaaacaaagccaaggcaattgtttgatttaattgactagacaaactggttatacaggttagtagaacttagttttatttttgtccagctgcatatttgaatgttcataaagtaacttagtaaaataataagattccagtgacattgtaatatattttaaagaataattaccaaagcaaagaaaaaaaacattctaaaacccaaactatagaagctattcatggtatttttttctttatggctccactttcactataatgaaatgtgttcccccaaaaaagtagccttcttttctttcactattcatttccttctttttttttttttaatttttttttgaagattttttttcctgggctgtagttaatataactatcagaaaatttcctgtacaatttagatgaataaatgcttttacagaatagttctctatgtgcaagcagacatcctctaacagttggtcagcccccttttggcttcagtgtcctccttacccagccaacct

SEQ ID NO: 73635 - DNA, 1077 bp, Homo sapiens
ggaagaacacctcttaggaagctattccagtatttcagtgagtgaaggtggtgtcttgaactagattggtgatgatgaggtgaaacaaaaatggaccgatttgaaagctatttaagaagcataattggccgggcgtggtggctcaagcctgtaatcccagcactttcggaggccgaggcgggcagatcacaagatcaggagatcgagaccatcctggctaacacagtgaaacctgtccctactaaaaatagaaaaatttagccaggcatggtggtgggcgcctgtagttccagctactcgggaggctgaggcaggagaatggcatgaacccgggaggcgaaggttgcagtgagctgagattgtgccactgcactgcagccttggcaacgacagagcaagactctgtctcaaaaaaagaaaaaagaaaattaagaagcataatcacggtccttggtgatttgagtacattagggactgatgaagagaggagggatgagaattgatgcctaggtttttggcttgtgtctttagtggtgctacaaagaacctagaagaaagaggtttggggaagaaaagttcaagaaaatatctaagtggatatatacactagagagttggaaatgtaggttcttgtgcccaagaaagagaattcatctgttaatagaaatttgaaagtcacaacataaagatgttactttacatggaaatagagtaaatgaactagtgagactatatagagtaagaacagaaaaaggcctgtgacagaatcttaatgagtaccagcatttaagggaagggcataggaaaaagtgcttacacaaagaagagtgaagagtgaccagcatcagtgacgagcatcaggaagagagtagagtccctaaagcccagggagaaccattcataacagagccagttgtacgcagtgacgtgctctcaagaggtcaggccaaagaaagatttttaaaaaagagtcatttggatttaataagatgctaaagggccggcacggtggctcatgcctgtaatcccagcacttgaggaggctgaggcagacagatcacttgagctcaggagttc

SEQ ID NO: 73636 - DNA, 1102 bp, Homo sapiens
tttctgtcatctttttttttttttttttttttttttgagacagagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacagggtttcaccttgttagccaggatggtctcgatctcctgacctcctgatccacctgcctcggcctcccaaagtgctgggattacaggcgtgagccaccgcgcccggcctctgtcatcttaaatgtattagaataagaagtagataaacctgctctgctctagtcagtacttctttctttattctgttctaggcccaaaaattttcaatgtaaggaaaacaggatgatgaaagaattcttttcagtcataagagagatgaatgaaactggggatgtttagagaagataagacttagtgaaagataagaaattcaaagtaggcacgtaaaacaggcagtaagagatttgttacacatgtctccaaagtccagaattaaaccaaaggctagatgctatgaggagacacatcctgttttgttgttctacttttttttttttttctttttgaaacgggagtgttttggttttatagttgagtaaggaaaacctagattaatacctaatgtgtcttcatttttaaagcctgggctaggtggccatatagtcagaggggatttcttaattgtatagagagactgggctaaataacttgaagatctcttccaaacctgaaattgtgtgtatcacagacattgatggaaggcatctgcattattgtataatgatagctttgaccccagaaaggccttacttaatttgaatgctgtttcacttcttagtagctaaatgaacatggttaattttcttgagccttctttttatttatttatttttatttagaatttttttattttcctttgttgtttttttttttgagaaggggtcttgctatgttgcccaggctggtctcaaactcctggactcaagcaatccacctgccttggcc

SEQ ID NO: 73637 - DNA, 1049 bp, Homo sapiens
ccaggcctaggctagaactgccagaatgaaacgaagctctagattagaatactctacattttgtcattttgagaagggagcttcctttctgcctgagaaccttagggtaaatcctgctacacaaattatcgcatccacgtacacagagattgtactcaatggtgtcattaagatgaatagccccactttgggatgccgaggcaggcagatcacttgaactcacaagtttgagaccagcctgcgcaacatggtgaaaccccatctccacaaaaatgaaagataaaaaaataaaaaaataattagccaggcatggtggtacatgcctggagttccagctgccaaggaggctgaggtgggaccattgcttgagcctgggaggcagaggtgagccaaaatcgcaccattgcactccagcctgggtgatagagccagaccttgtctcagaaaaaataaaaaaggccataaggcagaaagaaaacatgtgagctggtcctttattcataaatgggatcacacaaccaaaaactatcagaaactggaagaaaaagcatagaaggaaaaaaatagcaataaacagataaactgggggaaaaacaaattctggagcagaaaagaacttccacattgttataattaatttcttcagaaagatttggaaaagtaatatttccctaatataaaaatcagtaggccagatgcagtggctcacgcctgtaatccccacattttgagaggccaaggcaagtggattgcttgagtccagcctgggcaacatggcgaaaccccatttatacaaaaaaatacaaaaataattagccgggcatggttggtgcatgcctgtagacccagctactcaggaggctaaggtgggaggatcgcttgagcccaggaggcggaggttgtagtaagccaagattgtgccactgcactccagcctgggcgacagagcaagacctgtctccagaaaataaaaataaaaataaaaataaattgtgatattttgaagaattgcgaaagtcaaaatcatgaagtaaataaagtataagtaa

SEQ ID NO: 73638 - DNA, 1057 bp, Homo sapiens
cccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccaggtaggaagagccgctcccctcccaccgcagcactcccgggctcgggcgtgtcccgttgctgcgactcgcgggcgacaggggccgctccaggctggggcgtgcgtcggggcgcaccggagccggtgctgggtgggcagccccgccctgcacgcctggccggggccccgcgtttcgctgagagtaaatgggggggggggccgggggtgggaaggatggaggggaatctgccccggcgggtcggcctgggagaggtaagagggagggaactgggtgctcacgcgcaccttagttgtttttcttacacttgagggacgaaaccttgtaccttacgctcagttttacttaaattacgccttcgcctgtaccgctctccaatgccaaggcattggagccctcccccccatccccatcgtctcgggttaagtaga

SEQ ID NO: 73639 - DNA, 2210 bp, Homo sapiens
gaatgtagcattggcccactgagaaggacatgataaatgttttgctgatgactgtgctagggatacagcagcctccccacccacgggctccttagcagcactctaccaagggagtgattttcccctaggtaattaaagatctgttttagatagggatatgaataggaacatttcattatcatattaaccaattacaggatctgctgatgaaaatcaacatttagatcaaatattgaatgtgaaattgttttgtttcagtggatacaaggttttgcttagaacgttgtgtttaatttctcattgaactgtaaacaagaaaagacactgaaatagccaaataatatttttatattacttttgaagtatctagtcaagaaaagaaacctgtgcaatattttaaaggtttgcatcgttttttctattaaaaaaaaccacgctttttaatgtttgtgacttaaacagaattgaggtagtttggcaacatttcaatactgtactctaattgcaaacttaactgtgtaatggggcagggaatcctgcttgtacaggggtgatggtaccttgttattgcatcagaatggaatgttttaagtttgctttcttttttattcttgatttgcgtctttcacttttgggggtgattgggggagcagttttaccagttacacagagtttcataaggttttggtcaaccagttattacacaatcgacaaaataagcctgatatgtttataagcaacactgaggagtttgccctagtaccttacacagggattgggggaatttttagtaggcgccgattgttcgttcttcccgagatggtgaatcaggtggattatgcattttatatctcttcttttttagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggtatgtgctcttacctggttgaagcatcaatagatgtagtgtgtgtgtgtgtgtgtctgtgtgcgcgcgcgtgtgcgtgtgtgcacgcgcgtgcccttttcaacctcatggctttaaataggaaagttgtacttgacagtaaaaaaaaaaaaaattacctttttttttttctctatcctatctctgtgctttaactttggtatgtaaaccagttagttgtctgttgcttatgttatgcatcaaaaacttggctagaatattctggaaaaagttcccttggatttttttttctttaatattaaaacagatttgaatttctaatacatattatttcgagttaggccagagttactttaaaatggcaattgaataaattgcagtttttaattctaaattaagtgccccagaaagagattaaagtagggtgggggaaaataaggtttggtggtgaagtggaggttgcaggcagct

SEQ ID NO: 73640 - DNA, 2790 bp, Homo sapiens
tcagaagccattttaagatgaaaccaggtggcatactttaaaggccccccaaatactccaaatattgtcaaatatatagatggttactatttgcgattttcttaaaagagcagccctaaagaaaagaacttatataaagtgattgtgtttttttccctcaataaatacagccttacctaaagttcagagaataagtttgctaataaaagcaatgacctagcaaaatgtattattccatcattgctatggaaaccaaagtattcaacagttcctttgaatgggttgttggattagtgtgaggacttgaatctcccgaggctagatgttactatggaaattgagttttgataaatgaagtagttatctctaactgctgcattaaaaagtaaaagcctttgaacaaaggtcagtgctgaggtagagccctaagaggaatatggttgcagacattttgtatgcatgttaggaagcattgcttgatatcccagtgataaacactacttactaaaatccgatgacaatgttgtagattccagggctttttgagaaactgcttttaaggagaaggcatcttatgtatttatctatgaaatgagcgggctgttttggcctgaggtttttgcatggagacaaactgattacataagaggaaggatccttcataggcagcccaaggtagaaatttttatagttaaacacaaatgaattaagcatgttataaaaactccaacttaaagttttcaaaatacaaatgacaagtgccaggaaaatattccatgtagaaataccaaaatgtccttttacagaatataaatggaaatataaagacatttgaactattgtttttttcacttttggaagtccttgagagataggagggaacacattttcctgggtttaaagtctcctaataaaagagcacaattgcatataacgatgtaatcaactacttattgcagggatgtagtcaaacccatatctgaatagcctttcaccccgtcagggtttagtgccctgaatgcttatacctgcgattcaggaacttgacctgccggcaaatacatttaatcgtgggttgtcttaacaatgcttgtactaataaaaacagactgaaaagaagaccgagacctggtttgggtcccttgcatcagctttttcacctgaccataaacattgtggccttcaacatctaatgaatgagaacatgtaatccagtttaataaagttttgtttgatagtctttcaaatgccttggggagggtttgtagcagacttgttcatctggctaaacctgttcttgggtaatcatagagcattgaggttgttttctcctcatttctcatttctagacaatgccttttaaaattacctgttctctcattgcatcctccccaccctgcccgcctgttgtttttaaatgaatgtatctgaagccagcaaaggtgttttttttttttctttccctttaaggcccaggtagaacagttaggacagtttttctaaattacttctcttatgtaatagctttttttggttttctttctgtcctcctcctccctctcggaccgttgatcagaggactttaaaaaccacacaacagttgatgacataaaatactctttaaatgattgtcgttttacaggcagaatgtgaagcaccctagcatttctttggaaaataattgtaattgctttaaaatgtcaagttaccttatgttttaaaaataatttaggcaatgaaaacagcctacatctgagtttaattacttcttctggatttttagattggaagtgcttctttaacttgggttgcaaattgaacctaagcaaataatagtcttaacaaaatagaactttttaagtaatctgagatgacagagtagatgatatatcagtttcttaaaccagaagtatagcattcaagtcttctaagttcatatactttgatttctttatcaggaaatcgcatataaataatacaaagttctgtcttctttgtgtgattagacaatactggaaacatttgcttctattctagggaataattatattttatttatatctgtacatacatagtatagcataaggcctgtagaagcaccccttatagatgtggatgttcgcatgtattatttgtagtatgtgtgtgtatacatttatcatgcctttggtgagaaataattatggctgcttctaggtaacaatgtcaatgagtggtgtatttccaattcaaaatatttgtacttttaacagcatttaaatgaacattgtactgaaatttgtatgcctcatgatgtctacaaggggcggaacacattgctattactctaaagttgctcccaagtatactgttttgtctttataaatcaacatgactgataaactgtctattgcaaccagtattatatgctcacataccttacttttttctttaatataatgaacatttaaaataatgtctaagtttgcaaaggtttgaggcaagttgaaatcagtaggaaaatatattgactgtatcttcaaacaaaaatttgtagaaatttaaaaagttcttaccagagaaaaagttctgaaaaagtaaaccatgaactcaacacagatgtttgaagtcctagcggttcccttcatgtgcgtggatatacacttaaccttagagaatatggaaaagctgttgggaaatcagggtacggtaacgtttctagattttttctttcttttttttcccccgtttcagctatctggaacagggcaagaaattagcatttgtacaaagaaagtctttgaacaacac

SEQ ID NO: 73641 - DNA, 3571 bp, Homo sapiens
gatttttagaagcaaatctaatatgagcctatttcagagactaaatttcgtaagtctcaaatgatgggaaaaatctaattattattgaattgcatgaaaatattttcctcttgaaataagagcccattttgagcttcaaggactcttaagttctaagagtttagattaggttgaaataatttattctactttaaaagtttggattgtttaggttcgcagaacaagatacaagattttaagttctttgaggccagaaaccaagtcttatttgagttttgcaaggcatttagtacaggttacaccttcactaataaacagtgactttaattctcatgatattttagctttatcagatattgattgagttgtcttttagtcaccaggaaggaaaccgatgtgtaaatttgctgcaataaacttttaaaacattatctaaaataactattttaagataaatattttatcagtgatttttattcttttgttagaagaatctatgtagaacattttagggaaaggccttggtatgtctattgaatgtgttcagcagagcagagaaacttcccattccattgtgataggttcagaagtcattcagaggggggaaaaaaaaggacaattttcagtttgttgctgaggatttttaaaatggcttacaaacatgttccactaacccactgaaattcacttaccctgggggaaaggagctatcgttaggtgatacctgggaattggcaatacctgaacagtgctcaggaccccacaggccccacagaggctggcactgccaggttgtgctctctgtttcagatcgtctggggttcaaggcttgctgtgagtccattaagccattccttagctgaccttcgcaagtggctttagaatctggaaatgaatttgaacaatatgtatgtgttccttaaatcgttcaaagagagtgtattagtgtttgctaatggaagatttaagtgagacattaaggaaaagtggcagaccaggattcttaatgtggagctcatcgttttgcttctaactctacggggttattgtgaggaagcgagataatgagaagtacctcgctctggagtatgtgctccatggctgctggtgcctgctcccttttccttttaccggtaatgtttctgcttaacatttttgtaaagtatgttaatgactttatcagcgtggatagtatgcatgtttaacttgaacatagttttcaaagattagagattctagcaaaatactcctgtaatttaaaaacagaatgagaaaacacatactttgagataaagtgggagcttgttttctgtgctgtacaaacttgtcacttttttctttttgcctttggaaagtttcacgttaacagcatgagaacttaaaaatacagttgatgttgaaagagcttaactaaatattttaaattggtggtattggaaagagattctgtaaaaatccaattaaacttttgaaagctctatcctgttgaaatataacttaaaggaagtcagtttggtttcccagaagtactgtgcatagtgtttctggctgaggaagaaaggcccaagtctgctgtttggccagaaattgggtaccagtttcctctacgatgttttacttgaacggtgttgacacttgaacaaatcccatagaaactgccccaagtggggggatagttgtccttacttttatggtaagacttggccccagtaactaacattccagacactggtagtattcttggctgaatactctatagatgtgcataaattgagagcaaaaccccaaatgttttagaaactttaatggctaccgtatttcaagcaatcagtaaagtaaactttaaaaaatactggtgcagtttattgcttcatagccaataaaaatagtgaacaaaaagagtctagtgtcccttgtttcttacataaactctgaaaattcagttctgctatttaattattaaattcaaaagactagaatgatttcttttaaaattgggagcactataggaatttttttccttgtctcagacatcagaaataactttttctttccattaaatgacagtaaagtatttaaccaatatgtttgtttctgtggtttatttttcacagggaacaaaaactaatagtactgtgcaaaaattttttttgtgatcaatttacatctacaaatgtgatagctatatttactactggtgttaaaatatttctatatatcagacattttatgtgattgtaagtgacagaacgtgatttatactttgttttgtaaatggcttgagtgtcttaggttaaatttctggttagaatctactatgaggggagaaaaaacttctagaattgagatgttcatttttaaagtggattgataggaaccagaaagggaattaaaacaaaaactgtctgggtcagaggcagaggagagaagagaggaagtatggcacagcaatccataccatgggaaatgtaggtgaactctcaagggaaaaaaaattgggaccactttcatgtcgtctgttttggcactttcttctttgtctgagagtcagagtggttatcatgacaacaaaaatatattaaccacaaattgtagaaatctcagttgatgaggacagggtcttttaaagtttagactgacttggttaatcctacaacttcctgaacatgatactgctaaattaggcagaaaggttgtgcagtttctgtttcgtcagaactaaacaagtgttcaaagcaactctgaggttcctccctttcagaaggaaacatttttttaagggaatttaagaggtgaaaaagtatctatataaaactcagcagtaagccagtaatactttaatatacaaatttatctcacgaattcttataaaaaattcatagaaaattataaaatcataaatgtaggaactgctagttaatgctcactgaaagaacgttttggcatttattcctactggaatatatgatctccagtaggattcttcacaaacagagaattaagactacattatgaatatttagtggttttgaaagttaaacagctggcaagctttggggagcattaggaataatatacattacaggatgggagggaggaacataccaactcaatactcaagggaagagaactgtgaaagaatggaatgggtaggttgaacaatttcagacttttagatgtatattacacatgtaagctccatgaggccaactgtttttattttgttagccattgtatcacaagtatttgggacagttcctggcctataatagatgcttggcgaattgtttatggaatgaattttgggtgtaacacatgacaaagaaaaactaaatacaagtcaacaaatgtcagtttttacagttgtttcatggtcttttttttttaccaatgtgaagttatcagtaccagactattttgcttcaatctgcaaaaggaaggtgtgtgaaggtgtgtgtgactctcaaagagtgaatgccctaatagtccattttggaggccatgttttcaagtgaactgattgatgagctgcaagcttctgtctggctaatttagaaacatctaggaccag

SEQ ID NO: 73642 - DNA, 2029 bp, Homo sapiens
aaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaagatgtatgtggtgcttttcttctttacctgcaataaagagtctgatcagggcggttagtgagaaatcaattccacacatttgtagaggagccacattgaacccgtacctacataagacggggatttattttttgagacggagtctcgctctgtcacccaggctggagtgcagtggcgcaatatcggctcactgcaacctctgcctcccaggttcaagtgattatcctgtctcagcatcccgagtggttgagattacgggcgcacgtcaccacgcctggctaatttttgtatttttagtagaggtgggctttcaccatattggccaggctggtcttgtgaactgacctcgtgatccacccacctcagcctcccaaagtgctaggattacaggcgtgagccactgcgcccagctgggggatttattttttaaattagcataaagggagtcataattcacgaatac

SEQ ID NO: 73643 - DNA, 1044 bp, Homo sapiens
caaaacccactttaatctaatagccaagtgttaaagctcctcagttactcaaaatctacttactggcagattgcaggagccttggaggaggtaaggtcttggcatttttttagtgagtcttgccctaggtccctggtttctaaatctggccaggtgtcatcattggaggaactagttaaacatctgcattcctggcaccattccagcctcggtgactcagaatttggggtgtgctgcccccagcctccaaagagtacagcaggagcctcaggaatttgaattttaacaagtgttccaggcaattctgatacctgggcagatagtccaaacatttagtgtaaattccttccagggtcggcaaagggacaagggagaaggatgagttcaaattttggcagagattgggagtgagtctgactatccgtccatgttgtctatgtatttttactcttctctttagagcctacattttcctccctgccttccacggttgacttgtagactgactctaaaggacaaggacttgctacttcattggtatcagaagcaggaatttctatgaaaatgaatagacctgaattcttttatcttacaatcctggaattgttaggaatcttaaaggtcacttagtgatcttatttagtgggacaccttagatatccaaaggacaagcaatgacatcaagattagcaactcacataattgtggtgagccacccagggcaggccttccctgaggcttccagcctgaagtctccagcactgcgagcggagagatcagaaagtcaggagtaggcctacgctgggagagaagcagggggctgcgcacaggaaaatgaagggagatcagatggtatatggagagcaaagagggagtggaagaggaatgtgggtgagaacaatcttccagtgcactcaaacacaaaggaattcacttacttactccccaaacacctgcgaattatctccttagaacctgatctgatgctaaccacaggtcttgccctcaaggagctctcaatctagtgggatagacaaataccca

SEQ ID NO: 73644 - DNA, 1611 bp, Homo sapiens
ccattgttgattgaattagttatagtaactcatatttattttagcaactagctaatataaatgcaaactcttcttatcaccagatgattgataggcacattaagaagttgttcaacaggttgcttggtttgaagaaatgtttaaatcctgatgggttacctttttatcagcaaagagtgggaattagcacagataagcccatagtaacaaaattttattttcgaagtggaatgttgtcagttctttatatttgattttgcttgaagcagtagattctatcagttcctttttatagatttaaatgtattttggaggtattgcttttctattgttgactggagaaggtatcctataaagaatattatcaagcagctgaaggtgatgaagtatctgttggcactaatctgactttccttcttctttctgttttgtttttgcataaaacgtccattttgtaaaggctttcaggcacttgaactaagttagccccacaaatgcctaacatttttttcactggtaaaagtactgttttgattcttttttttttttttttttttttttttttgggacagagtctctctgtgttgacacgctggagtgcagtggcacgatctcggctcactgcaacctccgcctcctgggtgcaagcgattctcctaccttagcctccaaattagctgggattacaggcacgtgccaccacatccagctaatttttgtattttcagtagagatgggatttcaccatgttggccaggatggatggtctcgatctcttgacctcgtaatccgcctgcctcggcctaccaaagtactgagattacaggagtgagccaccaagcccggctaattttggtatttttagtagagacggggtttcaccgtgttggccagactggttttgaactcctgacctcaggtaatctgccagcctcagcctcccaaagtgctggcttgagccactgcgcttggcttcttcttcttctcctcctcctccttcttctttttttttttaaatggaaacatgagcacaatagggtaaggtaaattgccgatggctatccaataggtgagtgacaggattaaagttcataggtcctcatccttaatctggtcattggtgcataggcccagcagggcttcttaacaactggctgtgattttcattataatatctcttcctgaggacataggtactttagtgataagcactagagaaaggtctaaatatggacatgatgggttagtcaaaagaaatgactgaaaatttcttcttgattggaaactgaataatgttcctagaaaattctgttgaagccgggtgcagtggctcacgcctgtaatcccagcacttttggaggctgaggccccgggggggatcaccttaggtcaggagttcaagaccagcctgaccaatatggtgaaactccagtctctactaaaaatacagaattagccgggcatagtggtccatgcctgtaatcccaactagttgggaggctgaggcaggagaatcgcttgaacccgggaggcagaggttgcagtgagtggagattgtgctattgcactccagcctgggcaacaagagtgaaactccatctcaaaagaaaa

SEQ ID NO: 73645 - DNA, 1973 bp, Homo sapiens
ctgggtggttgaggcaggagaatcgcttgaactcgggaggcgtatgttgcggggagccaagatctggccactgcacttcggcctggttaacagagttagactctctcaaaaaaaaaaaaaaaaaaaaaaaaatacaactcgcttagagtcacctgctagaggtttctggttatttggagatttgctggctctgccatggacatgatggcatattcgtggatgatatggagagtgacaaaatggctgagtgtctaattattaatcaaatcacagattcatatctctctccccctcctccactagtttccttggagacacagttttttgtcaattttttgaattgcattaatattaactatgactttgaatcaggaagaatgcaaaatatctgaagagtagtatttatatcttccacgtgacatttgcatcacatggataaactttaaaaatgttcttgagaacacgggaaaataaggaaatagagttcaaaaataaagtatagaacttgttagactagtttctgtttaaaactcggtggattatacctctttgttttaaaccattagaacagcaatgattaaatatcagattccttaaagagtcaccagttccttttggaaagttttgattaaagcattgtatttattaaactgttctacccacacatctttccttcaagatgttgtttttcccacgtctactgttttattacatgacagttattgaaaggttagatgtggtttaatttctcaaggtttatttttatatgtcataaatcaagctttgtttttttaatactttacaagaagcagtgtggtctgttcaaagggggtgccgggagacctgggttctatttctgactatgacatgtgactgggtaagtcgatgaattcatcagtgtctcagtctcccttgccatgtaatggggataataatatctcccttttacctacttcacagtttttttttaaaggattaattagttgatgtttgcaagtcactctgagctcctttgataaaatacaaagcaccattatttatgacaataataatagtgtctcgaccagtacgtttcctttcatccaaggatggcaaagtactttaccactgggattgcagctttacagcagattactgtgtggtggctggctctccctgaagaaacagatggtaatgagcagtctggttttcactagagagtaattaagtctcccaccaactcattgaatcatttgcataaacttcccaagacagaagtgcagctcccgaaagagctgggagaagctgaattgggctctcatccctcattactatttataaacaagtcacaggggatgtggatcttggaatatcaatattttcaacccttaaatcgatatgctgaaaggttgctaaagcatgggaatatttagacaacaggtaaattaggttcaacaaaaacatacatgtaagaagcgtgggttacctgagggtatttcaagttgtgtagaccaattacgtacaagtcctgtgatctctccttggcagtctggttagactaactttcagttaattgacaaagacgaattaagtgcctgactcgtgtgcctgtctcgggttattaagaagaaaagtgtgcgatgtggtccctgccctcaagttgtttacaacgtatttgagaagatgaaactaagatacaggaaacaattagtggagtatggaagacagcatataattaagggctaaattgtgtggaacagaccacaggacgttgaaagaaggaagtggtctgtatggaccagtgtagttcaggaatgcttcaccaaacacgtgaattaaagaagcacattttccatgtactccataaatatatagacctactatatacccacaaacattcaaatttttgtttgaatgaatatatctatatagaatatctatatagaatatctatatagaatatatagaatatctatatagaatatctatataga

SEQ ID NO: 73646 - DNA, 1036 bp, Homo sapiens
gatgtaattagattactttgtttctactttcaatctctcttttttcttttccttctttttattgtattttatttttatttatttatttattttttttgagacttagtttcactcctgtttccaggctggagtgcaatgacgtgatctcggctcattgcagttcaagcaattcacctgcctcctgagttcaagcgatttgcctgcctcagcctcccaagtagctgggattacaggcatataccactacgcccggctaattctgtacttttagtagagacagggtttcactgtgttggtcaggctagtctcgaactcctgacctcaggtgatctgcccgcctcggcctcccaaagtgctaggattacaggtgtgagccatcgcacccagcctcttttttcttttatattctctctctctccccactgccccaccccctgaggtggtgacaaggtggaagaccttaaatggccaaattagacaagatggaaataccgtcctggcttagttcgctgtaacttccctatatgactccactgtgcagccaggacctagaaatacctgtcctgttactaacctatcatttaaatggtttagtgtgatttaatcattcattctctcccaacagcttaacatgcagtcactatcgtggtttcttatcaatatgggacaccaatgaatgcttttgaattcccagtgttttgggaaactcttggcattgcgtccagctgcctgaggattgactctacggtctgcattctttttttttttttttttttttttttttttttttttttttttgagacagagtctcactctgtcacccaggctggagtgcagtggcgcgatcttggctcaccgcaagctccacctcccgagttcacgccattctcctgcctcagcctcccgcatagctgggactacaggcgcctgccacgaggcctggctaattttttgtattttcagtagagacaggggtttcaccatgttggccaggatggtcttgatctcctgacgtcgtgatccgcccacctcggcc

SEQ ID NO: 73647 - DNA, 1022 bp, Homo sapiens
acaattcacatgattcaacatattacccgtatctctagatctctctgatcctttaaaccctttctactgattatcaatgaaagtcctcaagggtttgaggtcctggctgttttcctttcaagtatattcagaatcagcagcttcttgaatttcagaatataattttagggctgcaagagcaattcagcacccaagttttgaaatgtgatgccaacttctagtcattgtccgtcctttctccttttcttccttgcccctgtattcccgctgtctgaactctcccatgacatcaaaagtagccctgctttgaggggacaaaaactgtactcatgggacattccattttagtatttcaaatttaaatttattaggaccatatttcattttctatttttcctagagcccagcccattattgaattacaacaaatggaaaaaaatgctgagaataaactagttaaatgttatactaagaaatgcacagagaaggttgaaaaattgttatgattgtggcctctgctttgtctaaagttattttattgttataacaaagtattgcttagttttactctttttttaaaacacagaatttatgttatatggagtacaatcaatcaaaaaccccaataattgactacatttaggaattaatgttactttttacttttatgtaaaaaaagcatttcttaggttcatactttaaaaagacaaacagatttagataaatatattctggctaggccgggcgcggtggctcacgcctgtaatcccagcactttgggaggccggggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaa

SEQ ID NO: 73648 - DNA, 1018 bp, Homo sapiens
agagtttcagtcttgtcacccaggctggagtgcaatggtgcaatctcagctcactgcaacctctggctcactgcaacttccacctcccgggttcaagtgattctcctgcctcagcctcccaagtagctggaattacaggcgcctgccaccatgcctagctaatttttatatttttagtagagacggggcttcaccatgttggccaggctggtctcagactcctgacctcaagtgatctgcccatctcagcctcccaaagtgctgggattacaggcgtgagccaccacaactggcttctcggagggtgtgtgcgagtgacaattgagcccatctctattttttaacgtcccttccctgcgtgttattgtggcaggtgctgggaatatggagaattgcgttcttgtcccagtcatgtatccaacaatttatgtgactctgtggtcaggagactactttgtagtccacgtattttccatctcttaaataggggtaaattccttgtccatctgtctcttccagggtcacttcttcatgctaatctttggaagtattacaaagaaagtatcttaagcatgaatttcagcccatgtttttgtgttcctgttcttggaccattggttggtttctttggagacagcttctgactgttatgccaattgttacaaagtcatggatatcaaattacaacctatagttaatattcagcattattagaatattttaaagcaaaattcaccaaatacagagcttgtggagagaatatgtgacattgtctttcttcctgtagttcttcaacaaaatctggttttatgggggtaagatgtaatttatagccaatgatggttttctgtactgcagttaacagctatcagaagaaaaattctctagttttaaagaacttaaatttgaatgatgatgataagtgaataaatataagaaatatacttctaaagtaataaagaaatttatataaataccatccagtttgtaatagcagcagtggaaaaaaatcacagaa

SEQ ID NO: 73649 - DNA, 1046 bp, Homo sapiens
cttgggaggctaaggcaggagaatcacttgaactctggaaaaaaaaaagaaactcccaaattgcttgaacctggggggcagatgatcgagtgagcggagatcatgccactgcactccagcctgggcaacagagcaagactcagcctcaaaaaaaaaaaaaagaaaaggaatgtgatcctggttggtacaactttagtttctgctttccaactgcttcagttttcttcatgcaattatttttcatttttcatgtaaaaaataactaaaaatactttttgtaaaaatttaacttacaaaaaatatatgacacctatggaattgcctcctaaaattcactctctgccctgtacctcaaatgctactttcctcaccagaagtaaccactgataatactttgttctacattcctgatctattttctattttctctctgtgtaagtacaaacaattctatcttttgaatttcatatatgggattatatcacacatattttttctataacttaatgctttcacttgtttttttccataacagtgtacagaaatccagctaatccctttttttttttttgagacagggtctctcactatttgttgcccagactggagtgcagtggcatgaccttggctcactgcagcctcaaccttccaagctcgggcaatcctcctgccttagcctcgcaagtagctgggactacaggcatgcaccactacactcatgtattttttgtagacatggggtctttctttgttgcccaggctgctgctcattcattttaaatgctgcaaattaagtaatcaataaaatactatctactgcacttttttttggttttatcatatctctattaataaatcatttagaaactcctccaagatttcagctacaaaatatgttatcatgaactttcttatacatgcttcttcaattgctttcttttcttctagtgaattgccttaggagactcgttcttcgtatttggggtcttgggtattgactgcaaagattgaaatatgaaatgtggaggtgctacttttgacttttc

SEQ ID NO: 73650 - DNA, 1060 bp, Homo sapiens
atgttagatgagtatttaatgactttagttattattattattattatttttagagacagggtctcactgtcactcaggctggagtgcagtggtgggatcatagctcactacaacttcaaacttctggactcaagcaatcctctcgcctcagcctctcaagtagctaggactataggtgcttgtcaccacacccagacaatttttattttttatagagacagggtcttcctatgttgcttgggctgctctcaaactcctgggctcaagcaatcctcccaccttggcctcccaaaatgttggaattacaggtgtgagccaccacactcagctgaccttagtctttaaatacttattaaaccactattatttccagacattctttcaatctctgactgtctgatgctcttccttgacagatttggttctgcggttgggatgggtggagtcagtgggaaaatgccagaaactgtgtcctaaggcagtgagtgccaggtcagggccagtgtaaacaatataaaagcaggtcagagatccaaataagattggatgaatctaggaagctaaggcatgaagccaactgggttggtgtctgtgtttttgaagaggctggtggaaaggaaatcttagacttaatctcaggtccatgagagacatctgtggcagttttttattcactttaagatgctcacagtgtcatagtccctgggatacaaagatgaataggagctcatggttttgtgggaaaacagataggttaaaaaaaaaaaaacttacactttgatgtaagaagagacataataaagcaaacgtatacaacatttgcttggaataaattgtgatgactttggaaaaattctggttatggaagtttttgtttgttttttaaaagagaacacctcgaatttggcatttcagctcctcagatgtcctcaggacaaataacaccctttgatacatagaaaaaagttggatggttctattattccaaaaggatccacatcacaacttttttccagggctcatagggcctgctactctgctactctgtggaaatcttttc

SEQ ID NO: 73651 - DNA, 1091 bp, Homo sapiens
tttttctccaaatattgaatgtgaaatatcatttcaacatactctggaatccgaactagcaaacgaaggcagcctgaccaagaatgctgtgctcctgtgccgccaggcctccttcctcctggttccgattactaatactgtcccaaagtaaacagaaacttgaccctccattaacttgctgtagactgcctacaataacatttcccctaatggtactagggggaaatcgacgactcccgaaagatatttgcacattgctggagtttcttgaccttaagatatctttttggaagcatttaaagaactaaggaaagaaactgccctttaagtagaccttgtgacagaagtaggtgggaaaataatgacactgcataccaaaccttacctttgcacaggataactccctgacaaatgctatggcaaacatgctgtaagaataccatcatattcattcacctcttttgtgataagaaaggctatggatttgatatcttgaaaacctttgttttgcagggtttgctttagcagctcgcctcttactcaccatgtatagagactgaattactttggaatccgttttcatttagtgacttgaggtagagcattcagtgtattttgtgttagaaaccacaggtgggacctgtttctgtaaatgatttatttccagggatctgttcctttaattgatttcatatttacttaagaaagttctttctttgcttgccttgtcgtcccccactgagagcttttgtaaagtgcgtggctgtcataaataggctgcttccttcccagcccagtcatttctctgaggtttacctgtctttcttttattctttttttttttttttttgagacggaatctcgttctgtcgtccaggctggagtgcagtggtgcgatctcggctcattgcaacctctgcctcttgggttcaagtaattctcctacctcagcctcttgagtagttggaattacaggtgtgcaccaccaagcctggctaatttttgtatttttagtggaaacgggcttcaccatgttgtccaggctggtctcagactcctgatcgtgagtgatacacctgccttggcctccc

SEQ ID NO: 73652 - DNA, 1036 bp, Homo sapiens
attctctaacttgaccatgttaactggaaatactccagagtgttaataattttaaaatgtagattccagaaaaggaatgactttcctgatctatagtattaattctagagaacttgagatatttgtaccatttattaggctcacacactgtagaatttatataatttttttttaatcaaggaggaaggagggagagtttccacaatttcctctgtttctgtggttttgcatgtaaactagatgattagttcctgataagcagggactctgagctgcaaatctctatgtccttcaaagaaggctctggacctaataggcctgccatcatttgattttgaaaaatcaatctcagataatgaacattgctgactctagtgttcacttttctgctcttacattatttgatttcttggcaatgttgacactgttgaccactttcttcttctggaaatgcttcatttggttttcctgagaatctactctacttcttagtctttttttgtgatttttctttagtgttggttttctttgtgattcattctaatgctgttgttttttgttttttttttactcaactcactcccttgacatccatttctatgccttcaataaaatctagttacaaatgatatctttctcttgagaactagaccagtgtaggccttctccacttgaatgaccaaaggcattaaaatacacaatatgttcaaaagcttgaattcattacattcattttgtttttttttcaggatcatattttcttctgtattcgtcactacccactgaggaattcaagctggaaatctgggcatcatcctcaccctctgtctctatttcccaccatccctttcaattaataattatggtcaatcaattctgcttcctaaacattctatgggtctattcacttctcttcatcctcattgctacttccctattctggataccatcttgggcgtggattactgtaatactcctacaatcagattttagaagtctggggatgcttaatagctaaattcctttcatggggaaa

SEQ ID NO: 73653 - DNA, 1035 bp, Homo sapiens
tagattttcccacactgtggcaaatgttgacgagagggtggcaccttctgattgcctatgaaaaatgccacccagatggggaggcctgtggtttgctggcctgcttcgtccagtccgtgacagagtggtgtagctattactaccagacaggataaatcctggacagtgctctctgggcactgttgacatttgcctcgatgattcttctttcttccctttaagacggaccagtgtcttattctatgtctccttctgatatgctaaaaaccttcaatccaggccgaggtcaagtgctttctaaaaacttcctttgtaaggttcctctcttaggcagatactacatatgaaataataactaccagcagtagccaaaagaccctgtgctatattatttttatcatctcttcctcactataaaatatttgagaaatgtaattttacttttgaggcatttaaatgaggaaactgacataatttaagtgatttttctaaagccacactgcttagcaaatctggaccttaaactgacgaagccatcaaggcaatgttaggagtctagttatggctgatgtggcatacaattcatcacatttttaccagctccgtaattagaaactgggtggttatgcgtggtttactgtggtagagattgatgatggttcagttaaggatcaaagaaaaatcatttcccagttctctatccattcatattgttgtggttttttttttttttttcaaatcttcctaattttcctttttttttttttcttctttcccggagtgagtgcaagccaagaaacctttggagtgtgactttggggccaggcagtgtttcggtgccacataatgatatagtagtgcatcatcagttgctagatctgggtctccttgggtgatggagtgttcttcctggaagcctagggcaggggaaggagcccggggtcatgaacaaacctgttggtgttctatcaaattagtacaaaacttttaaaagttcttttattttttcctttcttcctatatattgaaaatatt

SEQ ID NO: 73654 - DNA, 1004 bp, Homo sapiens
gcagctccggcaatcacaaccatgactcaagaagaaaaaagaggaagagcggcatgagcgaagaggatctgctgattaaggcagtctcctttatagagtgtcccctgacgtgccaccacatcacatgcctgtctgggaaagggctaagaaaggtagttttctggactgggcacctgccttcctttcccagtggttctgctagtaaggaaataagggtaatgctaatcagataagatttagaagtctttatcataatgcagtaggaaggaaagcagtagattaacagtactgaaggcaaaccttgcttattttattttagcaaggatcaaaattttcagaagccaaaatgtaaatgttgcctttttgttaagataatttagctctggacactactaatcaatactacaacatgacactgcttcgagggctggctgggttatcaaggcaacaattagagaaaattcagattactgaagaattaaatgttgatactcactgatctcataattctatagagctatacttctagcaagaaggttactatcattattactattttggatggtgtttgagagtcaggagatgaatgtggagctgcctcattttctttaaagcaatttttcagaggtcacttaaatagctaaatccgcctccctatatcccactatgatagggacaaaaggctccaggggccccagcatttgagaacttgtagtcactagaacttttctaattgatgtccatgggtaataaatgactttgtgcagttggttgtggtatttatgctttaaggaaaagtaaacctctgatatctatcttgcagctctttgtctactgacaaccattgatctcttctcaaaaacttccagtgacacacacatgtccctcatctccacctatcatacacaaatgggatttaagaaacaaggtcactcctaaaaaaggatgttaaaaaaagcaaaaaaaaaaagcaaaaaaaaaaaaatcctttgttaactctaaac

SEQ ID NO: 73655 - DNA, 1073 bp, Homo sapiens
cataatcatctggagcccgcagcctgcctctttcatctttgagtccccttaagatgagccttgtacttagtaggaactcagtgactgtgtgttgaaagcacagagggcctggaaaccgcagtggcaggcatataaatcacatagaattaaggttcattttcttgagggttgttgaatgacggaataatttactgagggaatgttatctcctctagaggtcttaaaaaaatctcctcatcaatttgaaatgatttaaatatgatcttgcgtgtggccagaggaagtgagcagctgagctctcaggattctgtccagagcccagagctctgatctgtgatgaaaaacatcagcttcgacttctctctctttcattctttctcttcctccacttcccggtcaaccatgtttgaatccaactgacagtgataaatgaacagtaggattcttgcattttgtactttcatgaaagtctctgagtacctgaaagagagatctgggcttggggttattcaccagaacagggtccagccgttatctgaggcggtggcaggtctctgtttcttctgctatgatgactgggcacttaggagcaaatcagatggcagcactgcctccttcatctggcctgaaaaaaactgaggctgttcaaaatgtgaatgttttttggatatgcggttttctggaaatcttccaaatagggactctaaccttagcatgaatgttttttgttttttgtttttaaaggcatctgagattttgccaataattcttggacatagcccttcatgccacccatcatatgcagaggccagggggaagctttcccccttttctgctctgaatccatggcactcagtgaaaataaagggatttttgacaagggaattacattctcccatttgacagtgaaatcgtgtttctttacttaaaaggaactttgcctctgaggtctaattttcaaacagttttggaatgagatgtttaggactattaaaaatgcatctttatttttgatttctcattttgtttgggctccagaggttcctagtttgcttattatgattagctttcat

SEQ ID NO: 73656 - DNA, 1047 bp, Homo sapiens
ctacagtgctggagatctttgtttttgttagggagtgggttttctctctctccctttttttaatttgtcttccattagaaaagtattttttgattgcttgcacggtttattttgtggaaataagactctattgttctatcaggggaaaaaaacatccaccgcaataaccatttagcacaaggagaaggaagaaaggtattttggagaaaaataattcctttcccatatttctcttaagttgtatatcttggaactagttttccattataagaaacttctcttttgtttatgaaaaaaaaaaaacctctaagaagtcaaaacccataggatttgttctttttcctagctaattttcaagcaagatgcaaaactgccattaagcatctctgttccttgtccagtccaatttaaaaatatttttttagaagttacaaaagatttcaaaaacatgttaaaggactcttcttaaaaagttgactccccttgggaacttgaaaatcagctttttaaaaagtgcttctgagctgtctctgaaatttcttcttgaatagcattatactgtcttcctagcaaggagtggtttgatctagctttccaacagtgtgatgatggaggtatgagctagtcagacagtgtacccaatttgggggttttattcacagctttcattttagttcaccatatagattgtggagttagattcttctaatggagattgtttaattttctccatctagaaatattttcactgaggcacatttaacaattttcttgtatatatctcaggtgtgttagtgtttttcctccgcaaatggatgataaatttcacatagctggaggaccctcaataatattctttggaatttcccttagtgcttggtccctttgtagctgctccataaatactatagtagtccatttattggttgattatctgttagtgcaatctgtaatccattagaaaattagaaagaagggtgaggctgtccatactcaactcagctaatgaggaagaatttctaaagcaaaatatccatgtatttctct

SEQ ID NO: 73657 - DNA, 1049 bp, Homo sapiens
taaagcacccggactctccagttagaacagagcaggatcaaatcctgcctttgtacttggtgtaggactttggttatcacccatctatgaaacaggaataaattataggactttcctcttaaataaaagcatggaaatcaaggacttagcatgtgtgtctggctagtcagtgctcagtacatggtagttattgtgagtgtctgttggtcttcctgcctctctatctcttcctcccacaattttagtaaagtggtcttcctcctacaaggagtcaatcagtcccctgcactcttcagacatctgcagtcattgctagtcctgatggtccaggcttttcaatgcactcaaagactttcctacaaaacagaggaaccccagttccttatgctcaagtctccatgtctgtgtcctgcatcccagtcccacaggacattttgtgctgtcgaatccactcttgtacttccgggcctttgctcacgctctgtctggaatgcctctttctttctctgtcccttgttaaaattctactcatccctcgaggtcttgttcaaatgccacatctttcgggaaatatttttgtctaaatgtgttttgaaatcttccttggccatctagttagaattgattcctccattggccacagtctcacagcactttgcttgtaccttgggttcaactagacctattgtattttgcaaaagagttagttgctcaaatctatgtccttcctggccttctaaacaacttcagggaaggaactgtgacttcgtaaaatcaatatccacacagtgctttgctcctaatatgtgatctgtgttttacaattgaattaaaactggatatgaaatagatggcttttaaatatctgtgagtgagctgcgtccattggtctgggcagatctgttacagagcttagtaagtgagtgtggctctggcaacataacagtatagtaaagggaaaggcacaggactttccaatctctttgacagcagcctagacctcacttattccaaacccttgatgagatagcagatgggatgtgagctaa

SEQ ID NO: 73658 - DNA, 1084 bp, Homo sapiens
ccaattaagtgtcaaaggaaagctgctgggttccttaatctcactgaagtcaagtcttctgactgggcttcttaccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcagagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcattt

SEQ ID NO: 73659 - DNA, 1079 bp, Homo sapiens
aagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcagatatgccttgtatatcttacacacaatgagtgaaattgccatgggaactctgtccaactttgtcagagcatgctcttcgtgttctgttcaaaatagagtggccacttgtcatggtttagccaggatggtttaaaatataatgaagtcattttaagttgcagacaactgattccaaactagtaatgtcttttcctgaaaagggcaaaacagctgcacaggattttgcttgtactaaagaggagcatcttacaattgttctcttttctcagttatctccctcctcaacagagtgtgaacaaccatacaggtgtttattcttgttttattccagggagactgcttttaggtataactacatgttgacaagattaagtgctgtggatatggccacgtgttaaaggaatctatactcgcaataggaataagctaatgcccattttcagaaataaattaaatgctgaaagtgcctgtcagtaaaccttatgaccaatgagatattcctatacttttacacagcaataattcttaataagactgggttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagttaaaaacaccaatttatttggcgcaaaagactgaaggatatttgtttgcttgttcattttatccactcatatc

SEQ ID NO: 73660 - DNA, 1046 bp, Homo sapiens
ccaataggttcttctataccgatttcattttctaaactgtatcaggacccaggtgtcctgcattggcatctgcagggatattgaacccactcatcctgtgcagaggatgagaggaaggtgttagttccatcagccccataaaattatgaacctttttgcaactaggaacatatacagtaaacaagcaatacatcaccaacgagcattctttcagaaaaattaccatatttttgtccccaccacaagctgggtttttttccagctttctgtggctgaggggctggtgagattttttgttgttattgttgttgttgctagaattttttatagcttagatataaaaggtctccaacaaagacctttgcaatatattttaattacaaacacttgattttgggaattgcacatattaacctcacaatattactagctcatttttaaatgtctggacattctgaaataatttccggttacagaattaccctttttaggatcatcttctaattcagataatcttattctgatgaagcgagaactatgaacgttgaaacaaggacaatttgtgttggatggtattcaaaaggaattttttaaaacattaagcaacagtgtaatgattttcaggtcaaattatggcttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagttcttttctctgct

SEQ ID NO: 73661 - DNA, 1042 bp, Homo sapiens
ttaatgatggctttgcttggaagtagtgtgttccctatcactgaaagtgttgaggcacaggctggaaatacaggacagaatcattattctgaggttgcacatactttttcaagtctaagaaataattattctatattcattttcttgatttgggcccattattctaataaattgaaatgacttgaaagttctccctacccactttgctttcattatttttgctgtctgtttcagcttcttcatctgtgccaggtaattgatgaatgtattgaatgggatgcgttcaaggaaaaaaccctaagacatgatccgagaggcctccattcagataggtcttaattctttaaacagtagccagaatccacctagctctcctgtttccagctcacatttctctgcctcacagttaaatctaaatgtccttgtgaaatacctgcccaaaaccaagatatgtcaaatccattcatccacttagcagagagatagttactatgtgcagtcatggcttccttgaactattatcagtcaaataacattatttttagaaagaaaaaaagtgaaatttggttgatttttctgtaactagttcaaaatgagcccatcctgacttctgatttataattatgtataagattttgtaacagtgttcaaaatgaaatcaaaactatttctatagggaatcaggttggtttgcatgctcttagtaaacatcttcttagccttacctttgcttcaggcatattgagtaagttacttgtgtgtgaccaacaattaatttggaatttgggattataccagttgacttacgagagccatgcacgctatgggaggggagtaagtatcagtgagaaacttgctttgagaaagttaattttgcctttaatgcttcatctttttgtaccatataagtacctgatcagtcatctttttatttacaacttagtaacttaaacatatttgtaggtatttgaaagaggtacattttctagatattagcaaagaatttagaatagaaaaagaaatgctgaggagtgcctttcta

SEQ ID NO: 73662 - DNA, 1014 bp, Homo sapiens
agacttccctgcagtccccccacccatcagcctcttcttcctctctgatccaatgccaccatatggagcatagcatcacttttatcatgatttactgtatttgttggcccgtgtgtaatgttctttccaccttctcctcaagcctgaggccctccagtatgaaggctgtccttgcctggctccaagcacagcacatgtggcagcaggttcaaggcatattgatcagtgaaatgaagacatctcttccactatcctcatctattggtaggaaaactgaagcccggagtttgaatgattttgtccaaatttgcacaggagctaggattagaacttagaacttctgccgcctgactttggtggttccctttccacattttgatggctgtttcccattccttagtcaatattttcagaaaagtagaaatactcaaattcagaggatagcaagacatattttcacattacagacatctttaaacattggttacatcatttctgccctttctctgtttatcgttgttatgcctgacaaaatgtttgaagaataatggtgactactgacctgaatttcagaagctaagattttagacctgttctgtcactctctaattatgtgatctggggcaagattgagtcccttatgcctgatcttgcctgtttctttccacagggattatgtgaaaataaatggagatgagtatgtaggaaagagctttatgtcacagaaggcaggatgctacaaaatacctctgcagtattgtcactgttcacttttcttttaaatataaccacttttattcatgctttagaaagaaaaaaccaactttcataagtttcctttctcttcttctttcgacaatccatatagtattataaaagattgggattctaattcttacctccacctgatttttacgtttttggccttccctctgatccacttgatcctgaatttaattatcaggcttacattaacaccctgtctctttgcttgctctgcctagcagttcttca

SEQ ID NO: 73663 - DNA, 1035 bp, Homo sapiens
aatttttctcagttgaccaccagatcttcataaagtttcttagtaatttccctgaaactagctatttattacatttcttggcatagtacaagatttgcctaaggtaagaccagtatcctaataatacatttctttaaattagttttaagagagcaatagatagcgtgcaacgtatttataaaaaagatttaaaccaactcagaatcacacaggttttgtcacagctgttttacataagccctcagctaactaatagctaaggggctgaggaccctgctgaaatccactgtctacttgtggctgttatctctgtctaaatattcatttagtttagtcccttttatcagatgaagttctttttttgtgtaaatttatgagatacaagtgtaattttgttacatgcataggattgtgtaggtgaagtcagggcttttagagtatccatcacccaaataatgtatgctgtatagatggggttcttttgttggaagtaatggaaactaactgaatatggctgccttaagcaaaaggtgatttttcaggacataaggtaggttatatggagacaaaagtaaagaagaggatctgggcctcaggaaacacaggagccaggacagcacccagggtccagggagcaagatttaatcagcaggtacaggcctgggaggggtcagctctagttcctctgtgtcacctcctcaataatcacaatagaggaagctagagtatgattggtcctgggttaggtgcccagcccttggttacaatcctacaaagatgagatgaggtgggagtagtttcccaaaggaaaagtgttagtaccaaaaaatgatgggaaagactactctttataaattagaaccatcaatttgccctacctttaaattacctgaaagctctcgtaagggtagtagcttttccatgacaagctttaacgctttccataaggtcgtaatgccttacgttttagaaagtgaaagcactctatcattagttactaggtcctttctccttggtcttactcttagttatcga

SEQ ID NO: 73664 - DNA, 1042 bp, Homo sapiens
aaaggaaggaacaaggctgtcagaaaatccatcccaaagaagaaagcttttgagcaaagacctagaattagtaagaaaagcagagttgagctagtgtttcctttatagattgatgcacgcatagaaagacctggagatatttccaaattgactctagtaggagcatacatggatttaatacgtgtacgttatttggtcataagctagctaagatttctatgatatatactaccttgaatcttccttaggtaaatactgtgagtctagtatatggaaataaatcacctggctaggaagaagccccatgaatcacccagcctgtacttctagtaaagtgataaacacttgttatttcttagtgaaatattggccctgaaaattcagaaagtttaaagactcacgctggcaatgaagaggaagggaaagtgatagttgctgtcccccatctatcaactgggtaatttgtaggattacatgtcaagttcaacactagcttggctctggcttgggttcaacccgcaaacactgtatttgagaattaggaacagtgatttttgtgaaggtagcttagcaaataccccaatcaattaaaaaattgtgttcatcaaataagtaattaaagttcaggaaaagaagaaaagcctccaacttaacactattaaggtatgtataggtaaggtatgaaaatcagtaggttgggaaagcctatggctgttgttgagttcccaaaccagtgtttattattgagttaagatggtttaaacttttaactagcatttttctttgcatgatattgttacgagaggcagcatctgctggccttgttcatctgggaacatttcctctggagctgaagaaaaagaatatctgtataaggcaaacaaaatccactggaattgaaagtgtggtaatattgtacatacccagggaggaaacgagagtgccagggcctaagaggcccaacgacatatgttggagtggattcaggcttgctataactgcctgctaactccaagggattaaagaatggcaataagaactt

SEQ ID NO: 73665 - DNA, 1049 bp, Homo sapiens
tctgttttggaatgattttcacttattaaacaactacagagaactgggtttcttacaaaccttggttctaactggactttaagaccagttttatatccccattttttttcttgtaaataagagcaatgtatgaagcataaagggtgaaggtaatacaagctaagactgcttggatctcacaaatcctggctaaagacagaccataacaggaagctggcagccggaagtagggcgtattgttttgccggttagtgacccacaaagaggcggaggtttactagctaggctttgattagaagataacagcagttcccggaagctttaagctgtttccagtggataagtccaatcctggaagcttggaaagcaatatattcttcacttctcctttatctggctaaaattttgaattgactttactttcttcaaagtccagtgtagcacatcacttccagaatgtactcctcctaggagtacctgttcacccttccttccttccctgtgcctgcagattctgtcacagcacatttgaataacgttgtttgcttcctagagttttaaatgtggtagagtgaaggagagggcacttagacacctctttgtgcccaccctcatgggaacaggtacaaagagggctcactgaactcaggcaccataccttagataacttttacccacccttgtacctggcaagggttaggtattcagtcacttttgttggactgaatgaatgcatcagtcctgcctctgggagtcttcagagtgaacattatgacagacctgttgtcttgagagtggttaagaaggaaaaaaggaccacagatttgcaggcgtaggaatttaattgcatcatttactaagaggggttcaagttctggggattttgtattaagcaattctaaaagaaattatttataaaacatgccatttttttaaatttgcaattgggaatatgctttttcaatgactggattattcttctctgtctacagggtacatccgtccccagtatcaagggtccggggcaatcgaatgaataatcaaaagtt

SEQ ID NO: 73666 - DNA, 1010 bp, Homo sapiens
ctagtgacaatagctaacatgtattgactgcttcctaagtactgagcaccattctaaagattttatagctgttaactgatttaaacctcgcagccctaggtaataggccccattattacctccatttgccctgatgaggaaactgaggcacagagaggttaaataacttgcccaaagatgacaccgttggtaaacggtgaagctgggattcagtcaggcaggctggtcacacaattttcactcttaaccacttcatcctaattccatttgggatgataagattgcattaagttatcacagcttttctgtggtgcagatagtaaagtgggaccagtatccttcccccagcaattcatgagtgctgatgatttgtgttgggaatcaagatgttgcatcccacctccagtcaccagggggtgccactcaggtaggtttatgaaaacattgaaaaccagagtgatggtattctcttgattaactataaatggcagtcattaagatgcaaggttttgagagtcaggttctttggtgcttatacccaaagaagaaagagccgtttttgtattaagtcatctaaaaagttctcatatgcttagcaagaaagctaaattaagctctgcactgggtaaaattataaacatgctctctgctccagatgagtaagtgtatataaatagaacagttggtacacatggccctaatggtatagcttccctgttttctatgtaatgtaaatcaccaaatgtgagcatttctacctgacaaactgtcagtctcagaagagcacattcaatacatgttacacaacaaccaagattgcccttttgttcagcgtggtgttttttctttccacatccagcagttagtactaaggcctgaaccccttagttacagaacaaagtggcttagcagtaatcgagcctgtgtgaggctaagggaagaataatgaacattccctgcaagcttcctgcctagatgcaggtgcaagaatcaggaggtcatgaataatg

SEQ ID NO: 73667 - DNA, 1074 bp, Homo sapiens
tttattccctatactggcttctttgattacccacatcagaaccctggatgtcatccaaaaattgttaccttacttctgcctcacttacccccacctcacatgtacttagaccagatcctgcagatacgcctaatctgtgtccatcttcttctcactcctccctcgacccaccgtcattcctgctgtgtccatctgaatcccgctttgtgacattattgcaggtgtcctcccatggcctcctgtgccttgcattcccctcagaccaccctctgtactgctgccaaggtgatttttctggtatacaaatccgactgtgccagttccaatcttgaaatcctttgatggctgtcctttaattctgtttgagttaaccatttaccacaacacacgacacctgtaatctcctgcccctccaggctcgctaaacctttccctctggttgtctacaccaatttgtggttttgctattggacacattcctaccctttggtgctttttcatatctccagaattcccctttccttttccacatctgagaaatgtatcctttaaagtgtacctccttcattgtcctacggaaactcccaggttcactccaaagcttaattcagatgcaccatggccgtttatctgccactgcagctgtttatcacatggcaccatcatggtcaattatttgtctaagctcaccttgcagtgctggcttcttcaagtcaggaactgtgtttgaatccttgtagcatcccctcccctcacacacttcatagcacataggagcctggaacacacttaagaacttagaacagtgcctggcacagtagagattcaactaatatttgaattaatgagtaagtaataggtgcacaataaatgttggttaagtaaaagatagacaggttgtatatatggctctgagcaatagaagaaaggctgatgtggctgcacagctctgtgacccagttcccgactccttagacatttatgtattgatatgtgcatcttaatcccatcttaacatcaagcttgtctcccgcaaatacttgcaagaatctctcccctctggccatgccatat

SEQ ID NO: 73668 - DNA, 1032 bp, Homo sapiens
aattctaatgctagctatgcagttagcacagatgccacagctcaagggctctgtccctcaagactgctagcacttcagatgccagctccaaatgggatccccaagctacccacacttttgtctgtctaactagaacttgggaaattcccatgatcctgtctccagttcagtaattggtgagaacgccttgcagaacttaggaaggcatttcacttatgattaccagtttttgataaaggatgcaactcgggcagccagatggaagaaatggatagggtaaggtatcagggggaaccctgagtttccatgtcctctccaggcactccatcctcccagcacatggatgtattcaccaacctgacagctctccaaaccctgccctgtagggagttttattgaggtttcattccataggcatgagggatcaaatcattggccactggtgattgtgctcactctccaggcctctctcccctttctagaagttggaggttggggctgaaatttctaaccctgtttctggtgaggagctaaaaacctgaaactctctagggggttctgccatatgtcatctcattaacataaaccaaggcatggtcaaaggaggtttattatgaataaaaaaagatactccagtcacttaaaaaataccaaaggttttaggagctctgtgtcaggaagcagggcaaagaccagataattaattttttattatacaacacataggcagactaatatgtatattatatgctgtgtattgataaattagatggtcatttaaatagcccagactagtttatgacttctaaactaatccttaactgcaaacagcaccactgtttggtaaatatgaaactataatatttgccacacattctgtcattctagcttatgtctacttaacattttttaaaagagctgcttctttgctcttaaaataaacaaagtaaggtgttgtttaagagtgtggcatggtagtccctcaggcctggacttgagtttcaaccatggtatgtgaccttgggttaggta

SEQ ID NO: 73669 - DNA, 1545 bp, Homo sapiens
ctctggtaaccatcattctactgtggacctccatgagatcaacctttttaactcccacatatgagtgagaacatgtgatgtttgtctttctttgcttagcttatttcactgaacataatgacctcagttccatgcatgttgctgcaaatgacaggattttatactttttttaagcctgtatttatgtaagcccttcaacccttatattggtcattacctgaaaaagccataatgtaatccatccatgatttgttttgtgtggtgtggaatgattccagcaggggagcaggcctgtgtgtagccggatgatacatatgtaagaggatgggaatttcaaggtctctgctctttaacactgctctgcgtacagaatacgctaaatcaatccaactgcctgtcctgtttttccccattcagattgatgacactttgtaaacacaagccacaattaggacacagcttgacaaattagagccccagacacagtagagaactcttttgacttctgaagcagccactcatctgatacacaatcaacaccaaattttgaaatgcacagactcaaaactaaaaagaaactaaagtcacttggcaaccactgggtcatacttcctaatcagcagataattagtatggtcggttcaacattgcatttccaaaatactggttactctgggatccttgcagaatgcactctactacagctatagtgattgaagtttgtcgggttatttaacagcatgttgcaacactctggttacttcttattttaaaattaagcatttaaacatttcttcatgataaactcccctagttaggtacaatttgggagttagctgtttatttcaaatgaagaatatttcaagtcttcatcgtagtcacttagcatttagcctgtcaatgccagcacccagagaaacagtctagtagctattgttcttactttaggagaaagttaggcacaagacatggaacagccagggacacatgtcagcactgcagcatgagactccagtaagtaaggacaagatcatcaagctgagacttggatagaacacactgtgctccaggcattgttttgaactatccccattatgaagataggaaacctgaggcatagaagattagatttctcatctgtaaaccacataatcaataagtgcagaacctggatttgaaccccggcagtctggtctagagtctagactcttaaccatgttactacatagcccttccatgaagtttctatgctgatttatacatttataccacactactgtctgttacctggcttagaaaacagtagaaactaagaacatgttctgattcattaattactatttttaaacattgaaatgttaatcctttgtatgattaaattgtattgccttgtttcttaaattcccagggcaagaatgaaagagtgaaaacatcaattgattctattaatatattaattttatcatttcttttttttaattgtggcatttctattttactgcttggtaataggcagttttttaggcctgtgctttgtgtgttgtt

SEQ ID NO: 73670 - DNA, 1085 bp, Homo sapiens
ttcagaatattcctgattagttttctgcaaaattactggtgtggagaaaggaattctaaacttttacttatataataaaatagaatcctgccagtgtttagttttaaaactatctgatatatcattaatattattttatctgtacttatggaaaaacaaatgtaatacagaaaactggatgcattattttaatgctttaactctaatttaaaagtaactagatattcttaggtaaaatgattattttgtcaacctaatttttaatgttagactaagtcatgtaatatttctagataaaattctgcatcttaattaatgtgaatgaaatcacatgactaagcccaacatcagtagggtgaggaaatattttcctcctagcagaaggagagctttaggagagtgatgattactgtattaatattttagaaaagaaacactgttgcttatagaagcaattcaaatgaatggatgtatctgtttttctaatctaattcgtaagttttagctaattttagtcatgttctcttataaaaatttctagatgattctggtggttctcataacttcttcccactagactcatgtagtgacctaacttttaaaatccgtaacagctacatttgttttgtcttaatttcataatgtaaatccttattactagggtttcactctcaggaatgccgttttgttttgccaagtataatagagtagtgtttctgaaatacagagcttgacaaaaggcttattctaggagaataaacaaaatctgtgaaacatagttatattcagtctataaactcaaattaacattgattaacctctcattttgtagaaaatgacaaaaaatataatcagctattgtgtctttccccctgatttctggaattacatagctatgggctacgatagtgacaaaacacaaataaaatataaaattgaaactattatctaaataattggaaataaaatctttgagctaaaatttcatgacctttcagcagaaagtgttgcggtcttcaattctgcatccattctctattgtgttttgtatatgtaagcactattacaagtgacacagaagatga

SEQ ID NO: 73671 - DNA, 1021 bp, Homo sapiens
ctagccttctttgtgtctccagagctagcactgtatccatcagacactggttttaaacactagaaaagcattggataaaatagacaaaaatcactgatctcgtggtgcttaatattctagtggagggggtgggaggagagagacaataagcatatgattctataataagcatatgattcttctgtccctggagaaggtaagtgctgtggtggtgaagcaagaaggatgtggggactgggcagtgtggaaggtggtaggcagggtttactatttcatgtgaggtgtttggggaagaactctggtaagattacattttaggagacttgaaagggtaggaggtcaaaccacatggacagctaaaggaagagcattccaggcagaaggaataacaagtgcagaggccctgaggcaggggcttctcgcaaagagtaaatgaacaatttcactgaccaactgaagaagattcattataattccttaaaacttacagaagaaactgaacttcatagaggccaactgaatagtctagcatcaaatccctagggagaagtcagaactgaatctctttatctactcatgctttctcttgctgttataaaaattctgtttttctaagggaatctgtaaatacttgtctaaccaaaaacaaacaaacaaaaaaccatgcagagcaaatttttctttcaaaacctttgtctgctttgtacttcttttaggcataggttcttgaaatctagttatatacatatataggtatttgttctgtttaattgtttaccaaaaatgataaaatgtccatattagtgtacatgttactattggttatcataccaatttgtgtttgaatcagtttattctttcaaagtgagttttatcctggtacatacctgtatatcccatggaatattatggagccataaaaaagaatgaaattgtgtctgctgcagcaacgtggatgcagctggaggccattatcctaagccaattaacccaggaacagaaaaccaaataccacatgttc

SEQ ID NO: 73672 - DNA, 1034 bp, Homo sapiens
atcactgcaacctcttgggctcaagcatttctcccaccttagacttcaagtagctgagactacaagtgtgtgccgtgaggccagctaatttttgtatatttagtagacagaattttgccatattgctcaggctgatgttgaactcctgggctcaagtgacccccctgcctcggtgtcccaaaatgttgggattgtaggcatgagccaccacatccagcattaattttaaaacttctaatcttcaaatccattgttattttaatataatttggtttagggagaaataattatattaaatacattctctgatacataaaaaaaattcagctgttaatctcaacattacattgaaatgtaaataaataagatgtaaaatagtagagtgtttttggataaactttactattactaatattcaaagaaaatcttgggaaaaagttgtctgagagttaaaagggcactgagtcaacttattttgcaccctttgatggaaaaacttgagaatgtttgggccatgtctcttctctgctgacaagaattaagtcagctgcattgattgtgttctgagaaaaagcccaagaaagctcatgtatttggtttctaatttcagtgttaaattatttcaattttgctcttagatgcttcccataatcctggcacattaaaagatgcttcgtttttatttaacaagactagtaggtttgggacacctttaaatcctcacttcagagactaccaaagaaatattctttgactcagatatttaggtggaagtcagctctctgttagtgactaaatatcatgcctgttgtggtgctgctgatgggcaaatcagggagccattcattcttgccaggggagataaatgctgttagattgctcttttttgaaggaggtcagaaaaagctttgattgactgtgaatgactgtagataaaacctaaagtatatgctttgccattatcagcccaccagccttctaagcttcaaaaaattaaaaatagtgatcccttagtaactcagtctgtgggtatt

SEQ ID NO: 73673 - DNA, 1012 bp, Homo sapiens
ctaatacctcctgcacccttctcctgaactctgcaaaaaaaaaaaaattgttatttttgaatgtcactatttgattatcatcatcattattattacacaaagtcaagggaaatatggcaaagtattgttatcttgttttgataggaaattacagaatagctttttggaagatttaaatttggaaaataatatgttcatcctttgaaaagtagtactcatatgttatttttaaatgaatcttttctctgtccttttacctggaccgcagggttagatttcagccctcgtttattgaaaatagctgcttttctatcagtcaaccttgtacctagaattgaacctaaatgattgaaaaaaaaaatccatgtttttttttgtagaataattttttcagctttattgaggtctaattgacacattaaactttatatacttaaagtatatgtgctgatttaacatacatgtacatagtgaaatgtttaccacaattaagttaattaatacattcctcaccttacatagtttttttttttgtgagaatgcataagttctacactcctagaaaatttcaggtatacagtacagtattattaactgtagtcaccatgctgtatattaggtcctaagaatttcttcttcttctatctgcaaatttgtaccctttgaccagtatctcctcttttctctgacaccccagcctctggcagccaccattcctctctgttcctatgaattcaactttttaaaaaatcttccacatataagtagtgtcatacaatatgtgtcttctagagtaatttttagtaacataatcttgaagatgaggagggtttaaatagccactgttattgctgacatacttgttaatgaacagttcactcaaaattatcttagttacctttacctctgttatatccatttattttccccaaatgttgattaaatacctactttgttttattcattaggctttgaaattaaaaaacaaagaaaagagagccttggtattgca

SEQ ID NO: 73674 - DNA, 1055 bp, Homo sapiens
ggaaaaggggaaacccaaggtgcaagtgcttttcaagcctctacttgtgtcacatttgctaatgtcccattggtcacttcaagtcttagagccaagcccagagtcattgttgagaagtggccacatcagggcatggatacagacagacatgatttattggagggatcgttatagtaacaatctaccataggagagtatttgaaaatcagagtatatcagttcaacttcaggtgttgggttctgaaattttctccccaggattttgacacatggaatgaaactcacgtaggattccagaacacctccaactccgaggaatgacacctctaccagcagtgagctgggttacccaaaactgtctgatccctttttcattaaagagcaataaaatcttaagtgtaaatttttttcaggtgtttatagatcatctcctgttctcttacttacagaggctgatatttttttgtttctggtgtccagataactttctttggtctttaaatgggcatgccagagaatcagtccttcctaaatgggctgagatgctcaaagactgatggaggttaactagggttgatgtccctattctacatttaataaaaatagagtggaattatgcaagtatgcagataagctaatcatctgacctaatcagcaatgcagattttgaaaagcctttctaattacttcctcagcttggctgaaggtatgggtaaaaagattttcccagcatgatggtagcagatgtatttcataatatttattgaaaatattggaaagaaatcctcaattatgctcctgaaaagtacatcaaaaagatatcatatttaacatattttaaactttcattaagatacaaacataacataattagatgatcatgtaacaactctcacacaaggttttggaatctttcatacaattagactttaactttcagagccagattgctcatggttaactgcctctatcttccttgagttgtattacttactataagagctctagttgtcttggacaaaatggtactatcagaatattttcttttttcttgg

SEQ ID NO: 73675 - DNA, 1023 bp, Homo sapiens
tcccaggctcatctcgagctcctgagctcaagcaatctgccttcattggcctcccaaagtgctgggaatacgggcatgagccaccacacctgtctgacattaccttctatgtatcttgaatttctaaaatgtaatacctattaatgtttaaatgtaaaaaaatgcctttaaaggacaaagtaataatttgggactcatggtttattttcagttatcctgcacattccactaaacaatgaagaaaaaatgttgatcttataatttctggtatcatttttataattatcaatggaactcaaattttacttttatttttacttgtttgctaataatccagtaaagagttgaaaatggacaatcctaaacaggaagaattatagaagcaaagtccttaattgcacgttattgcttatattgtactgtgaacacacctgcatcttgcagtaattaatctgaattctaaagtctatttattatgttgacaaaattgttaggaaaaagatacataatggaaaatgaaaggaactacaaaaaacagaagataatgatgtaggattattcctgatggcatataaacttgctatactatctccttcttttaaaacccctcccttgagaacctaatgcctctccagctctcattccatttctctacaactctttaaagcaaaactactccaaagaactatcgagactttcagtctcctcttcctcacctctcatctgaacaccaacttacttcaggcagtcttttgtccccaccattccactgacacactgcaggtcagtgtcaacgatgaacactccctcgccaaatgcacaattctcggtcctcattttatttggtccctgagcagcatttgataccattgacaagctgctcttgaaaacacgctccacctgcattctctttaacattactccactttcctcatgaacagatgagtttccatgctgactcttgcatccctcttcactttctaacctcacaatgctcaggtgtccagtcgtccatgcttctcc

SEQ ID NO: 73676 - DNA, 1103 bp, Homo sapiens
catttaccttataccaaccacatttctaggaattggtgtcccaaaatgagcaagtccctactgtcagggaccttacattctagtagcagtgacagttcatgtgtatcagatgctacaagtgctatgaagacaaataaggcatgataagggagttggaaagttaatgggagaggggcacagctttaggtataatcaaggaaggcctctctgagaagtaagctgtgtcagtaatagctgtggaagacctttgcaaaaagagagagctgcaggttcaaagactctgaggcatgagtgagtatggcctttgtgaggaggagctgctaggaggctggtggaactagagaggcttaagtagggggagggaaggggagggtaaatgaaggatctggtaggttctcaaggcaatgctgtacagtctttggttttgttttaaatatgttgggaagccactgggttcagaatgaacaggagggtgacatgatccgttttaccttttacaaaaatcgttgaaccactgcatgctgtaaagaatatggggaaggagcagaactaggaagaactagtaaaggggactattgcagtatgggtcggatggtgggatatgagggaaggagaggaagtgagggtgacttctaggtttttggctgacctattgttctctactaagatgagcacagtggggttgagagaggaattccctttgggacgtgttaaatttgatatgcctgttccacattttaatagagcttgagatgggagttgggtgggcgagcctggaactcagaggaaagaggagacagatttggagaaataaaatttgggtaccactagggatcatctcaggagagccaaatggagaaggagaagcatggacgactggacacctgagcattgtgaggttagaaagtgaagagggatgcaagagtcagcatggaaactcatctgttcatgaggaaagtggagtaatgttaaagagaatgcaggtggagcgtgttttcaagagcagcttgtcaatggtatcaaatgctgctcagggaccaaataaaatgaggaccgagaattgtgcatttggcgagggagtgttcatcgttgacactgacctg

SEQ ID NO: 73677 - DNA, 1027 bp, Homo sapiens
ctgggcggtgagccagtagtgaaggctgagagaataaagggagcccccatttcccttcctacttcggatgtgtatttctggtatgcatgagcaaaggaaaatacgatagggaagttggattttcaaaatgctaataataaaaatacaaagtgtaatgcataaatgtagatgattgtactggctacttttaaagttggtataacgtatctggtctctgatagagaaataggttaccctacatgtcacattacgtgaaggactgtgaatgcgcatatccgtctaagctcacatgtcctgtcagttgaaccatttgtcctttcagctgtctattgtgcatctatcattatcaggcattttattgacaccaaagatacagtgttgggcaaagcagatgttgtttctgtctcatagtgcttacagtctaatgagagctactgactttccacgaaataatcatagaaacaaataactgataattgtggacagagttggactaaaatagaccagccagggagttgcccagtggaatgagtttaattataatcgcaaatagagaaagctgtatttgaccaaagtattttcatgtaggatgtcatgttctaggaagacatgtatttactgtgatgctcatggagtggtgagggtttgggaaggggtggggtgaaacttctgcaagggatgcttgactaaggacagaatggcatgcaaagatttttttaaaactccttcctgagaagtgtgaaaatgccttctagtgaggctagaacctcagcctttccaagtgtgcaaagaatagtgatctaaagcaatggcaggttgtcagctagcacagaacaccccgacatctctactgggccttggatataatatgtgatatgaagaaaaatggaatgatgtcctagaaggtatagtaaacaaacataatttagaattgagctatgagagggaggatgtcaggaaacgtctcccaaggaagacatttttccacttgatacctaaggacaagtagcagttagcccccccacag

SEQ ID NO: 73678 - DNA, 1299 bp, Homo sapiens
gtgtgggaggttgaagaactttatgcccttttttaatgctcagaatatactgagtatggtatggtaactcttgcaacaagtatgaaagtagaaatgtcatagtgagttttcccactattgttgccaggtaatatgtttccgtattgtgatagtgttgagtaagggttagaatcctagagattcatatggcctcttttctccttcatagagcactgatttcatagtattttaataattgtctatctgtcccaatggaatgaaaatgtctttatggtagaggccttattctgttttgtactcttatgccctcagttttaatcacagtgactgtctctgagcaatccttcagatatttggagaacgaataaatgtcccatagcaataagagaaaaagtaataaacgttcaagtggtaagccatgcatcgataaaatgtgtgataaacaaagataaatatatgttccatttttctccccacagtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaaggtaagagacataaacaagccttgatttatttcagcactagaggtgacttcatttttgcagtgaacaaaacctaaattgtatacaaacactacatctaaagaagttctgtgtagagcaacgtggagacaccagctgttcagccttaagtagaacacagtttagagggaactcaccctatgtttatgtaggtatatgctccagttttgcttagtgtatttttacttaccataggtcacgtaatgttagaattcagatatctaagtttgcaaaata

SEQ ID NO: 73679 - DNA, 1514 bp, Homo sapiens
tgtgattatagagctactcatgttatttctttttatcctaacagaaagcacaaagttatgtctggaatttaggcaatcaagttgaccttaacatttgacttattatagactccttttttgtttagtggaaggggccttgattttttatttgttgtttttattatataactgtatatgtctttcatcatatattttctgtcagacttccttatacctgtacttggacaattgaagcttttaaacctgtttacttgttatttactccttaattttatattggattgaaaactattactctaaccttattcagacttgacaacattaagtcctcttcaaaattcttatttttatggtcttttatgtaccacttttatcgcatatatattccttcattctactgtgatcttctcatgtcagtgattaatgaaaatttagcacttcctgaatgatgaattttgtgttgattgatgtttctgttgaacagaactttcagcacattttacccaggcagttagactaacttttgaactcctttgtaatttaaaatcttttggattgaatattttggatttatagtcaataatattttccttactctgatcagtgaatgatataaacgctttccttcagtcttttataaatatgcatcagatttttttctacctcatactggggactatttacaatctgatataattgttgtgtatctgtgggaagataatagatatagaccagtgttttttccctagagaactcagctccatttccaatcatattgcttatgttctgcttcatctactgatcagcactgaggaatttaatagtttgttaaatccttaaatctaataatttaatcccactcactggtaaagtacaactatgagagaaattaattcctaattgaaaccaagtataaaatgggtaatgctatctgtatgtcactttatacaaatcaggatatctgccatacccttttaaaaattagggagtaattacttaaacttgaattgctatttagaattccatttactacaaattattcagggatattttatgtaaaccaagaggaatttttaactccccagttatcttaccctataatgttatgacatgtagtatattattaatggaaaactgtagaatcaaggttagttgtatcattctatttaatccatttccacaacttcttatctataatctaaaatccttaaaaattctgaaaaaatacttatttagaattaaaaactgtactaaactgacatacaagtatttatagtctttataacactcagtgtaaatgttcatgtgttttactgcagagatattaatgtgttggagtatccagttccaccccaagccctcctggcggggtgctattaccttctaaaaaacctaccaaaagtttgaattcctgaatatgtatggccccagaagtttaaaactagaaaactgtgcatctctagtatttgcctgtctgcaccagatgaacatattctaatatttgaccctacagt

SEQ ID NO: 73680 - DNA, 1657 bp, Homo sapiens
atgtataatttcccaaagaaattgaatgggaatagaatgtgtaagacagcaagcaaacaaaaaagtatttcttttcttttcttttttttttttttgagacggagtctcactctcacccaggctagagtgcagtggcacggtctctgctcactgcaacgtttgcctcccggattcaagtgattctcctgcctcagcctcccgagtagctgggattacaggcgtgtgccaccatgcctggctaatttttgtatttttagtggagacagggtttccccatgttggccaggctggtctcaaactcctgaccccagatgatctgcccacttctgcctcccaaagtgctgggattgcaggcataagccaccgcgcccagccacagaaaagtatttctgtgtcattttttagaaatcagaattgaaaaaattaaacaaaaaggacaaatagaaacataaaaaataagaaaaggaataaggtaaaaataaagccaagtatcactaattataagccacgtaaatgaatgtggaatgcacaattctggctggcccccaagagttcctgtctgcttcagcctagagtacatgttttgcataatccctggaattgtgaatttgatggattttacttctgtgattaggttgtatcctgtggcacaattgtctttaagaaagggagattgtcccaatggacctgatcttatcacaggagtcttttaagggaagagagttttctcaagctggtcctagaaagggaggtctgagagattgccacattgcaaggacctgagagtagccactaaaagctgaaaacagtcccagctaaaagccgaaaggcatctgtcctacagccacaaggaactgaattcagccaataatctgtggtagtgtgaaggtgagtctttgctagttgaacctccagattaggactcagcaagctaaaaccttttttttttttttttattttagctgagtatagcacccagctaaaatgtgctggattcctgactcacaaaaactgagaataatacattgtcttgttttaagtcagtatgtttgcagtaatttatcatgtagcaatagaaaattaatacaagaatctaattccaaaagccaaaagacagagactctgagtttgaatttaaaagtatagtcatatgtggtttacacacctaaacatgaaaacaaaggttgaaaataaaggaataatgacaaatttgccctggaaatacagccattttgtttcagatcattcagattttagcacagaaaacaattgggtgaagatagttttactagtttatcaggacagtataaaaatactaaacctgtaagcattttttaaaaatagcatgaaaatatataaagcacaattcatcaaatgtaaaacgttaaaaagtcatctactacagaggtagattttaatacacctttatcaattatttttgtcaagcaggaaaagctggtaaagattaatgatttatacaacacatttaatagggtaaatggaataaacatatatagattcctgtatctaacagtttagaaaataggcattctttcaaggacatgtagtaattgcaaaaatgtatcacacaatgtacaacaaagcaagcttcatcaaatttctgaaaatttctgtcacaaaaaccatgttttctaac

SEQ ID NO: 73681 - DNA, 1034 bp, Homo sapiens
atccacaacagggtattgatatgtccttcagctgagaaaagagaagaatataggtacagttgcattttagacaaacaacacattcaatcctcagaacaactttaggagggcaggtactgttaatatcttccttccagatgagaaagagttccatcttatttcgagacataatattgataggtaaactgaggttttattctgttagctttttggaaactaagtaggggagttaaagttttcacatagtggtcaaaaaaaatgtttctgtttttcccaactgcgttaaattcggagaaggtacctcagaaaggcaggctgatcagctttctccagataacttctatctataattaagttgactgccactccattttatcagagttcatggcagaatagctactcagtgtggaacagaaatatggtttatctcacacaatgtcatatcaccctaaatttaacttccaacaaaagttaatgcttttttaaaatatgagttaattattttatcaactatctactagaggcaaatgccctaccttttgtcatgttgttctttacagttaaactatgtacatgcctgtttgtcacactgggttataagctccttgaagcaaagatggatgtatctttgctttaccgtggagtgctctccccaaagctttgcaaataattagacatgtaatagaaatagcttggattgaattaactaccatgttaactgctgctgaaatcaggttcaggtcagcagtatcccccatctattttccttttgtgcttgatcttagggggttcttccctgtcacatctcttcagtttaccaaagagaaaaagaaaaatccctaaccacgtgctaccttgattggatgtcgtgtcgtttatgtaaggcaggttaccagtttggcaaggacatttaaatttatcgtctgacttctgcagtactgtgccacgcattcctaaggcttgtatgataactggtacttcaacaaagagaaacttgtgaggctgattcaatcactcatttttttctcatgcaa

SEQ ID NO: 73682 - DNA, 1030 bp, Homo sapiens
gaggctgaggcaggagaatcacttgaacctgggaggcggaggttgtggtaagtggagatcgcgccactgcactctagcctgggcgaaagagtgaggctgaggctctgtctcaaaaaaaaaaaaaaaaaaaaaaaagtcaatattgttgattgagtgcattctaaaacaatgagactgaaaaaaaaatgaactgatcaaattactggcagaaattgagtcaactaaacctaatgagaagagccacaccatacacataattaaattagatcacatggattgtgtttatttagtcattagaaaagagatttgaaggtgcccctctctctgacccagtgctaattggaaaagcattgcggaggtgtggggcaaggatttttttgaaagagtgccttttcaaaataagatgttagaaagcctgctttgggggctgataatcagtcagcagaataggaaataagaaaagggtttttttttttttctctttcaaagctcttgcctctgaacatagtgtattatctgaacacatttacatttccataagagtgctgatttatgttatttctttttattataacaaaagcaatgtattattgtggtaagaaaaattttaagtaagttatggttaaagagtagtagcttcaccctacccacctctattcccacaaatataagcaaagtaaatggtttattgtaactgagacagtggtctgtgcatatactacgaatacacaaattgcatgttgctgtgcaaaaactgtctttcagtttctttatttactaaaaagaataacttagatgtctttctctagcaatccataactctatgccattctttttaatagctgtatagtactctgttgtatggatactagtttgtcagattccttattgatggccattagatttctatactagcagatgtcaaccttaagcaaaataagagtttaactgttttttgtttgtttgttttggccatggtttttatacgttcctattttacttaaatacctgctagagtagataaagtctt

SEQ ID NO: 73683 - DNA, 1115 bp, Homo sapiens
ggtctgcaaaacttgttaatctaatatcaaactacctattgtccattccctccatctcagtcaggtcagccttttattgctccctgtcactcatttctccctgatgtatccttgaccttcctcctgtgccctgtgtagtgccgcccactctttattttatatatggttcataattcaccctgtaacccttgtcttcaatgtcaacattactaaccacccactataaagatacgaggactggcatagatcagagcacctattttacttttctaatgtttcaggtcttaaatataatttcatatatgaaaaattccatcacccaaaccaagtacacaagagaattatgtgatgtgaacagtgttgcctggttgtcagggtgagatcttatccttaagacgactagagactaaagcacaccattggaaaaactacttaactgtggtttcaccatgtgagagcaaaagtgttccaagggagccgttctaggatctcatgtatctatacaaatcttctgtcactcagaagttagacaataacctcagccacctagaacagctctgaatctagaaactgaattaaaaacatagatttggcagcaaaaaagcaacttatttatccagcaatgatgaatctacagggggtgtgttggggaaaccacagattcaagtcagattgtaattatgtggttcataaatggaaatacccagcaagaaagaaagaaatacgtttgttggctggctttattatataatgccaagacattttccacataagccaagaaatataggaggattaagagaaaacagagatagaagaaggaatcaaaaggaaatccgttgataaataagaactattactctataatcctctcactaaattttgacatttgacaaaattcaacagctattccttataaaaatactaaaaaatagaacttatttaaaagcggattgggtattttttcccatagtcaacagtatatttaatggaaaaagtcaaaagaattttcattaaaatcagaagataagccaacaacctcctagcacaatcattattattgttttgttttagaaaagcctattcagtgtgtatatgcgatacaaaaagtactaaat

SEQ ID NO: 73684 - DNA, 1020 bp, Homo sapiens
aactgtgaaactcctgtattctctcatttaaaaaaaaaaactaatcgtgcatagtaaaaaaattgtttctccaacaccacaattgaaattgcattcttgaaagaaagtgaattcattctgctgccaaaattagtcaaatgtctacatgtttttcctttaacaataacactgtattggctcactagatgtattcctcatgactataaatggaggaaaacaatatactcctccacacacattctcatcagggttacatttttgtgggcccgtctgctttaaattttacaccaagaaaaatcttgaaagttctgagttctagttttaaaaccagaagataaattctgaatcatagactgttagcctttggaaaccacttccagggtaacttaatttcaagacgatttgataggagtgtctttttctttaagagaaatagacctctgtaaacagtcagtgcatatacactaaactcatttaacatacatgggtcactcttaattgtgtttttgtgttgctgtttatgttgtttgttcaaaaacttcatccacattcagcaaacatcctacaattagctacgacttcacctacagagacaagtagcacaatgtcaggttcctaatattcctttgaaatttacttcaaagctgggctaaacaaatcagtcagaaagcttcagccaagtagtccacccacattcaacctttttctacctaatgataattacagtctgtagaacaggcagtctctaataaacagcatcaactttagaacacagatgtctggaggggcctttttgttgccatagaaatatcttcagtccaccttgtcctcagcactaaacattatctttacattagcctcctattaagggtgtgtgtgtatgtgtgttgggctagattggaggtatatattagcccaaattataggattgctcactctgtcctgatggttataaatgattgtggtccttcattctaaaaaaaaaaatccccaaaatggagcacacaaatcttcctggtg

SEQ ID NO: 73685 - DNA, 1131 bp, Homo sapiens
gtgacttacccaagttcacagacgtgcttactgggctgccaggaagtgaaaatgattctaattcaatagctctttccagaactgcattacggcatgactttaggtgttactttatttaggagaatggtcgcacttacacaaaacattctaaagtgttctttagacaaactttctcagcacacagtaataattcactgttaaatcacaaatctttaatgttccctctattcttttaattttcaaagataatccctaattgtataagtactaaatatcccacttcactttcaatgaggtaactcactgaggtgactttcaatgcaatgatttaaagttccgtgttactttcaataagatgattgtaactaggattgctgaaagtttaacacaaggagaaacctaaaaaaaattctgtccagcaacatgaccctgagttatttggttaatgccatttcttttggagaactgctgagacatctatctgtatattctccattagtttatctaataggacacagctggtttattcagatcagttctcctgtatgtggcactgataaattatctttataattattttgacaaaaatgttggcccacaaatcaagacattatattttttcatctgggttaccccaagttttcatgtaatatgatctaacaaaagatatcttctcacttggctggtgtctaactgatacattaattttttaagcaatgctggttttttttaaaggtctgttgtctgtgtggcatctgtgtgtgccagaacatgctgtgatagtgatgaagtgatcttcatatcaagagatgggcaataaacactaaaattaaccaccgagtctaaagtcttattaattatggcattccacaaacacataaggctgtaagtaaaacagtacaagggaaataaaagggaatgacaaatttgatataatatttggaaatatattaaaaagacaaaaacctggctatcttttcaggatattcattttactatgaaatttagtaggatttgtacctaaagccgaattcaagaatagaattgtatacttactggtaaatgtttattcacaaatcaagtcatacaattctcaaaaggtagatcgcctaaattttaacaattgggtgt

SEQ ID NO: 73686 - DNA, 1067 bp, Homo sapiens
tcacagttctgaaggctggaagtccacagttatcatgtcaacagggacatgggctctctgaaacctgtaggagagaagcttccatgcctcttctagcttctggtgttcgccagcaatttttggtgtcccttagtttgtagatgtgtcactccaatctctgtctctgcttctccttgtgtgtctctgtgtgtttcttctcctgttcttataaggacacctgtcttattggattcagggcccaccgtcttccagtatgacctcttcttaactaattacctttgcaatgaccttattccaaataaaatcacattcagaggtactgagggttaggacttcaacatatcattttggagaacacaattcaacccaaaacagtatccacaaaagagtgtttaagtttatgtttttccctgggagttgcttaaaggaaggccacacagtgggaacccacacctgtgggctgataaactgtggtgatttttttaatggcctattgaagaagaaaaggcaaacttgaacataatgaactgagaaaaagaacactaaatatttatagctctagtagccctcattaaataaacaatgggcagcattttcctgagaagctgtgtggaaactattttagaaactaccttttgggagttattgtgaaggagaagtcagtagttaaaccatcagcaatgtccttattgcaacaaaacaaaaaaagcaagccctggacacatcctattctaaatcattgtatcctacagaaacataaaaggaacagaaacacgagctgatggcagagtctctggcctacatgacagagttttattgaaaaggttatatggtatttgctttggaataaagacgtagaatgaaggcacaaagacaaaatccatttccataattcagtacataaagaatgcaacttttagtttgtactgtcttattatctgaacatttttcttatttctataacttctgacatagtgtttattacattctaggtactcttcaaaaatctgtaattcttcagttagaatagggaaataaatactctcaagttcatagaaattcactgc

SEQ ID NO: 73687 - DNA, 1552 bp, Homo sapiens
ctgaaattgcttagtagatacatatacattctgagtggcacaaatgattcctttaaaactccgtgagagttgggaggaaattgagttataagaagtatagtaagtgagatatgggtaatactgggacactttctccagcagcctttgaattcctgcagagtccagtgaatttccattgtcataggcagcattgtatttccaagttccaagccaattaccattgaatcatgagaaatgtactcactctatctttgaagcagtagttcacattttagtcattgacattttattttacctcttctctgctaagagagtgaatgactcatttagaagataaaaaaaatacttgaactgtttaaaatattgatgttataagtgccataactttgaagaggaagcatgaaaattggcatttaaatgacatctccaaagattccacatcttttgtacagaataagagtcactattggagtgaacctgagatgctggatttcgaatttgtggcggaaggtctgatggcagggctgctgtgcctggctgagtaccacataaagccaccctacagaggaggcctgggggttaatattcagtctgtgctaacctggccaatcaggagccctagtgcatgatttttctggcatgtatttttctgattatctgaaaagaaatgtctggtttttacaagtttgaatgtagggttttggattagctgaagccttgcacaatacctaggacagtgcagaaagtgtgctcccagtcagtgttcactgtcttttaatttattgagcctgacaagaagtcagagatgctgtgtttctgggatacagtgtacagagaattctcattccattatctctgacatggatgatcagaggaatctgcctctctcctggttgtaagaagagacagattatacctccccacccccaacaaaacaaaattaataaacaaattgtataaaatcttacacataagattcatgtcacactgttctccctcagctgttcctccagtccaaaatcaaattcctaatttctctttggctgtgcagcttcttgattttgccagtcttttccatgggtgctgagatgttaagctcatcttcagtcctgtgctgtacctgaaatacaggaatgatctgtttatgaccaggagtatctgtagaatgtctaacatagacaactgaagggggaaaaagcaaacgccactttggtctgcaattcatatgtaaaatgtttaaggcaaagggcaagaataaagtaattttcagtgtaaagaaaatatgaaggttttactccttgaaggtaatatcagtgtaaatagaaaatagtttcattgaaactagacaataaattaattcagttaaatgcaaactagataccaaaacaattgtatgcaatagtagaaaatcctgattcttcatactgtgaaaagcatgactttttttaattaaaagattgtgtacaattaaaaaacataatgctaattattgattctgcaaccacataatagaaagcccacagattctaaagctcctctttcctttgtaatc

SEQ ID NO: 73688 - DNA, 1028 bp, Homo sapiens
gaaagggtgcaggcattgccgcagacaagtatagaatcacgtcaatactccatgccttaactaccaggaaatatccaccttggccagaccagagattcctatgcactccctcattttagaggcagaacaaaagaggataagggagactcagtcttttccctagaggcagcttgcagtaactcttagaaaccattctgcaggacattaataacaaggtgttgaagctattcctatatcaccaagagctgactagcatcatgaagtcagctgtaatgtaacttccttaagagcagagcttatgctttatgtttcttgttattcctcatcatctcagcacaggagcttatgaatcggcagggctcaataagtggtgattcattcatgtgctatttgttgtaagtgagaggctgtttgccacactggaattgagaggatttggagacgggtgcttttttgaaaaagactccagtcgttaggcttaataaagaaatatagacgggtgcaggtattgtagctgaacctggaaatgtgctatggaatgtttacttaacgcaggaaataaattacattaaaattcagtagcattagggggaaaaaacccaacaattagcctaacttttttcctcagtaaacctatttaattttacactaacgatctagtgtacatctgtgcgtaaaggcgtagtaagacagtgttactttaatgactttatcagaagtgaaaaaagggcattattaaaaatgccacttgcattaccctttaaccaggggctcattattccctctcctgctgtggaacaggggccagcgtttgactaaattggtagaattatcttggaaatacgagtttgcttatcatttaatattctctgatgacctgctgcttgagatcttttgatctgtagtgaaatctttgcatgtcactacctggcttcaaagaaaaacatttgcagttgctgtgttatggctaatgtgagaagaccatttttttttttaagcggaaagaaatatctgctcttgcaaaactc

SEQ ID NO: 73689 - DNA, 1787 bp, Homo sapiens
gtgctgctcatgtggctgagtgcctgttggctacttattttattaaaccaccaccactgaggcagcacaggtgactgatagaaggacataaatacgtatataatctttaccttatcagtgtctctcttattaaaaaatcataactaaaaattagcaatgttttgtacttgaacattcaaaagaaattttaaatgtgaataaaatctcactgttagagtataaaaatcaatgtggatgagtacatccgggatcccactcaaagggttaggatattaatgtcccaaaaggatttcataatgagaacattcaaggttatggatccagatggtagtatttagagggtctcttcaataacttctgcatacctgagcatcacatagcaggctgtgtggcatctcaatataatttctgtttttcagtgtaagcctgtgtttgaacagagcctcatcgtggtagaggatgtcatttcacctctatgttctgggttgagttttgtagctttgaaatgaactttgtggagtatgtcaaccaataacatgactccacagtcctatacatgatataatgaccaattcataacagattcagcccaagacacaggcagtagaggatcatgaaggagaagaccgtggcaattactaacattggttcagtatagaaaacctttcagaaaaagtcatgtgttcaactggattttctagctggattcactaagttaaattgtatataccttccaaaccttatagatagtttcaacctttattgattaacctaaccatggggaggatttgtcttagttctttagagttctgttttcttaattcatttcttaatctagttgcattatcatgagtttagtaaaataaacttctgctcagctcatatagagcctggcgtctcattcagaaaggatagccttttcccactgctcatgggaaaaaaaagtgaaaaagcagtctgcatttcacaataatttcttcaacttgaaataacaatctgttcaaactgtgcatgttggaggaaggcaaaaactatagcaaaccagtcagaaacttagccccagaccaatggtcaaagccaggatcgtgggttgctgtcaccagtcttggtaatctttaacaatatccatatagttctttcccctttattttttggtttcaaggtaaggtctacctgaaatatttaggtgcacaaaaaacaaaagccactattcccagcagttttgcagtgtgaataagaactccatgtcacattatttatagaaagcattttttttgtccttagagagggacatgaaaagttgtgggttcataggtattgcctaatgcctgttcatgaaaatcgattttcctccttgtgagtggagctgatgttggtattttaactcttatttagattctgcatgttggagggaaatagaacttttttttttcctttgggtttatgtgtacctcttaaatatatgacagatacaatttcattctcttttgtagcaaagcttcaagagaatcagcctgtagtgtttaatgaaatgtataatgatttaactctattagaatacaataattttaacaattttgtaatgctttaaatcaactcttgtttgaaacaaagtctagaattttggtgactttcatttttggccactttgctgggtttttcattgagaagatgcgttgggtgttatataccatataatgttcagaatcttagaactatttttagataaggagagccagaatttggaatatttcatgacttcctcatttatgacttaaaggctggtt

SEQ ID NO: 73690 - DNA, 1896 bp, Homo sapiens
gttggtgtgggtgtgtgaaagtacagggtacctgggttttctcttactagttatactgtcacacatattacttttccattgcccactatttggatggaaggtcatgaatggtataaaattagacatttgtcacaatacttcagaaggaatctgtcagtactttcaagctagcttccccatttgttgatttcactggtaataaattgtagaaacaaacgcatgagttgaacctcagagactgttcttgcttaagttccacctcataatcccatagtgctaggttttcttctcatctgttattgaggggcacaatctttttgccagttcttttgggtgtttgcatttctgaaccaatcaatcagactttagcatccaagctgtacatgatttcttatttaaaattagtagcttgcataaatataaacaatgttttttcaagtaattacatttagataaatatttctgcttctccttgacaacttattttctatgtcaaaatattaagattttctgaagttagtattgaaaatgaaagatttatccattggcattattagcgtcatacgagtactaaattatatacgaaacttttccatatagaaaattggagttatttttccgaaaactttttaacttaaaaggtagttgatataaacagatgttccaaaaacattgttgaatgacttgtcctaattgttggaagtagtaaaacctaaaaccattttttaacgtttatataatccattctaaaattgaaaataaatagaaaagttaaggttagttgaggcagagtgctgtgtctcaatgcctgcgatggtttttcccactggatgtttttcagggacatacaaataattccgagtgtgtgtgtgtgtgtgtgtatactgaagtactatacttcagcatatatacgtgtgtgtgtgtgtgtgtgtgtgtgtgtgtgtgtgtataaatgactctcttatactttatgattgttaacctgtatagaaactttgatttttctatcccaatagaacacacatattcttacatcttctggcacaaaatgactatgctttatttaattgtattttaatcttttatttaataagtataccagatagcaattttctttactgctaggggaaaaatgattaaatgcagaatgatatatttgcccatgttgcctggtatttcaaattattaaccaatcccttctattggtgttgacaaaatgctaaaaagtaatgtggggtgatagaattatgtttgaatctctgttacaagtatgcttaagtaatataaaattgtgtgagagaatggtctgtttcttcaaaactcttgagatagcaccttgctactttttataattttatagacttggcaatcgtggttacttttaggcactagtgtttttacatatgtctaaatattaattatagtacccctgaagtgagttaggaaatgcattatcgaattgtccatttatttttaactgctttttttggagaccatggtacagagtatattctttttgtttttgaattttaaaaagtagaatttgtgattaaacttgcgaagagatttttaaaatacactttatttttagaattttgaatgcacagcaaaattgagcagaaagtacagagagttcccatctacccctcatccctacacatacgcaacctccttaaaaatttcagcatcctgcacgacagtggtacatttgttacaatggatgaacctacgttgacacatcattgtgattcgaagtccatagtctgcaatagggcttactctttgtgtacattctgtgggttttgacaagtgcatattgatgtgtattcactatcatagtctcataaaaatagttttattgttctagaaatcttctatgcccttcctgtttatctt

SEQ ID NO: 73691 - DNA, 1059 bp, Homo sapiens
ctcaatattactgagatgtctcataaggaaattattcataatatgtattaaagatgggctatatgtgcctgaggaaccaccacgctgttataaactattattcaattgtattgataattttattaattgaattagttatagggagtcgaactttgaagattgttttaaagacgttctttaatggaacacttacagtgaaaatgtattaggataatggggaaagtttcaggtgttgatgtttgttattgtcagtgtttctttattctgctgaatcaaaactcataatgttagcctttaaattcttcgtctgtggtttaaatcttttaacatgttgctgtgattttacatactcgtgtatattatgttttttcctccctttactcaaagcatttcagaattttaaggttgtctttagcatttgttacaggttggcatttcttttcctgagcatcatttcatatcatttggtttgatttaatgaacacttaatgattcggtagcacccaaagtctgatttgatgagtgtaattgtacagctggttaatttgtgagtagaaaacaatactatttaaagcccttaccttatgagtcatctgatcaattcacttaaaaaaatctgttagctttcttgataaatgaaatggggtcttgctgtgttgcccagggtggtcttgaacttctggtcacaaatgatccttctgccttagcctcccaaagtggtagtattacagtcaggagccattgtgccgagcctgttagctctgtttattcatagttcatatcaccattgtgaatgtagtattttcattgacgtcagtagttttacataaggtctcttgatggtgatgaaactagtcactattaagatggagtttccttgtttggagcctcaggagaaatacccaccatgcttttttaaaatcaggggcctccatagtatcaactttatagttgatggtttagtaccttttcctgtcttaaaaaagatactgtcatggaggtggacttaaactggaaaagagtgatatagccgaaataaattatatatacatttcattg

SEQ ID NO: 73692 - DNA, 1046 bp, Homo sapiens
tttttctcagaattttagtgtcaaagtaatccttttgccatagcgtctctgttaatgactcatttgactggattttattattaaagagtttattttatgaaggtcttgtggatgctgcatttcctgacttcttgcatctttaaatatattttcttttatagtcaaaaggtatttggccttgtgaaattcttgagttgcacttagaaatctgtagacgatgctcctttgtcttctggcattgagtgttcctaatggaagggtgagaccagtttgacttctttgttcccccacataagtgaattgctcttttctgcctgaacacctgcagaattcttttttttttgtcttgaagttcagtgacttaaggatataactttttttggatcattctgtaacaatttttcctggaacactgtctgttatttcaatctgttcttcgtgttagggaaagtttatactatttttacttgaaatatttttctatccaatttttgggttcttcaggatcagcaattttcaggctctctttgttctttgtgcctcttatcttttctccattaaaaaagaatatttgtcttcctcctctgtattctttggaattaagcctttcttctacattattaattcaatttttagtcatattcctttatttttagtcatgtctcttcctttccatgctgtttttattgtgtttacgagtactgagttgataaatttttggtctccggtatgttttattggcttggtgacatctttctgttgtcttatcatttcatctttgagctcccattcgttgataatcactttttggaagtcctgtaacatgaagccttctgcttttaagctgtgtaaatgttaggagtgagtgctttttcctcctttgcatgcttgttttcttccttctctttctttcatttcttctttctttacttcctttttgtcctgtgctatgtttacctgttttccctatgactttgttttaccttgtcttgctgggcagatgttctatgtcttgtgttggttaatctttctttctgccttttcat

SEQ ID NO: 73693 - DNA, 1033 bp, Homo sapiens
acatttgtatcaactgtaaagaaacaatcatttcccccaatgaaatgacattactttaaattctctcagttgctaagaataatgaagccaagggttccagtttgagtatttgggacttctcttttatacaggaaatttacttataaaccttttttttacttggccattttctcctcagctgtctctctctgttgcatccctttctttttattctcctcctcccttcctccctcatttttgtctaggtcttaattatttagtgcccaggatcttgtcctagtgtcatagctggtgtttttccctctactgcattttgccctttgatggctgctgaagagcaagccaacaacacatagctgaagaaaagatattcctcagctctatgatcacgagcttaaggaactgtagaattaagatgtatttttttccccaaaggagcaataacatcaagttgtagaactttctctcatcatttgtctttgtgtttttcttgcaggatcaatgtgactctaagaacaaatggatgaatgaatatccatatgaagagaaaaacaataaaggttggttagtcagatgttaaaattgcattgaaaatattgctactttgagcattacttttgggcagtttattctcattagagtaccttcttgtgtgaatacgagacagaggtcagtacttacatgtgcatatctatctgtaaaatgtaatttttccttttagccccttaaaaaattatatggaagcaactcctcatttttttcctgcaagtctagctgtaattcttttccagaacttaagctggtattttaagaatcaactttcagatgaatattaaaaaatggaaaactgcttgatgcaactgatcactggtacaaaaaaagaagccagattttttttaatatacatcagttttctacaaacataattctaataccagtgccatatggtgcatgattgctgtcaaatgcagtcctatgcccctgaagtctctgcttttctcctagaagtaggatcatcatggaaaactttaat

SEQ ID NO: 73694 - DNA, 1332 bp, Homo sapiens
attgaatatgtatgtaaacctttattagttgatttttaaaatcggtgctggaaaacacaagatcataactaatgaagcagtgatttgtaaacttgaatctagaagacagaattccaaataagataactatatcagcaccaccattcaattcactcgaaacagagcaactaaattacctttgagcagagagtggaatccctggctagttagatgtctagtgtgtttctctgtctctatttaaagatacataaagggattctcagaggatctagcaacaagtatacttatgggtccattttaatacatttaaaatgtattaaacactaacctttaaagactgagaacataatagatcatttaagatgtgatgaagagcaagcaatctggtactgtagtataatataatgcctgtactctgaggtaattgtgacagagtagctgcttatttgttaaagtggatagcattcactttcactatggccagggtcacttctgttgtccagggtgtactgtctttgagttataaaggaacttgagtgatcatatgtggaaatttcaagacagaaaaagagaaaggaaagaatttaaaaatcattctctattgcttgcagctactaaagagaaacaggtgtaactggaatttctccagtctctcctctaaaaccatgagtatttacccatggttccaggcagcaatattttggtttaaaagtaatcttaaaatactttcaaaagtgtaatattttatgccttgctatttttcatgtttttcatattgaaataagcgaccaatcctttgcttttcttcacctaatgacaattgagaaacatttttgaagccaggaaaatgaggaccaaaaccatgcgtcatgagcattttgatgaggccactggcctttaaaacttctgtgctttgggaagatttactggataatttcagaaacctatttggcagagctaagtaaatttaattcggaaattgatgagctattaactgttattggaaatgtgccattttcctattttatatcatggcttgcttttgatagggattggggggaaaaactaaaggccccttagcatgaataaaattagagatgtatctgttctatcatgtggcctccatttagagaaatcttttttatttcctattcgatatctaggctgttgattaaaaagtggtaattcttacacgtatgacatttaacattttacagattgctgtataaacattactgcaattagagtaggcaagtatataaagcaggtattattattattattatccttgcttcttggagaagaaaactgggcatcaaagaggttgaacga

SEQ ID NO: 73695 - DNA, 1506 bp, Homo sapiens
acttgaatataactgtagggcaaacttgtcaggagtggagtagcagtggttctctccagagagtgcatttcttgtccctgccactttcagccttactctgtctggctagccacctcggtctcaaccctggctctttttagcatttagacttgtagctgcctaagtaaattcaagtgctgtgggttgttataggtatgctgagatagtgattttctctgacacttggagaatgatgggaataaagttgggagatgcccagttagccttttggtaacttcaggcacagcctggcattccccaggatgtcccaaggttaggggttcagggaatccgttcccatgaggggcctttcttgtgttcgtacccagctgttgaagactgccaactcttaaaggccttccacagacatagaagaaagaaatctacatgttctttaccaggcgggtattctttctatgtcacagatttgaattagctgcttatgtttcctcagaaaaatggtccagtttggcaatttgctcacccataacgggctctatcgaagtaaggcagggatagttagtagaggtcatatatttgaaaacactgtctttatgtataactccatgaaaaaaatgatgagtggttagatataatatgtgattgttttttaagtactgctagttgtaaaggaactgaagtactgcaaaatagcttaagtgtacagtgatttctttcagcacttttacctgttatgaaaattatgaactgctaagcaagtttgtttactcagaagaatgcttaaggaaaaacataactagaagcaacagtaagataacaactgaatgaaaatgttgtcagaggtttgacatttaagaattttggaggatggcttggcctgagtttccagatgatactgtaacataatatacttagttgtgctcattttaatcatgtatattgtcacatgcatttcccatcagcaatgtagcagggatgtgatataaaataggtgacattttattttatcaatttaaaaaagcagccctgcttcaggacatgaaacagtgtactcaggaatagatattgggttatatttctggtcctctgggactcttttcgttttaatagtctatgaggattatggaaagctcttgacacttccattcagacatggctgtgcacgaatgactgtgctttggaagacacatccagcacttttgggatcactttgtagaattttctaagaactaaaggttgataatctggtgagataaaaattaggtaccaagaagcatcaaatacattctgcacaattatagctctccaaggggctgaagattgtgctaaattaacagtacatgtgatacatttacatccagatgcattaaatgctagattaaacaagaaaacatgtctttggggagtttagtggatgttttaaggtctatataaaatacagttaaaggccaggaaaattcccagtgtgtcatacaagggtttgaaatgtggaaccttgaccagtac

SEQ ID NO: 73696 - DNA, 1040 bp, Homo sapiens
tatattgtcatgtaactgtatctaacatggaaatatgtgcatgcatatgtaacttacaaagatgaaaactgttccttccttattttgtaatagaagaaccttaaatatcactattttaattttctttttaaattgtgaaatacaacttaaaattttagtttaaccatttttaaatgtataatacaaggtgatgttttttcactatataagttaggctttacataaaggaattacatacagttctattagagaagcatgcaactaaaaagaggttgatttgcagatatttcacttttttggaaatgaaataactgatttttttcctcttccatccctctttatttttctacacatatattttggtacttgaagtattgctaagtttttgaacccagttttcctccaaggtaaaggttttttttttttttcttcaaaatcttgagttaattttttcatgtaatgaatttgcaatccatgtgcaatcgatctttataataaaaataggaaattgacatttcacattgtatccataattggcataaattatgatgattaataatgtcaagtttgtgagttagggtacccaaaactcaactgtttcactagagaaatcttagcaaatccaaattatttaattgtttgcattttaccaaataatgttttcagcctgttatggggactctagagaggtggttatctgacagttgtcaagtcggaggaagttaagatgcctttgtatctacctgggctcatcatttagctatatctgcagtcatttggtaatgtcatccagtcagtcaaatgtgtttcatttactttattcatcaatataatctacattatatttacgacagtgactgtttataaaaaggcagtatataaacctggacagttctaaattcccttgggtacctttcttacctcagtatatgttagtaaatgatgattatgtcctatgcagtggagtgccagaactcttgcatctgtttagactactcactgattttcttttttttttttttaactctgaacaaaccaaa

SEQ ID NO: 73697 - DNA, 1077 bp, Homo sapiens
agctaaatcttgtgaagtaagatgctatcttaaatgtcaccctgaaatgaaataggaacatggcagaatgctacttttgtggcttgtattaacatataaatgcatcctttattgtttgctataggcttctaagaagtgatactaattggcttaaatattatctgtgccatataattattttctcttggatgggggccaaaatgagagagagcgtgggaggaaaggacaggaaggtttttttctgaaacagtagaggtgttcagacatcttcatctaggtatttagaaatttaattaaggcccatcttaaggtagggtgaaatatcctcttttctaatgaaagaagttgatgtctaatgaccatatattggcagtaatagacacagagtctgaatcaggaataggaaaagagaggcaataacgtgtaacattgggcagagtgtgtgctcctgctctgctcttctctaacagcttctttcctgactgttctttgctttgtccgaaagaggtagtctctctattgtcaatgggctctgtttttggtaatcttctcatttgttttcttctagtgagtcctggctaccatactggctaaaacaaaatatgctcccactccattcctatccatgacttttattttagcctggaggttcaaatctctaaggacattttgacttttatatttggctatcagtgttctcagataattcaagacaaatagtcacttaaaaattttttaatgtgctatgaaatgatctactgtggagttttatggaggaaattcacatatacttataagaaaatacagaactttaagtaatttagaggcatctgtggagtgaatcaggctcttcctgtggcctcaactctccttcctttccatactttttcacttcagcttccttgtgcctggctctggatatgcacttaactataggtcagaggtaagatttgataagcagtgttcttaggagattaagttatgaaacttaactcatagggaaccaaacatttgatttaggaagggagctaactgcctaggaggtccttaggtgttatttatgctagaaagcaaggt

SEQ ID NO: 73698 - DNA, 1078 bp, Homo sapiens
ggaaaatctgtgaagacttagagagtgggtggtgtcagatggttcacaaggagctgatgaatgctaggccttgcggataggagtgtataggagcattctgaggcaggagctggggatgtggccgtggctggctggttaatgagtgcactggaccggtcagacatcctgggttcaagtccttctaccactagacctgttaatttaagatgaggttcttccctattaactcccatgtcacattaaagttatgaatagtaaataaaatgtttatagaaaagtaaaaaagctttctaaattgcaaaatcctatagagatttgaattgttactctcaaattaccagtcttagaaatcaaaattttaaaaatttgtgtacaatttaaaactgaagagcgtctgaagagatgctgatacttacccatttttaaggatatgaaatgacagcagatcattttaggatgaaaaattcattcccctttcaacccctcagaaatgaatttttagaatgattatgattctcttcagcttttctaaaaatttgtgagagaaagattacttctaaagaactgggtagtaccagctttttgtttggcttcattcagacatcacatttaaaaacaaacaaatgagaacaaaacaaaaaaatgtactatgaatttttcttcctcctttcttttgagacatatttatcgagcacctatttggatgccagctcctgcaatggggatcaaaaataatcatcattcttgcagtggtgcagataaccacattaatataaattgagtcaaccctctgtttccaagggtttctcatccacaaattccaccaaccgaaattgaaaatattaaaagaaagacaacataaatttaaaaatacagcacaactatgtatgtagcatctgcattgtattaggcattatatgtaatctagagatgatttaaagtatatgggaggatatgcataggttatatgcaaatactacatgctactgttttacataatgggctcaagcatctttggattttgatttgtggtgggagtcctagaaccaataaccgcaaatactgagggattactgta

SEQ ID NO: 73699 - DNA, 1055 bp, Homo sapiens
tttttgctagttatagatattcaaattctaatagcataaagcatttttttttcccctgggatgttatcgtccctaagttttacatgttttaaactaagctgtaaatttagcttgaacaattttaataacatttccaaagatgtatcttaaaaaggaatttaaaagaaatactgagcttttgaagtcaaacacaaccccctttcttacaaaagcagtcaacttactttaactgaacatttctttgtcctgaagttagaaataacttcagcaaaaatttctccacagggttgatattttaatgatgggaaccttaggttaatatgttcattttatactagtcgtttatagtcatttgtgaatggaatggtgattgacaaatacatttgctttaatgtggagctggactataatatatatggatcaacttcaggtgttcatgtctgtctgttctccatgtcgagtacgattgtaccttctcttccctcctgcactgctttttgtcgtggatgaccaggctgtgagttcttccagatcaaagatcatatcatgttgtgtctgtagccccagcatgtagagcaatgctaggcagcagtatgtggttaataaatgttggttgaatgaatacatgattgactgaatgcatgtatgtctaacagtgtttgcaactgacagcctttttgaaaaaattattttgaatagttataagttcacaggaattccccctcccattcctcagacacaggagattccttgtctcctccctaccagttttccccactggtagcatcttacatgacgtaatacagtgccaaaactaagaaattgacattggtataatccacagatcttcttcaggatcactgactttacatgcactcatttgtgtgtcctttgtatcagttctaggcagttttatcacatgtattgatttgcatggctaccaccagaatcaagataacagatcttgtgtatgtggggttccatgcccacaaggcttcctgtgctactgttttgtagctaaccctgacccctcataacaggattttaatcatcct

SEQ ID NO: 73700 - DNA, 1616 bp, Homo sapiens
tttttctgaagaagttgctttaaagctaggatgtgaaggaggtgggatttctgtgaggtatttgaggtggaaggagtgatgtgagcggagtgctaaggaggaaaggtgtgtataagtagtctagtgtggttgtcagctaagatatctttgtggggagaaagaattttggagatgttatttggggttgtattgtgggtttatttattgtcaccctagacaactgttgcggcaatgcaaatggacaagaagggatcagtttgagaggttttctcagatagaacttgtaggacttggcaactaatagaatgggaaaggtctgggtgaaggaggggtcaaagatgatgtcaagcttttaagttgagctttggagagggcagatggaaatcagaaaagctggttttcattctggcctgctttgcagaggcaaggattattgtgagagttgttatgaacatttttgacttcctcagcttcgggaatactgttttgtatgactatattatatgtagggtgtgtatttaagcagaggggatgactccctaaaggaatcatggagaaaatgcctgttaacagctttcctgtgtaatgcattcattgtgtctaagtgagtttttccaagaaccttttagtcagtctcaagttgtttgaaaatggaaaaggtgagaatttgtaggcattctgatgttggcactgagttttttatactggaagtctttttcattcctgaaactgttcttgatacaatggaggctccccaggtcttctggaatcccaatgtcccaggccggggctgcagatggccagtgcatccactaggggtgtcagtcgtcaggagtggtgcctggtctgcatagcacagtaccgtattccatagaccagcagcacgagcacactttttctcttcctcatagatgccctccttgatggcatgaatcctgtctgtctgtgactgttgaatccctagcacctggcattatgcctgatacatgttagactaaaaaaatataaatgaagtgataatgtgtttttcccttagtctgtggctatcacatctgtcctgtttattaataaccctgtgatatacagattttgaattaacagataagttttgaaagataatgtagtggccatttattagggaaaatttgaagaaagggtcctatatatgtgatttaccatttatatattttaatgcattaaacccacagttgaatactttcatctagattgtctactaaccacacttggtctttgacatccatgagttggtgttcgagcaagccatactttttacattgacagccgtaagtcactattttatactgaattttgagcaatagctcatgtgtgaaaattgaggcatgacaggacagtgttatgtgtcagacaacagtttagtggagtcagcattaccatcttttgtgtctgtcatcttgaatgcagcactcatccaagctgaggctaaagatgtgtgaagaatttctatctttatcctaattgtattacgcttttgaaatataacattgatatttcattttttatttccccctatttccagaagtactgtccattttgtaataaatctttaaggccaaagcacaatatcattaaataaa

SEQ ID NO: 73701 - DNA, 1052 bp, Homo sapiens
cccaggctggagtgcagtggtgctatctcagctcactgcaacatccacctcctgggtccaagtgattctcctgcctcatcctcctgagtagctgggattacaggtgcctgccactatgcccagctaacttttgtatttttagtggagatggggttttaccatgttgggcaggctggtcttgaactcctcacctaaagtgatccacccacctcagcctcctaaagtgctgggattacaggcgtgagccactacacccagccgataaccccttcttcatactgaagttatgactaaactatacattacagaaaatgttaatagcaaacacttgtatagcacttatttagcacttatattttttagatgtttatatgaattatgatcttcattttgtagatgaaattaaggagcagggtatttatatagcttgaataccttcacacaataatgtagtagaggaaatattagaccaaagcattctgactcaggagattgctctgaaaactttgctattctgccctgagtgttttcttttctgttttgaaggggtgtgtgtgtgtgtgtgtgtgtgtgtgtgtgtgtgtgtgtgtaaatcagcgatctggggaatttcatagctatatctttgatttttaatttctctttcattacgctgagccgtggatgctggtgattttgatgagttttaagaaggaagagttgctgcagcaaattgaactcttaaaagcccccatcctcccacttatcaaaattttagctctacttacacaatgcttgaatttgagagtaagtcagcatcttaacatgaatgttggaagccagtttcatttgataaatatttattaatctcatcctgtgagccgtgtcttatctgaaggacagtaatcacaaaaagagaaataaaactcatccctgaactgtgtgggacaaagccagtcttttgatatataaatacttccataataaatacctacatgagaaactatactacagggcacatgaatggtgcaaaatattgtggggattcagagatggtagataatatgggcatg

SEQ ID NO: 73702 - DNA, 1038 bp, Homo sapiens
tgtttttgagatggagtttcactttgtcacccaggctggagtgcagtggcgtgatcttggcttaccgcaacctctgcctcccgggttcaagcgaatcccttgcctcagcctcccgagcagctgggactacaggcgcccgccactacatctggcaaattttttgtattttagtagagacggggtttcaccatgttggtcaggatggtctcgatctcctgacctcgtgattcacctgccttggcctcccaaagtgctgggattacagacgtgagccaccatgcccagcttgccattggtaactcttttagttgacttttgtatctctctgacatatctcccttattgtatgtcaaacatttttttttaattgtacttctctactttctggtactttcaagatgtgccatactcatacccatacaccatcttatatatctcctgcctcagtcctggaatcattcatttcatcacagagccctcgttcctcttattgacaaatggtattagaaaccaagatctgggtgcggggtgtgtttgttgccactggggtgttgcaaggcaggcatttttattatcccattttacagatgaggaatgggacatctcaaatgacagtgctagtgaaggaagagggtggggcggttgtggtcagtgtgtggagtaggggtcttgtttctgggtagcttccttttcattcctcttcagtgtgcagagtttttctctctcactgatacttttacaaggtagtttatattcctgggcattgaatcattcatctaagggcaaggtataagaaagtttgtattaatattctgactggagaaattatttattgaccatatcattctttttgttttttgcagctttgccagcaggcatagaaatgaaatattatgtattaaagaatattgtatattgttggtagcaataagaatagatgcagaattctctgcaagattgttagtaaagatagaatgctgtaggagtgtttaatgaattgaatgctctcccactcttctttcaacccacacagcaatt

SEQ ID NO: 73703 - DNA, 1067 bp, Homo sapiens
taggctatcaaaatgtggcagcaatacagctgctggttgcctcaaatttccatcataaagtttttttttttttttatttgagatggagtctcattatgtcgcccaggctggaatgcagtggctggatctcggctcactgcaagctctgcctcccgggttcactccattctcctacctcagcctcccgagtagctgggactacaagcccccgccaccacgcctggctaattttttttttttgtatttttagtagagacggggtttcgccgtgttagccaggatgctctccatctcctgacctcgtgatctgcctgcctcggcctcccaaaatgctgggattataggggtgagccaccgcgcctggcctggctttttaaagcaagcacttttctgataatttaacacttggcctggtcacctatttcctaaatcaatcaaggtgactaaggggcaaatcctcacagctgttaggcttgggtcatatgaccactgctgatgtggaggggaggggacatccttacccaagcatgtagactaagtggcatttctctggcatagaggaggactggttggagaggattctcggaagataaatatacatccagttgcattatataccatttagatttcataatgctgtggtttaaaaaccaatatatatgttaatttcttgatttttttcctgtttttcagtagttctttcctaagaaaacaatgaatattaaagtcaataatttataggagaatcaatgatagtgaagagataaaaaataaaatttaagatatataatttggtattttaagtcttatatggtatagtaaggaaaatgcaaaatattctttgcctttataggacacagtagtaatatcaaatgaaagtatctgtggttaaaaaaatcataacatttgtctaagtaatgatcatttatgttagttataatgaaacattccttcttagagtggttgcagtgtatttatgcaaactgtcacaactacagttaagaaactaataatcttatatgattcacttctgattgtaatctcttacagtaactctcttttttcta

SEQ ID NO: 73704 - DNA, 1624 bp, Homo sapiens
gcctttatgtggcctgtttttgtcaagttttgcaggatactcagtgggccctatcattctgtaaacgtaagtccttcctttagggaattaaaaacaacaacaacaacaacaacaacaaaaccaccatcaccagaaatctcatggtatccaaattgattcatttactgagttcagatggcaagcaacagtgttaggacatgtcagaggattggggtactgtttcttccaaagatactattgcagaacttactttcctcttccttttggttcctgagttcggagaatgagaatttgaagagcaagggatcccctatttggttgatgctgttcttatctccattttctctcttctctctttagctctcattctcaaatgttggattatcccacgctggaattccaattttattattattttgctcctgttttcagtcttgttctgctttctgaaagaccacatcatcattgtctttttgtcttcttatttattctttaatttttactatcatatttttaatttctaagaacattttcttgttgttctgagaataacacttttttaatgacgtcctcttatttggtgagtgcattaataatgtctgtaatctctgtgtggggcactaagcagcttcctgaaagctctgagctagtctgtgctcttctcagcagagtcacctggctgggctattatgtgttgcacccttgatggcaggaactgtctttaggcttgagtctagggctaattaggtcttccatagaaaaacctttcaagcttctgcctaccattgtagaccaggctgccagcagtttgcaatttgaatgagaagaaactggacatcttatcactctttgttccctcactctgttcttggtatgattttctcttgtacaagatgtctatggagtctctcagtggaggccctttgtttgactctgcactagcaataaactgctagacttctggggctgagaaggacagtcctccagctgtgttcacgaggatatgtggaaatctaactaattctcaagtggactgtcaatcagtcttcctcattttagctagacttttaccgccatttctggtcgtagggagctgagagtgtcccagattctgggaggttttgttggctgtgtcaggttgcttgttatttttcttcacaattggccggcctccctcattcggctttccagggtctgccaaatcatttcttccacttactttttaaccttttcagaaatcttgtgcttattgacttatctcacattctgtatctaaagaaaaatctattccatcttactttatttgaattggggagagagtgcaagtcaaggttcataatcagtctgttttctttactcagaagtcatattctagttggccatttaagtttccctttctgtcagttatttatgttttaccagggctttgttgggtttcttgacttatttccttatctattccagaatttaattccttattaaattcacattcttatgttagcaactttgggccacatgataaagctctactctcaatggtctaaaatgtgaaattaggtgttaatattctgttctctaagtatgtgtcattgctgtatgggattcccaaaacataaatactaca

SEQ ID NO: 73705 - DNA, 2114 bp, Homo sapiens
atcttttgtttctagagctagatggattttttcgtttttcttttttaacacaaaagggtcagaaatgcaaaggatgccctttgctgacacagctctgtaagagattacaagcaaaacaaagacagatttatagataatttatcagcatattgaagacaaattgaatatcatgctgcacagtaaattacttcagaacaaccccaaagtggaagaaaatacttgtaaattgcatttttaagcccttaagaacaagttctatcacttgtttaaaaaaattgttttgtaacatgaagtgcattttaattgtctgactatgaactcttgccttatgggctcagtcactaaagatgcttaagagaaaagcataaatgaatacttgattgatcataaaatcatctacaggatgctgttttaaccacttccgaaacgatctaaaagtgtacacagcttcatccctttagagacttagaaaaagtccagatacatcaaccaaatagagacaaatatagagaaaatgagagactaagttttgagtgtaagaaattaactcattttgagcttcactgatgaaaagcaagattttaaaacaagaggtgctccatgatgagtcgttttttacaataaggaatgaagcaaagcagacactctttaacatgggtgcactcaggggtcagggctatgaaagctgccagaattcaaccctgatttagcaatgagaagccagagacaggaagctgccttgtttattagaaatagggtaaccacagtctcaagacaactgaggaagactctgctggcacttttcttctgaaagcaagcactagtgcaaaaaaaccccaccaaagtatgtagtataggtgtttatatgtgactaaggcttatgtattcatatattcttttgtttacttcttaaaatttatggttagaaaggcacaacttttatattttttccagttaaaagtttcagaaagctatcatataacgtcaaggtataaaaatcatgtgtgaccttgatttctacaatactttacgtattcaaagtagttgaacctttatttaggaggatgcttccttcaaattaaagacttttgctcagagagtgccaccatgtttcagtgggaaaaggatcagattagcctcgggatacttggaagttatggcagaggttgcagagtaatttttcattatttgctagaacttgggacatcattgggattgtttttaatcacaggtgaagaaactgagaccccagagtgttttttttatctgtggtctcacagtctaggaagtatcatggaaattagatggatgagtctaattgaaagtcactgtgtgcaataactggcgtgccactttagagggcaattaggaaaaactgtagtatgcttatattaaatttttctggaccttgatttcatctgtctttggaacttagaagtttcttaaggatcatgaaatttgtcttagtgattaaaagctaggctccagaacccacctatctgtgtttgaaacctagttcctccctcagtgttacatgacctaggctaagttacctaacatatcagggcctcagtttcctcatttataagatgaccttattgatagaacttaaccttaaaggattgttgtgatgttttgagagaatatatctgaaatgcctcatttggtacctcctacataaaaagaccaaagttaatgtgaactcttgctatgatgaatgttactttattgtacaatgcctcaaggccttgattcgatagctgcatttttgtttgtgttgaaagtattggaccacacatggtaacccagggaccaaggtctagacttagcccatgagatggtactattcccctcacccttgtctactagaaaataatttctcttctggtaggaaataagtgctctatcaatagtgaagtgctttttcaggagtaaagttcaagaagttaaaacctgtgaatagagatcagtgaacattttagaaaatagaaaacgaccactcctattcaacagagtactggaaggcctagccagagcaatcaggtaagagagaaataaaagacatccaaattggaaaagaggaagtaaaattatctctgttcactgatggcatg

SEQ ID NO: 73706 - DNA, 2189 bp, Homo sapiens
attttggtaactagaagagcttaatacaaacttgcctactttcctgtataccccttccctgacatcatttataaaaatgttaaataagaccattttgagcacctgtctcctggaagtgtgcatgcttatatatctgtttctctgtcatttatccactgctttcaccatggcaaaatgtaatttttaaaactaaaactattctttggttggttactgtctgttgattgctaccaagtagagtgagtgctcaatcatatcacatcattaattcctgtggtttttttcttcaatatgtagtttcttcaatacttgaaaggcctttattttgaacattttgtggataggtacctgattagcaactgcatccttctatatagtgattagttgtaattcaggttttacatctgtgccaacaatttacacatttcctcttgagtttttaacactgtgataatgccaaacaggtctttgcttttgttatatctaatgtaataattaggtttagactcttccttaagttggtaattgtttgatttagttcctgcaatctgtttccaaagataacttagtatttacaatatttttaatacttcatagagaccaaggacaaaggtattcaatttcatatacagactctttttcatctgatgtacatgctttgcagaaaatctcacttcattttcaagggttgtatcttgttaagcaacattttttattttctttggaatactttgcaaggttgttcaaattctttcttggcaggcctgattattagtttgtacttgacctgctaaactttgagggttttcttgtaatccttggtaggagggctttaattttccaatttttgaaaagcagttagctatgtgtgtccctgtccacactgtccccaagcccctgcccagggcctgatctttttgatccttagcagatgtttatcttgggctatgggtaagttctttaaaatggtcttcaaagtacctattgtttatttgcttaaagctgtatatttcctttttaggaataatgccccatttttaagagttgactactagtgagctttatagctcccttcgaaggccagagtgatggtgctgcccagtttgggaggactatcaaagacagctatctttgatatttaaatgttaagcaaaatccaggaagagatatatattcacatataacatcaccatgattattcttggtgttttatttttatattttaattaaaactataatttatctaaagggctcataaaagcagttcctcattgtttggatcatggcttgctgcagcatcaaccttctaggcaggcccaagtcgttctcccaccttagcctcctgagtaactgggactacaggtgcgtgttggctaatttttttgatttctggtagaaacaaggtctcgctatgttgcccaggctagtcttgaactcctgagctcaagcgatcctcccacctcagcctcccaaagtgttgggattataggcctgagtcaccaggcccagcctacagaggctctttcaatataatgtatttacgagttggtaatggatatatttaataatgaagaaaaactatggataaagaaaagtgtgctggacttttagagcaagtagcttaagaaaacaagtgttcataatattcaccatctgcttcagtcgactttttgagaataacatcgtacagtctgaaacccacagatgttgggttccatatttcctcttcatagtcttgtcttctcagtgttgcctgcaggtccacgggccttactgacctgtggatgtggatggagcatataatccacaacaatccacattttctgtttatgcacctccctgctcctgcaggacctctagcctccataaagtctccctaatctttttatgtccgcgtccccaggaatgtcttctatgtacatgtgaattactgtatcagctagttaccctgaagagtcttctccatctctgtctactgcttgctccccttcttcataaaacctctgtgaggggctcatgattgagattctaactccagttagaatcctcatgtcacatgtctagagagatcgttcagagccctctacgttgccagcccttgaggagaggggaggatgttcctcaggtcacactttgtagttgcggtcccaagccacgttgctcatgcacttccctcacgtcactcctac

SEQ ID NO: 73707 - DNA, 1039 bp, Homo sapiens
gtaccatattccagacactccattaagtgctaataggtacaaaagaaatgtatgataatatataatcacttgagttgtaataaaggtagaatataatttgaagtgaagccaaatggcattgatctgccttcatctatttccaggtaaatttgcatttctagttaaaatttcttttgtagagagaacttggaggttcataaggaggtttggatactaccccagtattctatatagtatgatgtaagtttctgcggtagattgtccagttgttcaggtgggggggttggggaggaaaatttagaagatgctattcattacattacactaacactcttctgttaatatgtggagaattgttcattctttcccattggtattgatttaaaataagaaatcaccatacacagtcagacccatgaccaatcagttttctcccctgtagcttcatgatggggttgcctctttaacgtagttcactcgtatcttaatttctttaagctactacttgtttctttgaatccatttcggtttgccattcagtcatttcttttttttcttttttgagacggagtctcgctctgtcgcccaggctggagtgcagtggtgcgatcttggctcactgcaagctccgcctcccgagttcacgccattctcctgcctcagcctcccgagtagctgggactacaggcgcctgccaccacgcccggctaatttttttgtatttttttttttagtagagacggggtttcactgtgttagccaggatggtctcgatctcctgaccttgtgatccgcccacctcaccctcccaaagtgctgggatgacaggtggaagccactgcgcccggccccagtcatttcttaaaacttgatgaagttttaaaaaattttagtcttgcggattataggtttaacacctgccatatgaaatagcaattgattcattttctttatattatttgtatttgtctcaggttttaataaaatactcctgtgtgtactgttgccaggatgagatggacaaatggtgttataaaat

SEQ ID NO: 73708 - DNA, 1032 bp, Homo sapiens
ttctgcaggttttagaaccctgtttggcctcttggcagatttccttctctgggagcaagaggacacatgctgtcttcctgtaccagtttatcagagctcactgggtttgttcatccctcctgtacttccctagagttgcttggatgttttagagttgacttgacataccgaaaaagagtgcttcagagtagcaaaatgtgcacatgcatctgtgcatgcgtacacacacacacactctctctctctctcgaatgagaaaacagtagcagaagggacagtgttttacattgctttttaatcagtgattcttttacttggttatttctagctttccagcctctcagcctatagaaaatgtcttctaaataagagtaaacaggtatagattgctgggttatgtatatttctgcagtgcttctattgaaaatataaaatggggcaagaaagattgcaaagcttattaacaaggcattccttctgtttgagtctttgctgttactattggcattattaaatttatgtatgcgaccatgcataatgataactagagacatagcatgccccgtgctcttaggaaaatattttcaaaagtaaattcagcttttgttttgtaaatgaagtgattggagtttagtctttggggttcttccctcacactgcattcccccctcaatccttatactttgtatttgggccatttgactccttattccattttgcaaatagtgtattttgtggacatgtgtgttggtgtgtgcctgtttaaaaaatattttgtttggtaaccctttgggtataccaatggagcttctgtgtggccaccactagaacaaaacttcctaatttcagtgtcattaagtcagcagctggtgcagctgaactcaaagaaacaagcatagttattgactgttttctctaaaaacagcctgaacaaagcatttccttaagcagcattgagcaggatttagaacttcctatgcctcaaaaaagtcttagagagatttacggaagtacaaaggtcaacattactgc

SEQ ID NO: 73709 - DNA, 1040 bp, Homo sapiens
cagtacctttacctactccccagagattgtaatttaatgggtaatttaatctggcatgggacctacatgtcaatagttagccaatttaagtttcctgtatgattctgatgtgtggcaggattgagagccattgctttacattcttgctatcagattttagtaacagaaacctgcagcttattattatttttttaacctagcttaccttttatctgtctgatccttcaagaaggactgattaaaccaaagctagattagaaaatggagaaaaggaccctgactaaatcactggccagaacctttgaagctaatttgccatattttttatcttcacatcctcagtgcttagtaaattcctgctctgtagacgttccttccttcccttccttcttgtccctttcttcctttccttttattccttccttcaacacttattaagtgcctactgtctgttccagcactgttttatatcctgaggatataaatacaatttggaatccttcttacatttgagttggcagaagatgcctaataaatatttgttgaattgaatagaatcacagctgagccctcttggcatactgctgtgctgtgtgcttcagttcctttgtagaaattatgcctttttgatatccaggaacagtccaagcattatctgtcacttcctcatttgtctgtctttttcccctttctagtcaggaacatgccagctttagccaggcttaagccatcaggatgtagttggttaagacaggtaactttggtatcccttctccatgaatcctccataatctgtacataatctgtacaacaaacccccatgacatgagtttacctatataacaaactttcacatgtacccccaaacctaagataaaagttaaaaaataaaaaggaaattcatggccaatgtgatggtattaagaggtggggcctttaagaggtgattaggccataagggcctaatcattgatatccaggaacattccaagcattggaatggtacctggtacctgggatccactgaattatggagtttt

SEQ ID NO: 73710 - DNA, 1044 bp, Homo sapiens
aggtgggatctctaagaggtaattaggccatgagggcttctcctctcatgaatgggattaaggcccttataaaagaggcttcacatagccttcagctcctttgcccttccaccttccactgtgtggggaacaccacagtgttcctttcctccaaagaatgcagggtcaaggcaccgtcttggaagcagagaacacccctcacctgtctgacaaaccttccagccccttgatcttggactttccagcctccagaattgtgaggaaaaaaatttctctactttataaattacctaggttattttgtttttataatctaggttattttatcatagcagcacaaatgcactaagatgtgcaattatgaaaacagtcgtattttaaatatagtgaagaaagtaaatctaccttttaaaattttcttttaaaaaatataatagctttatcaaggtataatttatgtaccatacaattcccctatttaaaatgtacagttctttagttcttaatatattcagagttgtgcaaccatcaccacaattaattttagaacataagaaaacctacttttaaagtagtggtattcagggatatccggcttgttttcagtttttggctgtaaagagcagagctgcttttaagaaagtataggtaattataacaaaataattaatcttcaagttaatgtcagaattgtgtttgaaaacctttaattacactgtaattatttctcagccatttagagacactttctgctggtgtgctgggctgggaaaattttactagatgtttaaaatgcctgtcttgtgtgtatggctttttgttgttgttatatcagtgtcttactgtttttccacttttttgtgtgtagtcagagaaacaaagtacattgatgtttgtttaaaggtatgagtttcctatattgtgggaggagctataaacatacatgtggttattaaatgtagatttatgtttttgcttattaagttcacagtggaatataggcagaaaactttacatagcattgtttaatgatcagtggttctc

SEQ ID NO: 73711 - DNA, 2054 bp, Homo sapiens
ttttgcaaccatcagcaccatacatgtccagaacttttttcatcttgcaaaatggaatctctttacccattggacagtaacttctcattcccctcagcccctggtacccgttctattttgtgtctctacgaatttgactgctttaggtacctcatataagtgatttcttctggtgactggcttatttcaaattttaaagaagtttgaaaataccttgtgcaacatttgaaaaatgtctctttgatagacatttactgagtgcctactgtgggaagagaataccgtatatcaagtctgggatgcaggcatattctctcccactctctcctgacctgcttttaaacgtctctgaaggcgatttggcattgtctaatagtttaatggatagagtttttgtctcttatttgcacttaaaataatacggtacattttacaatctctaggaactcatttccagtgacgggggtaggtggttcctgtgagggaaaatgattgtctacaaaacactcatttagggatacccctataattcccaggctataaatgttttaatttaactcaggaacagagaagttatttggtatcattaatcagtacatttgaatcattactctgaatgattatgcttcatttattttgtgtcagaatgttttccacacaataatagagaataaaagtgcatcattaattacagttgagcagctcacacaaatgtgggtgtatacatatatttctatatcatcacacaattatggaaatttgaaatttaatataacaagtaatccttacaaaacagtcaaatatttaattaagtaacagtgttaaatgtatggccatttataattatgccttgtaacagttttaactaatgcttgaaaaaggttggtgaaacatttccacaagcacgtgtcttctgtttctagatgaaaacatttttagtaatatggtttttgtcttttggggtaacagttatgtgctttggagaaaagtacaattttttgaaatgggatcaagtaatttgcagagcttcactgtgacaatttatgaaagaggagactaattgtaaaaagttatacttctatgcatggaattttggcttttctccttgactgtaaatgcgcactcctcctgattaagatccactgtgtaaatctgctcttgtaggttccagaactcccatgcccctcagtaactgctttccttcagtttggctggctgggactcttgtcagaaagccactaaacaaacaaacaaacttcacatggagtcgctgcaatattacaaaaacacactgtatcttccttggtctaaaaggcagatgaaagaagccaggccaccagtttgttacatcagctgcatttattctccagagtgaagcggaggacttaatttagaagtttaataacttcttaaaagacaaacacatctccctcttatagatgagaaaatacatagacaagaaaaattaaggcagtttaactgatgctacaaggaaaattgggcagagaactaaatttgggagattcctggacaaagtaaccatgtccgagaacttgttctttctctttttgcaacaaagccaaaataatttcaacactttttaaagccaccaaacaattttcaaatgatttcttaaacactgcttcagtttattctcagaatgaatttgtgatttacagtttttatcaccattttgagtcaattgtccaaggttactcatctcacaaatgatgggggtcagaactaggatttgggacttcttgctcttaggcctgcttcattttcggtgcatcactctgagtgattcactaacttaatcacatttcatcccctgccccctaattattatactgttaattataagtttttaatgttaacttttatagtttcaaaattttgctacaggttgaagccataattcttttagtatagaatatacccttgagtatagaagaacatgaaaaagaagtgagatttgatattaaaacatgatttaatattttgtggagtactcatagtccaaatacagtgctgtagtttgaatgtgtcccctt

SEQ ID NO: 73712 - DNA, 2078 bp, Homo sapiens
tgatcctcccacctcagcctgttgagtagcggggactacaggcacgcgtcaccatacctgggctaatttttctgcactttttagacacagtgttttgccatgttacccagtctggtctctgggctcaagtgatccgcctgccttggtgtcctaaagtgttgggattgcaggcgtgagccactgcgcccggcctcaatacatctttgatggaataaattggattggatttgtctaaattaccattactccttataagacagataataatggatgatctagagatgatgcctgactgtgggccccacgcttttaaagccaggatgtttgagctcactgtgtactttgtccaacccatttcaatgttgtcagataacccaaggtaaactttgtcaagtcactcttccttatttttaaatttcatattgtcacctttgttgaaacatttttctttattttgcctgtacttgttttgctttgcttaatgtagcaacagtaattcttgtattttcttcttttcctccctcagaatttttaactaacctaactcttgccggaaggtctgtcagtgtgcctccccttccctgccccgggaaaatgctccctggctttgtttgtttaatcatggaaaaaatcctttctttcttttgaagttatattctgtgcttgctaaaggtccagttaaatcacaagagataaaagttatactgacaaccttggatgttccctgcccttttgccagaaatagcaaactagatactcatcttatacaaaaatatgtacatgttcatcttcactaaaaacaacttgtatttggtctttcttagcagagcagatgtttaagtcagcacacagtgtaaaatctggggaatagtggaggtgagggtgtcagaggggttggaaaaaaaagggttggggagaaccaagtgtggtgctaaatgaatggagaaaattgatagactattgatagaatctttagtttaatatcacataatctcttagctacctatagtataagtagtatagtatagtggagtagctatgaaagctcaagctatgttttttagctcacttatattttttcctaactgggagaaattttacatgtgaaaaggatatgtgtggattggagagaaattgtgaaggctggatggcagttggaactcctggggtcaggtgatcctcttgcctcagcctcccaagtagctgggattacaggtacgcaccaccacacctggctaactttgtttttttttttttttaagagacagggtcttgctatgttgcccagttttgtcttgaattcctgggctcgagcagtcctcctgcctcagcctcccaaagtgctgggattacaggtgtgagccagcttgcctggccgaaaatatttttctttatgtgaatttcttttgttcttgaatcaataattttgcagcaaattacttttaattaggtaacaattctttggttttacattggctcttttacaagctaatgggcatgtacagacatttttcatttttagaccaacccattgtttgagggggctggaacatgagacactatagttgtctacgtagttgaaattgatagttttaataattaaataaggtgacttattttctgacattctctggcacgagtaatataggagaataggttattgtaaatctatggaaggaggcgttccatgcctgtatgcaaagatatatatgtgtttctgctgttgcaataaataattcaataaaacagaatagattttattgagcatggatcataaactcaggggtagggatcagtgtattctagtgcctaggatgatgcgttgctcatggcagatccattgtctgttgagtgaatggttaagttgataaataacatgtctactgattgcttagtaccatgtgatgagcttcaaaggacatagaaaaaaatgtaatactattaagcatggtccttgaggtaaattaggagtagaaacaaaaatcagtacatatttagggaatgattagtcctgaaatctatagtacttaaggtaatttttataaaagacgagatgaaagaagcatcagcagtgaaaa

SEQ ID NO: 73713 - DNA, 1028 bp, Homo sapiens
atgcataacctccttcattatcaacatcccctatcagagtggtacatatgttacaattaagtaatctacattgatgtattatcacccaaaataaatagtgtacattaggattcactcttggtgttggcttttcatagcttttagacaaattcacaatgatacataaccactaatacactatcatacagaggtttttttttactgccttaaaatcccctgtgctcttcctgttgatctctccctctccctaatcctggcaaccactactccttttacatttatagtcataattgctaaaagtttagaaacaaccaagatgttcttcagtaggtaaatggatgaagaaactgtggtgccttgagacaatggaatgttattaccactaaaaagaaatgaaatattaagccatgacaagacatagaggaaacttacatgcatatcactgagtgaaagaagcccatctgaaatgtcttcatactctatgattccaactgtataacattctaggagagtcaaaactacggaggtattataaaaagatcagtttaactttttgttacttgtggttttggtgtcatatctaaaaatcattgccaagtcataggtctttaaaatttacccttgtattttcttctaagaaatttattgttttagttcgaatgtttgttctttgatccatttttaatttttgaatatgttatgaggcaagggtccaaagtcattcttttgcatgtggatttccagttatctgagctccatttgttaaaaagactcttgatttttcatacagtgatcttggtactcccgtcaaaaatctattggccatagacacatgagctcatttttgaactctgaattctgctccattgacctacatccttatgctaaaaccacactggtcttgtttcttgatgctttgtagtaagtttcgaaatggaagagtatgagctttcttactttctttttttttttttcaaggtagttttggctattctggatctcttgcaatttctatacaaattttattt

SEQ ID NO: 73714 - DNA, 1724 bp, Homo sapiens
gtgagctattatcacaccactgcactccagcctggatgacagagtgagatcctgtctccaaaaggaaaaaaaaatacgataaaaaaggcactacaagtattcactgtaacaaaaactgtactgtctcagaggttttattcctcgaggattctaaaaaagatgaggtttcactgaatataattatattgctataaacttttgaaattttatatccaaaatcccatgtgggggttttaatcatatcttgaaaaagacatgatctgaaaaaaagatgactgatctttgttttgtctggagacttgaaaaatgtgaacttttcagtctggaggatatatgatcagagtccataaaatgcagactttattgtatcaaaactcagaaatctttattagaactgagttttcccatgaaaattgaaacacattaactataaaacaagtgaaaggaaataatactacatacaatgtgtaggataactgtaaaatatattacttacatgaggcattttatactggaaatatgtagtttcaaaaatgctttacaaatgaaagatggatataaaagaggccaggcgtggtggctcacgcctgtaatctcagcactttgggaggctgaggtgggtggatcacttgaggtcaggagttcataaccagcctggccaacgtggcgaaaccctgtttctactaaaaatacaaaaattagctgggcgtggtggtgggcacctgtagttctagctacctgggaggttgaggcaggagaatcacttggacctggaaggcggaggttgcagtgagccgaggtggggccgctgccctccagtctgggcaacagagtgatactccatctcaaaaaaaaaaaaaagaaaagatagaaaagcttttctggttgtggggtggaaaggcatttactacctcctatgtgccaggcattgtgattgatcctagagattcctggcccagttcttttgcatttgaaactcatgatctagtgagagttgataagccaagtagtaatccatggcaggttacatatcaagaaaatgatgatatgtaaaggaaaatgcacagtgctatggaagtccattataccatggatcatttcttcccctccacaaatgcatattcatatactttttaaagccaagaactattttctaaattcctgcagaatgtaaatgttatagttattattaataaaaaccatcgttctttgctttctcggccaccaagggacgaaagtatagctaattcaagtagataaatgagattttaaaccttttctactgtgtctgtatatatttgtgcatgtatatgacagatatttatgagcttagtctatatataaggtagaggtgggcacctgtagtcctagctacttttgcccatctgaaatggctttaaaattatatacttagcatgtatcaaatatactaatttaaagtgttgaatacatgtttgtgttgtgtaaatatgaactagctattgtatttttttttttgcattttactgatactcctaatgaactctgaaatagttgggaaaaatagccctttcctaagaaggaatgactttcaaatgtttgtggtgagtaacatgttgaagtcagagtggttgattgctatttaaaccaaagtaatgctcatttacattagtttatatttttgtttattttacttacctagagaaatgatctgaggtttaatgtgttgaatacaggctctctca

SEQ ID NO: 73715 - DNA, 1435 bp, Homo sapiens
tgcatggtgggtcagcagatgtacctataagtcaaaaggaatatttaaaaatatatatatttggaggagcagtttgtggagttggggtctgaagtgtggggaaattatgtgttgctgctttaggaaaaagttgctatgccgttgcagacatttaactaataaaagcacatgaacatacacacacacacacacacacacaaatacatatatatatatgtatataaaattgtattttcaagtattctgtgcagttaaatgtttgggaggatacctaaacgtgtgtttaaaatattgagatgatggtctccagtgtctgaatttggtaaaacagtgaatctcagcagcatatgaagtctttggatctttgggccagggttgtataccctacaatttactgtgatttaataatggattttagaaattcaagactgttttaataaactctgtagtcaagtgtgtaattcaaccatgttgtgatttgtgcatcagttttctttctgtatttgattgttgatatgaaagtcagagcaagcttaggtaatgtggtcccagcacagatgtacagtataaaatgatcacattttcagagttgaaaggtcatgcacagatgtttgtagaaatgacactcattaaactttctaaggatgccatgtccctttgtaacccctctaagatgggaactcaaaaaagaaaccttatacactggtcataaagtccttgagaaactacctgttttgttatctttaaacgtagttcttggagattctttagagacaaaattaatcctgaacttggtattttgtatttctttttaaattgtattcatatactgcaacgtgagctaggtcttttctccttattaagacttggaaactgtagttcagagaggtgaagtaattttaatttacccaaggggaaaaaaatttggaatttgaacttggaagtgtctgacctgatgtttctaacaaatccaggcttttaactcctttgtttcaaaatgtcatgctctgtgttgagcacataataaactagattataaactgttttccacctttttggagctctctgtgcaggcatttattctgttaattctctgtcacacctgagaaggagatgcagtctgagaaattggcattctatgtatctcccttctcatttcattgtgatattcaatgatactagaaggtaatttttttcttctagtaagcagtaaccacgttgtgaaccaaggataaaaggaaaatgacactggtagagttttctcgtcataggtattacctagtttcctaggaaacagaaacatgatttatgaatattgattttcaaaagcttaaaagaaaccctaggttattgtttctgccattaaaatagtttctctgaagagatcaacttacgtaattgaatctcgaccacattttatttagtgtacatcttg

SEQ ID NO: 73716 - DNA, 1038 bp, Homo sapiens
aaacagctccaaccgaagatatggagtttgcgcttcagaattcgctggggggtgtgcttaggctacttttaggagaatattagtgactgccagtgggcaacatatccctgctcctgtgacccgctctgctgtgttagatttagagtacctttgagggcattttccgtgctgcactgctgatgatatttcttggcagctggactaacatctttgaacacacacatttttgaagatcaaatcattgttttaatttgccaccatgagacagcttcaaatgatcagctacaaggatactcctattttaagaaatgttttaattatggaaatttttcaacagctgggatgaaattgtaaagtgtcctacagttagtttcgggatacaaattttagaaataataatgtttaaaattacttataaataattttaaatgtatagcaagttgtgtgagcagcacacgtttcgcatttcatcatgtttgctccatcacatacccctctctcccattatcattggtcttttaatgaaacatttgagaacaggctttagccatgatgcctgtcatccataaatactttagagtgtgttactgcccccctcaaaaaaacaggtgaatagagttccaagggaggaagtccatgttgatatgacacaaccatccaatccataaaacctacttagatttcaacaactgtcctaaagctgtctctttgctcttatggtggtgaactcatgcaataattatatcacagtcagtggtgacgtcttttcatactcaccaatctggaacatttcctcagtcattccctgtcatgtcctccacagtttttaagtgtgcaggtctgagatcctgctgtaggatgaccctcagccagtgatgatgttggagttttttttttttgagacagagtttcactatgttgcccaggctggagtgcagtggtgcgatctcagctcactgcaaccccccacctcccaggtgcaagcgattctcctgcctcagcctcctgagtagctgggattacaggcacctgccaaaa

SEQ ID NO: 73717 - DNA, 1050 bp, Homo sapiens
cacttatacatcgcgggggaggggggaacctaacccaattttggtaatgattactagtttaagtttcaagtatgagagcctatgccctccatattttatctcctggtcaccactctttattggtttgctattgtgattctcttttcccctgctgttctgttgcttcttaaaataaatataatgaatttagaagttgtcagatttaatttggagcactatatgtatatttatgaagtcatatactaaactaggaaaaagttttcttgatagaacattattgactcaggaaattgtatactatctcaagcgatattatattttcagtctgttacattgggcaatgggagtaccattaacagaaaataagaaagctgagagaaatgtgagggagcaggagaaaaatacagtgaacagtcacatctgaattgatcaagaaagtgggtccaggttattcaaaactttggtttttgactgaaactctgtgttttgaaggacagtctttaatgattcatagaacatgcaagttaagttttactgccttatgcatctttatgaatctcagtttatgtgaatgtgcagaaatgtcgagctgtacagttacggttgaataaatgtcagataacacagtgcatgagtttaatcattcactaaatatctctgtttccacagaggaataacggtgcactactcaaaactgtctagaaataaaatatacaaatcattgaaacaatatactaaaaacatgttcaaatgtgatgactcacaagtccccaaaacaccttatctgggatacttcctaatctgtacatgcttctctattgttgcatgggatgtgtgtttgtgtgtgtattttaatacaggataaaattttataacccattattcccagtggaaaaattaagggtaattatttccatgggaaaaattattcttatctttctagtattacatttgcttttcaggatctattacaatatcaggctttacttaaccccatagacttctaacaaaacttatcatttgtttctcaattactttgtaaactgatgc

SEQ ID NO: 73718 - DNA, 1093 bp, Homo sapiens
tttttactttctgctatgtggtttatttctctgccttttatttcaaggatagagccacccttaatggtttgtcttggctttccctgatttctagtttctaatatgtagtttatttctctgccttttagtctttatattggttcacatgtgtgcgcatgcgcacaaatacacacacggtgagagagacctcacatttaagtaagtccaacatacaatgatctaagaaagtgaagagttaactttcctttttacttttatttctgtagagatattgttaccttgaaattcaacctatttctttattttaacttagtgacattgctgtttcaaattttggttggagagtttggagtagaattgattgcatagggaccctaccctagaatagttagaaaccgaactgggaatacatgtgtgcctcctaaaggcatctactatggtctgttgatgtcccaccaaaattcattatgttgaaacttaatctccaatgcaatagtattaaaaagtggggcatttgggagcttattgggttatggtgctccacccttgtgaatgggattagtgcccttataaaataattcaagggagcaccctagccccccacatcccttccaccatgtgaagacaagcgccatctgtggggaatgggccttcctcagaccccagatctgctggtgccttgatcttggacttctgagcttccagaactgtgataaataaacttctgttgtttatagattaaccagtctaaggtgttttgtcatagcagcccaaaaaatgtaagacagcatctttaattttttttttttcctttgagctcttttgaattggacctgactttcttaccaagattttaccatcataatatagaggaagcataagaaagtctttaatgaattgtttggcttggctgtgggcagatagatttgagttactacacaccttactgtctttgcaaatagagtaaaatacctaacaatagttgtgttggagcaggtgtctaatgatcatctgtttagcccagtgcagtcatctgttttctaggcagttacgttttgttgaatattattaattcatggtcttgataatccag

SEQ ID NO: 73719 - DNA, 1037 bp, Homo sapiens
tgtgatatatactgccagtttattaaaagcttctatgttgctttttagtaaaaacggatcggttttcataatttcagttctatagatacttgatagtagttgctgttgtgaatgttccccttgctctttatatttcttaagtggtcattgttggtgtgttcttgtaggaaatttccattggcttgaactaacattttatcatgttaaagaactgtctttttatttttattttactaagaattacaatcaagtatagatttacaattttatcaaatgcttttggacatcttacaattttcttctttgaaatattgatgatttgacatcatggtatgttgcttttaactaatacatgaggaagtttcccatcttttcctgtgttctagagtacttcttacagcattcaaataatctgttcttttaaaaattattacaaaatatattatctattcttcaaatgttgggaaaccttatatatctgttagcttttaaaaataatcaattacttactccccccagtgctccctgcactccagcaaagctgttttgcagtgattgatccagttaggtctcttatttaaaaaaaaaaaaattgacattaacacttaccttcaataattttctagctacttttaaatttagtagcagaaatttaaagataatatatgttaaaaatttccatgtggtagttaaaagtgattcttaatttcatatttgtatttttatatcttcaaaaactagttgatgatttatctgttttatcaactttttttcaaatatttgtgtttattacatttttgttttcgattgcattttctgtttctttttttgaagtgattggattttacacattaatttctagttagaaaatctaacatgccatttctgtgttttggattttatggaaaattctttctcataaaatgaatgattaatttacataaattttcacatatacttgacccttgaacaatatggatttgaactgtagaggtctacttatacatggattttcttccacctatgctaccttggga

SEQ ID NO: 73720 - DNA, 1065 bp, Homo sapiens
gctggagtgcaatggtgggatcttggctcactgcaacccctgcctcctgggttcaagcagttctcctgcctcagcctcctgagtagttaggattacaggcgcccaccaccatgcctggctaatttttgtatttttagtggagacggggtttcaccatgttggtcaggctggtctcgtactcctgacctcaggtgatccgcccacctcagccttccaatgtaacttatattattgaagtcaatttcaaatacacaactagaatacatcacgtcttcttgggcttcatgtagtactcatatcctatttgcagattacaaacccttgagttcttatgtttaatgttgttcttatctttgctgtatctctcacctcagtgccctcatttgagaacagggtcccaagtaaatttaactcaaccgagaccaaccagctgtgatatgattggtgaagttggcaaaaaagaatttagaatccatttatttccaggacctgtttagttgcttacccctctgagcactgtactacctgtaaagtaggaaaaatacctgttttgcatttgttgggagggttacagaaaaactctgtagaaagcatcatttcagtgtttggtataaagaaaggccagtaagatagtagatggtattgttattagacactgttcctactctcaattctagaggaagagacagaatacattgggttactatttgttattacaatctattgttagaactgtaattcttgtagcagagggagagtaatgataaagccataccagaggttctaagaatgatctgttgaggactggcctgtaagccacacgttgatgggtgggttgcatttgactgggtggagaaagaggacggggctgtccaacataggaagcaacttgagctctgggcgaggcaggaagtgttgggtgtgtatagggcagaggtccactctggccaatttagcgtacagaaatgctttctttggaaatagtgctttcaaagacttaagcctacagagaaacatgtgacatttcacttaagaaaatctagatttccaaattttcttgaaaaa

SEQ ID NO: 73721 - DNA, 1016 bp, Homo sapiens
aacacacacacacacacacacacacacacacagacaatatctgcaaagtgcagtaaaatggaatgtaacaaaataaggcatgcctgtataaagaactttttatattctgacagggtcagtaaacttgcgtaagggccagacagtaatattttaggcttttctagccacataaggtcactgtcatgcatacatatcatacacacacacacacacacagatgcacacacacacataaacgtttatttaacagccctttaaaaatgtaaaaactattctttgggagcatgcctttcaaaaacaggccatggctctgtttggtccataggtcattgtccactgacccctgttctatggtaataagttgggtgttccttttttctttttgcagaagagtcatgtatttttgctataaagaacagatattaaatatgaataacttaaaatctgagccaaaatatgattggttgaagcttatgactttctagccttaaacaaatactgaacaaatttagaaatagccaaaaaatgatctagttttctgtaatatatttgccttttttataagtggaacttttaaaaacatatctttcacaggtctaaaaataaagaggaaaacatcatcttgaggatttctttaacttctttaaaataatacatttctggtttagtaactcatagtacttttaaaagaccttttttccccattggcacaaatgtttttcaatgtgagatgttctattgaatttttaaagacacttaaacaaaaatgtgttctttagggtgaatgattaattggacttttcagattatcttgtgaaagagttttgttactaggttgtgttctcctttttcagtcacagctcatgaaacatccccaaatgcttgtagctttagaatttttcagcaggttacattagaattactttaaattctctgaaggtaaattgattatagatattttaaagatttatttaattttttaaaagaagcctcttataaggtgattcatttttgat

SEQ ID NO: 73722 - DNA, 1909 bp, Homo sapiens
tgtctactttctcttttaggatacaaacaagtaccatattgctttgagttgttacacctgttaagttttctgttttgtggcagtttcttagtctctctttttatttcatgaccttaagaattttaaggagtactggtcaggtattttataggacgtccttcagttttggttcatctgatgcttttctcatggttagactggcttagggggtattggaaaacaatatcacataggtgacgaacccttctcagtgtatcacatcggggtatcattgtatcatatcatgatatccacaagataccactgatgatcttaaccttaattacttggttaaagtggtatttgccaagcttctctactgtaatttttttccatttccttactctgttctgtggaagtgagtcactaagtcttgcctactcttaaggaataactacatatcatgtttagaattctatagattattttgttctcccccatttatttttaaatttatattggcatgggtacatgcgtatatatcttacatgtggagtcataagctaatactgtgttagtctcttatttagatttttctggttttgaccaaagaccactttcagatttgctcttgtggcccagtgacatccccttgtccttttgtttttgaatactttgttaactttctggtattacaggatactccaggctcatctcatattttccctgccacagctaccaaatcagccaatccttcaagggtctctcatttcattgtagaatgatatctagaaaccatggactgggtgctgagtgttctttttgctaccagggtagatgctgttctaattgtgaatcaagttgatcagaatcagtctttctttaaaccttatttttttaataaactgataaatagaggaaataccaataattctgtttgaaattattacattattttggctaattgactggaattttcataacttatgttgcgataagagtagagaaaatagattttttaccaaatcttgcagcaagttgattgacatttttcttacgtttgctcttggctaacttttcattatcttggttccctggtatggtgggatattagggatgttttatttgaagagtttgagtctatggatacattatattgccagcattattttataatctgctagatagtactatattaatagttaattggtcccttcagttaataatgtaaaccttgaatagaacaattatttcaggcctaattatagtttatagaagttttgaaatttctatcctagtttccaaccctaatttgaagatcatagcagtctttgatctttgtaagattaaaatactttctgaaaagttctgctatgacatcttaaactgtgtctaggaaacaatcatagccatgggaatcaacttattctcagtgaatgttcatgatgtgcaagggattgtgtttcaaatgaaagcctaaaatcttgagaggtaaggctttaaacacttaaatttcctgtaaggataaattcttagtagtttggctttctaccattcatgtaaaactacacgtgctgtaaaatgttcatggccacgtataaagaatttaaagaaattgaaacttcacttaaagcaggttcccactcgatgtgaataagagtgtttctttgtgaggaagaaaatatatctctggccttttttccctaggagcaaagaaatggtctccagtgatctgtcattgggcattgtgttaagtaatccttagtaatttcttagtaaaaaaaatgctggtgaagctttctggctatgcctcagtggttccttttcaaagaggatattagcagagaagggaagaaattaagttttcctgtttccacttttcctcatttttgggtttatctataagtttatttcatgtgggtgtaaggta

SEQ ID NO: 73723 - DNA, 4152 bp, Homo sapiens
ttttgtgcttttagtagagacgggtttcaccatggtggccaggctggtctccaactcctgacctcaagtgatccacccgccttgctgctggggttacaggtgtgggccaacatacgcggcccagtttatattttttaatagaaaaagcaaacctgctaatggatgaatgcaaattaaaaacatattttggcagctgtggtgatttccctcttatttttttctgttatcttttagagctgatggttttatggtgttttggcaaatttttatcatttgccgtatcaccaggaagttttcttttccaaaaatagattctaggatatgcttggccaatagggtatatggtgttataatgagtttacagatggtttatttgggctacaaaagcaaagaaagttgactgatgaatacaactttaaatgcactttatgtgatgctgtctaatgaaggtcttccatatttttgaaaaaatgtgtagtattttacttttaaatgatcggaattttaactttgacaaaaaaatcttttaaataatgggaatatttagtttgtattaaaatattatttaaatattaagaggaatacaattttgtaaaacgtgagaacaatggaaggaaaaacttgaaaacataaattttgcagaagatcatagttgcagtttatcagaagtgttgcttgaagggatatttagaagcttgaagtaggtggatatttcaaggctaacagactttggaatatgcattagctcttctgctttagatatgaatacaagtaactttagcaaacacaaaatatttcattgaagaaagaaatgaactcaatgagtcgattaaaagcattaatggaatttttttttagcactatattgagtgtggtggaattataccaaggctttaggctgaggccgttaccttgtgttttgtttataaataacagtaattaagacagtttagaatacttgataagtatgggctaacaacaacaacaacaaaaattgctttgtgcctggtggtttagagtggatttagtttcatcttgatagttctgtatggtggattgaacacatgttacccatgtaactgatgagaacactaaaatcaggagaaggtaaaagtctagaaattggcagaactagaaccctaattgccaacaccagtaaaatagttttttcccattgcataattactactgtctttctgactttcatttagtctcgataagtaaaaactttgcaagtccacattacataaaagaagtgtcactagtgtctagctcatatgaaatgcccagtgaatatcagatgaatttttaccttcttccaaaatgcactttaaaaaggtagaaagaatccatatgtaacagcccagagagatcaacccgttgaccctggaatagagagtgtgcagttagagacatccatactctttgaagaaagttagggcatttaccatgtgccaaggcttgtgctaggtgctgtaaatacatacgtagataaaacatgggctttgtcctacaatgtaggcagatcaagaaagaagcaggatagctaagccgaaaggcaagcccaagctgatagattctggattagtttatttcttttagatctttaatgtgcctagaaggtaccctggatatttttagatttatgccgtagtctctttggagtacttttaatcttactagaaaaacttttcctatttaggtatgtagtttcgtaagttttttctttcaaaaactttttgcacatttttttaatcttaaatgtgtataatacattttaaacgcatttcattttatgtttccaaccaacacacagataggtatttatgatattgacgtgtgatttatttttatctttttatttctgtgactctttaagttttcaaagaaacacaactgaagatcgttagaaaataagcattgttttgcaaaagctcgctttaatgggcattgtttacaaatatattattctgataaaagtgggtatacttgtatggaaacttttaaattcattctttttttttttttttttttagtgacctgttttgtcttttacttagttctttttcttctagccaaaactagcattccattagtccataacttatgtttttagcacgattatgtgtccttttatatttttatccatgttcttaagcgttaggaacacatacacagtttttagtcactgcttacaaaaatggaaggagtttttttgaaactcttttatctttttttgttcagtgctgcctaagagaaatccttctcagctgctactgttctaatcaattaaaaatttgttatattgtattccaaggagtggttatttcatagtctactcactcatttattagagggaaatactgtgtttccagtttttgtcgcttttaaactaatgatgtaataaataactttatgggtatcttctgagagacctaaagaatagattcccagggataggaccatccattcaagatgtatcaattttcataaatgttgccacattgctttgacaaggatatagtaattcatattattaccagcaatgcaggcaaatacgctctccccaatcaccatcagtaatagttcatgtttcccagtctgataattgtgtggtaatatcttactgttactggaattagtattttctgattgttagtgactttgaacatcttttgtgatgtttgtaggaaaattagaattattctaagaattgtcctttcatattctttgcccatttaaaaaaattggttattgtccttttgtgggaattcattttatattaaagccactaaccatctgcctgacatctccattgcaagtaatttttttcataagctgatcttttatctcttgcctgttcaagaagtatcttttgaatacaacctttaaaatatataagcaattccttctctttctctctggtgtcctgttttaaggttttctccattgataaagtaggcatgtaatctcctcactagatttaattttcccccccatttttgtctttaatctatttggaatttattgttgtatatggtataagagagggagtctactttttaatttcagagcatagacataccattgtatcagcagcaattttgaggtagtctttttctttttccagagaatataaatttcacatttgtcatgtaatgttttcatatatccagtagtacctggatttctttataaattttcttaggtattctaatacttgcaactagcattcatatgtgaggaatattttatccatcatcacacctctcctgggataaaaaaattcaaaaaccctgttgtgattttaattgggattgcattaaattatatatattcttgggataattaacattttaatgttatttgcaatgcattatattatctcaattcaagaatgtagatgtttttcatttgctcgtgttttattttttatatttcaaaaatatgcattgcttacataagctttgatcttatgcatagctggatttgatttttaagagtgtttttgtttgcttgtttgttttgttttgtttaatgggataatggtcattagcttttttcttttcttttaatgtattcatctgatactggtttcagggtattcataacgtcgtataatgagttgggaagtttttcattctcttctattttttggaatactttgtgtagaattggtactatttcttccataaaagtatgggagaatttactggagaattctatattgttctatattgttactgattttttgactccttattctgtcagttattgggaaagtattgaagtacagttgtgaatttctgtaattctcttttcagtgctgtcagtttttgctttatgtattttgaaactctgttattaggtgtgtgcacatcaggattgttgtgttttcttagtgaattgacctctgttcttaccatctctaacttttatttggagtgttttggcaatttaatgtaaaatactttttgtataattgggtttctggaacttgctatttgttttctatttttctcttttgttccctcatagtcacctgtatcttgctctatttgggcttgattattttttagtattttatataatcttctttattggcttattagttaatctgtttgttttgtatttttagtagtgactctaata

SEQ ID NO: 73724 - DNA, 3642 bp, Homo sapiens
cctggcatgatgtatatgtatacagttggccctctttattcgtgggttctgcattaagggagtcaatcaattgtagattgaaaacgttcaagaaaaaaatacaacaataaaaatgatacaaataaaatcataactttatatagcatttacattgtataagtgattgtaagtaatctagagatgatttaaagtatgtaggaggatgtgcacaggttatatgcaaatactgcattattttttataacggacttgagcatccatggattttggtatctgctgtgggatgggatcctggagtcaaccctccaagggtactgaagaatgactacatactgtatatacatatatattcatcatcttatatatctatatgtgtatgtgtatatttagtatttatctttatatgtttttacatgtgtttttgtagtctatatctatattagtacataacccacccacacacaccatacacaagagcaagaattacagtaaaatttcatgaccgagaaatacagtaaaaagccacacgtgtgtataaaaaagggggaaaaacagtctttaaaaaaaattctatctttagtaatactgtgctcactttgaaattatcgagctaacttgtaacaaaagaaaaacaaccctgccttaaagaaaacaaacctaaatggcaaccaagttaaattattcgaaaacaatgtaaagaaaaccttccttcatttcacaatgaatggtaacctctaagatgatacatccttgaatcacaactaatttcagtggcagaaatatctcagttcgattcttactctcttgcttgctaactatggatgaccttggtcaaatttcttaacctctctgagtttatacaatggaaaaaataatatgtagtttacagggctgtggtgagggttaaatggggtaatgtggccaaaagtcactttgtaaaactacaaagttcttgtgtggcaactgatttgataggaaaagcactccagccatacctccaccgcccccacactgccctcccctgaaagggataaactttcctgtttctcaaagtgagcatataaattacacttatggggaaggaatttccgagtgtgggtagaaaactctggcagtcaaaggtcatgaattccattcctgtctcaccagagatttgctctgtgaccttgagaaagtcactcttaaaaagtttcaacgtagctggtataaaagttactgattattaacatttatataatacaggtgaagtatccaagcttgtcaaaagaaaaacacatgaaattacagttcacatgatcatttacagaaaattgaaaataaagatgaacaatgattagagattgaaaatctgcaggctacttctttaatgagtcacctgaagcttctatcaactggtcattaaaaagaatgcccttaattttaaaaatagaattattaaatttgtgatatactataatttcaagcagtacattgaactgcaaatccccagttaaatcaagattgtgttgattaagctatgtctgatttatggcttaaaagtcacttggttagactcaaacattgttgcaacatgctatatgttattcttaactaacattatacaaaatgcacaataaaggtagataatgaggatcttacacgttatttgtacatttattgaatacctatttataatcacgcatgatttctccgcaactgcattttctccagttaaaaaagaaacaaaaacaatttttttaaacccttgcaagagcaaagaaacaaactcaaactatctcttcaatataactgatttagactctttccatgttacaggtatcttgcctgactccaattcatgttacaattatcactgcaaacatcagcatcactttttgtgggactctcttatttatcatcccctgctttaagaatacactgtgttccggttggtattctcgggccccacaactcatagtattccttctggtgttaattgcttgttgatttgccttgttctaaatgcccctatcatggtcttttccaccctaagtagctaaatatattcaacgctgtcaaccattcctcgattcactttatttccctgaaaaaattttttatgtcttcttgcaaaaagaaatcttgtagtatagtagaattaaaccatgctgcatttataaatatttgctctagtgtattgatggctctcttaaaagctgccattcaggccgggtttggtggcgtgtgcctgtattcccagttacttgggaggctgaggcaggaggatcccttgatcccagagttcagggctacaacgagctatgatcaattgagccaatgcactccagccttgaaaaccctgtctctaaaacaacagtaacaacaaacagccattcagagtaaatagtaggtacaaaataaaatactccttattgtatacctagtataatacagaagttaagaacttggtttttcatatgttagtgtgtttaatatgtactctttagtaaacaggtactggtagcccttggcttttatatcattgacttttcaaataactggcacatggaatactatacgtgtcacctctgaaatgccatttatatactggattttgacttacgaacatcatttgatgaatgccttttttgggctgtttgtgttgctgtcttgccaagtaacccccacctgctacagaactgtgactttgccacttttggcaaaaatttcaaaaattatttggaaaattttattgctttttaccttattttaacaaaacaagtggaaaaaggggaaatgaaagcatctagttatgagaaagtttattatcttgatataaaattgagacaataatcattagatgtgctgaaagtgatgaatctttattggaagtgctgcatggagttaagctgatgaattgtgaaaaaaattgtgaaaaaaatgaaatagaacacaaaaaatacaaatacttttaatgactaatagattgtatataatggcagattttgtgattttccttttgtctgtgagaatgagtctcctttaaaacatgtctggtcccttcacttctgcatatttgagttttgtatgctttcaggagaaaacgtacaaaatctcatacaattattagattccatcctttattaaataaatattcaatgatatttgtataatataggtatagtaatcctcatagcctatgtatcatatgtatttgtatcatttaatatatatttgaatcgtacaacttatatgtcatgtatagtatatgttatatgacatgtaatacagcacatatgtgctatatgcactatgttatgctttctgttttattgttggactcttatgaactgtattatgatttttatttcatagatgtggaaattgattttcagcaaagtaaagtaatgaaattatagtgaatagccagttagctgtagagagctgaacgctagaaagccccctggactttccccttgtgttactcctacctccctctatcattaaacgtaatattccagagttagccttactgtagaataaagcaaaagtggaaggattatacaaataaatatggtttagaggctgtattattatatttgttgtagatcatattgacatactgtgtttactagaatacgtttactacaagatatacttcaa

SEQ ID NO: 73725 - DNA, 1042 bp, Homo sapiens
agtcaagttcataaatctagctgtagattgtgtattaaactataaaactagtaatggcacaaactcatttgaaaagtttttgtttataagtttttctgcttgccacttgcatgctgattaatgaacatgagctaaaatcccaagacagttttattcaaaatcaacaccattattaccttttctgcttagaaaacagctttttttttttttttgagttgaggtctcactctgtcacccaggcgggactgcagtggcatcatcatagctcaaattcccgggctcaagggatcctcccaccttagcctcccaagtaggcaggactacaggtgcacactgccacacccagctaaaaatttttttgtagacacggggtcttaactgtgttgtccaggctagatcctgaattcctggcctcaagcaaacctcctgccaaagtgctgggattataggcatcagcgactgcgctggctacaagtttaatttttaaaataagtctgaaataggttgtagttgcttatctgtcattttctatttgaaaatactgtatgatcatagactggaaatggcttatatttttgcccagtgtttatttttcctttcaaactcacacttacttgtttttcggcctgcaatttatgcacagctttgaacttttaactgtgtacagaatgtaagggtaaaaatattaaaattaaatcactggcaacgccctataaccacagccttaactcatctaccacaaccactcctcccaaaagcaagcaagtaaacagatgggccttgccctatgcccagaaggtcaacagtcttaggctctgttagacctgctaagtttctggatcccaagcccagcccagagagctgcctgacttccacccgccagaattcatttttagggcctaggtcggccacaccccatctgatgtcagctattgagttcttgtggtagagaacacatgctgtggattaaatggttactttctctctatattgtcagtaattatgttacaaaaggatttttccgttttgggtgtttattgtc

SEQ ID NO: 73726 - DNA, 2468 bp, Homo sapiens
ccccattcatttcctgagaactgcagagagccgctgagaggctctgcgtgtgcgtgtgcgcgggtgacgccgtgtgtgtgcgagtgtgtgtgtgtgtgtgcgcgcgcgcgtgtgagagagagaaagggagagagagagggggactctgtgtgagggaaagaaaacaatttctcctgctctgcagcttctgttcaggtctgtgccgattccgtttcttatcaaaataaacaaccccctcctcttttttttttttttttgccatcccaaatcagaccgtattctcttaacgtgttttattttccttctgtcatctgctcaagttaaatcattttggttggtctgtgttcttaaagggggaaagtgctgggaagcgggagggggccggggaagggcgatgctgttgcaaagcaagtagcgtcggtcggattcgtggagaagaaagaaggaggtttcttccccacctcccctaattttttttttccagaagaagttatcaagtaacgtgaattaagcaagtgtttttctacccctagtggaattgttggttgcagtgtttgcctgacagttgccaaggatgtgaaataaaaccccagggctgaacttgggggggagggggggctcgtggaagtagttggccccccggcctcgagcggggtggatgaatagctccgcaccgggaccgtgtgggctgtgtgtgcgcgctggagagagtggaggggaaggggttaaggcggagatgacactgctggcatgaatagtgctcctggtgctacattcattattgtctctggtcgtaatgatgtgtaactgtcacttgctacagtgcctggtccatgcaagtagccaggggctggccggtggctgttattttcaattacgggggacctggccggagttgacaaggggcaactttgtacgtccacccgggccgggaacccgcagagccggcctgggagccacttcttgcctcagaagctcactctgagggttcagacttgacctccgcgacattagttggtgttcacgttagatgctcccctacggggagaatcagtcctgcttttgttgggtagcgagctgtctgcaagaactttgaaaacttttatctttggggaaaagggtggggtgcactcaacagttttgtttcgcagtgcatttgaggcaaatgcttggaaaaagtaccaattcctttgttatatgccctgcagcttcccaacccccttcaccctgcgcttcgagttttgcatactttaatagtaatagtcttatttcagctgataaaagctgactgtgttgagttaaagagtattaatacaacggaatgtgtaatctggataaacagtttgcgtagttagtattgtcagcactctaatttaactgtatagatggctaaagtgtcgttctgtatggattgttttagataattccactggctaatggaattctcggcgagcactctgatattttattttacaccagcgttaagattctctgtttccctgtaacatcggagagacgagcaactctatttacatttagtgcgtgtgcatctagtgacttcggtagacatctgccaatcaaatacacgtcattctgcaaaaccacctagacgcctccatgcccttttcttactggacgatagagttgtttagataagtaaatgctttgaaataaatttggtggcttttagcaagaagcagcttgtgatgggaataggagtggtcactttgaggagtgggtgtataccgtcttctaagaaacgcttttagaactgacatttatttaaaacagtggaccccccctccctcaaggaaaaaagcttgcttgtgctattctcagacctcattcacatgttgtgtgcattttttaagaccacatagaaattggttccgataaaggagtatacttttaggttagaaaatttcaaactgtagaagcatagtggaaataggatgttgaaggacagacgtttcagttgggtaagttatatctttattgttgcagacgggtcttgatactagattgaatatattaagctcctttgagttggggaaagagcaatttgagcatataaaaattaggaaagcagtttattattctgccaatttaataactattatgaaatgtactgggaaaatttgaaatttgaaatgttttcacataaaattttcataattttgaactaagaccatgtaaccaacatggctatgtcaggttaaacaaaacattcttgagggtttctgtttatttttgaaaaccttcagttatttatctactacttagcaatgcagtcagctgaactttattgtggaatgctttttattactgtttattgaaaaaaattgttgtgctaatgagtccttaatattctccacctcccactccccagaagttctttttacagcaatgactatcatttgggagtaaatggtcctggtatagcatttgagaccttgaccttagcaact

SEQ ID NO: 73727 - DNA, 1197 bp, Homo sapiens
ggcagaattcagactggataggtggtgtagcatgagtatgtcaatcaaatttatggagagataaatatgaaatgtgactccaccctcatccattgtgagtttttgtagtattgttggtgaagttatattccttttccatacttgctagtgctgtgagattcctctacccccactcccatctcacaatgtggtttaaacagggtcatcagtcaaaccatgaggataaatctgtgtttataatgtagaaactcatgaaggtcaatgaatgttcattacccattgtgccctgctctttcagttatgtgcatttgaaaacagtaatagttttgtgggacccacttggacctccagagtcagtataaaaataattttcaagtgaaaatatttgagctaagtaagatacagaaagaaatcataactgaacttcttttattgggccaatgcagcactttcagaaaatgttgctgctctgtactcccctccaagggagttttctgagaattcagctgctgtggagacagacttcccattttccttagcatcaaaagcccaatagaaccctccatgtcttccatggaagccctccctcccttccctgcctccacattttgtcaaatgtggaatataaatcctttatctctggctattcagtgagttactcatcactgagtctgtataaataaaccttgtctattctcctttcttttctttatctttctttttctttttggagatagtgtcccactgtatggcccaggctggagtgcagtgacacaaacacagcttattgcagccttgatctatcaaactctcaggctgaagtgatcctcccacctcagtccctgagtagctgggactacaggcacacaccactatgcccagctaatattaaaaaaaaattttttttttgtagagacagggtattactgtgtttcccaggctggtctcaaactcctgggctcatgcaatccttccaccttggcctttcaaagtgctgggattacaggtatgagccgccacgctcggcgtatcttcttttaatctattgtcagttaatttgcaagcttccaaacactggacccaagttggaaaatgaaaagttttcctctggacagtgttttcatacaaagcaacgaatgggtcattgtacaaggaaattgcatgggatggttctccttggtagaaatcccagtggac

SEQ ID NO: 73728 - DNA, 1021 bp, Homo sapiens
gaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtaga

SEQ ID NO: 73729 - DNA, 1085 bp, Homo sapiens
gtagaccttcggagatcactgatacctagccacttaatctcgttcctcacagccagagaatatacgtaagtaaattgcagaagtgttggactcaggagaggccagttagttttggggcacctctcttacagagctctttgggtggaaagaagaagtggtgaaatgacctatgcttctgtttcatcatgacagggaaatctggaaggggaattcagtctagtgaatttacttaaatattagctgcagaaactaagttacagggaaagcggctttgtgacatttttaagtgtagaagatcagatgagaatgtgaattctacagaaacttgggtagtctgggttactgctaaggaatgcctctcactgtgttcttctctgcagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggttagccattttaacagactaaatgctatgatgctatgattgaagggtgtatgttaaacctacctttctctccccatacatactatccgcactcagttttggactgtatgcacactttaagaagaatacctactgattataattgttgatttccattttgtgaggtggttataacatgggaaaggtcagcttaagatatttgtggttttgttttaaatgggtttgcattttaaatagatttaagacttaagaaactcttagagtatatttaggtaaaatagaatgtagataatatggaatcaatgtatttgatgtgtctgaaagttcattatcttagtgtcacttctaaaaaatccttaaatatgagaaagcaaattttcttttctttgaatgtgattttcaagtttcaggttaattacattcataatgggagaaatatgcctacctcaagtaaatcctacttacattgtattcaatttaactatttaattataa

SEQ ID NO: 73730 - DNA, 1145 bp, Homo sapiens
gctgtgattgcgccactgcgctccagcctgggtgaaaaaatgagaccttatctcacaaaataaatgtcaataaaaatataaaaagatctattttttaacttagccatccaatcttatttgaccccagttttttcttagtatatcacctaccaataatcccaaggttgactgttctgcttatattcaggttatcatctgccatgattcaactgttggtagctgaccattcagagacacatcttaacagtcgtaggcaattagaaacagtctttattgacctgttctataagagctctaacaaaagctctttgtgaggcttttatggaatatttaccttgtttcaaataagctattcatgttatttccttagcaaagcatgaattcatgacttaagcaacctgtactcctccttataagtgcttctgttcctcagattagaactaggactggttggctgctaaggaatgagtagaaacaggggagcttctcttgactgggctgtggcctagattgctgtttccccaggatgtggtggcctgggtgactagtgtgcctggtgatgcattgctccatgttgcctgtggcttgtgcttgcccgtgacagaacttgtgaatggcttgtgctaccagttggttgtgaagtgccatgatgtgcagctctccttataagtgatatgtttatttgctttcaacagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaaggtctgtgttgcactccctaaggaatttatccctctgagtgtcagaaattagctaatggaatgcacgtgctgtgtataaagagatttaagtgattacagtgtagaaatatctttctgtatgtgatacagtggtttctctttcaggtatcattagaaaacattaggcattcaatacctgcttgttgaatgaatgaatgagtgagacagtttccaaaaacctgtacttgggcctactccacaaggtagacggaactgtgatagtgctaggaaagaagctgtatgtccttttt

SEQ ID NO: 73731 - DNA, 1036 bp, Homo sapiens
ctcccgggttcacgccattttcctgcctcagcctcctgagtagctgggactacaggcgcccgccaccatgcccggctaatttttttttttttttttttttttgtatttttagtagagacggggtttcaccgtgttagccaggatgaccttgatctcctgacctcgtgatccgcccgcctcagcctcccaaagtgctgggattacaggcatgagcaccgcgcccagcctactattacttttttaaaagcacattattttgaaattttaaattcagattaggcatccatttccaggaccactatcctgaattactgaaaacaggttactatttttaagcaggctgagaaaaaggagccaagatctttttaatagttggttagtagatttatttgcacataactgaaatgatagaggagagggaatgtgtgtattttttcttttacctcactttgaattaatttttcaaaatttaatgttatttcattgtttagtaaactataattttatataatgttatggtaatttttataacatctgcttattaaatattatcacagacatatttgttactttttacagtgcttctcaggttttaagcctgtgcttaaaaatttatttatgttgaaattcattgctcagaagtaaatgacagtcaaaaaaaagtaaatgatagatactacttctattcactgataaaacttttcaatgagaaaataaaatctttgatgatgaagtactttgtggtatagtttttgttctatatttctcttgtattcagtgaaaaaaaaaggtataattattcattgtggttcattattgaagtaaccttaccatgacttattgatgacttattggaatgccttttatcctgaatcctgatttggacatatttgtgtgtgctaattccattccttgttttcctgttgtaccagacaagacactgcttcagaatcaaggtgattagaggtctacgtatttttatttaaaaaaaattcacagattcttccaactgaacatcatccttagtttaaaaagc

SEQ ID NO: 73732 - DNA, 1136 bp, Homo sapiens
acacattagttttgggttgaaaaatttcacctttttgtagctgtgttgttttaagtggtgtattgaaatatatggcaaacttttaaatttctaagatcattaaaaaatccttgttttctgtatgttttaatgttttcttggctatgtgcaattctaaaaatcagagagtacttgtttgtacccttttctacactttgaaagtttgatagcagaaaatgaataggccaaaagtgtacttaaaaaattgttttcccaggaaaggacaccaattgaaagcacacagctcaatggattatcacagagtgaacaccactatttctcttcaccccagtcaataaatggaatgctagcagcatgcctgcaacttctcccatgtcccccatctaatcaccatccccatgctgacctcagatatcttagattagtggtgcttggctttgaactttgtataaatggaatgatacagcctatattcttttatctcacatctttcactgacattcgtttgtgagatttaattcctcttttaatgagcattttatttcattcattttattgctatttagtattccatttaatatatctcaatttttccattctcttgtgagtagacatatgggttatttctaggtttttggcttcaaaaagagtcctgtcttcactattattatacatgtctttaattgtacctacatatgaattattgatgaatatctacacggtagtaaaattgttggacaaaatgctctcttaataggtttatctgaactagtaagtcacttcaacataaatgttcaagttagaagattggagaatttttaatttgtattttgaaacaatttcaaatttatactaaagttgcagaaatatcacagaggattcctgttaaccctttatccaggttaatcaactttttatattttgctacatttgttttataatttttggtccatttacatatatatatacatatatatgcaccgctatatttcctcattctaagccatttgtgaataagttgcatgcatcgtgtccgtttactcttaatactttagggtgtatttcctaagaaaaaggatattcaattcaagagcatggtttctgaaacccagtggtttctgaactctacattctca

SEQ ID NO: 73733 - DNA, 1045 bp, Homo sapiens
aatccaaaagccactgattgacataactgtactaaactgatagatacaataatgtctttatttttaagtatatagaatatttcctaggcatttctttgatttttcaatgacagacttttctggatctcaatataaatcgcataatggttacaagatcatatggatagcaactcttagatagcatgagggatctgtgaaggacctcttgaatcttgtgaacgacctcttgaatcttgtgaacattctattttgttttgtttttatccccagtatggaaaatgtatagcctgttaaatcttattcttgttcttttagtaacacaaaattagacgtagtgatttttggagaattgctttttttaaaaaaaattaaaattatacatgcaataatattgatcattcaaattcttagtggggtgctgcagcctctagaaagtaatgggcttacttgggaacctttctaaatttgttggtgtcatagatgtttgtgagattcattcctgtttttgtgtatagcttgacttattcacttttattgctgtatagtattccatttcatacattacattttatccactctcttgctgatggatatttgggttgtttcttgttgtttgataattggcacttcttgtagtcaggagaggaatacatgttatccactagcctgtgtgccattaacatcttcttagatattcttttggcctatttctcttagacatagtacatgctaaaagttaatatataactaggtagcactcactcactagttaaagtagactaatccttgaattattcctgagggtcttttgtccatgtgtgcctttttttcactttaagaaaagataactaatactggattaatataattttgatcctgaactttcctctgaattagtacaaagtcatgttccaacagtgaatttgatttatagtgaagaaagtatatgaagaatttactttagagtgctttcagggacgaccttatggaagaaatttcaaaggaaatagccacaaaactagtataagatatatagaatatgaaa

SEQ ID NO: 73734 - DNA, 1007 bp, Homo sapiens
tcctgacctcaagtgattcacctgccttggcctcccaaagtgctggcattacaggtgtgagccaccatccatgcccagctcaaaatgatcttttttttttttccttgagacgaagtcttgctctgtcaccatgctggagtgcagtggtgcgatctcagcttactgcaatctctgtctcctgggttcaagcgattcttctgcctcagcctcctgagtagctgggactacaggtgcgcgccaccacgcctggctaatttttgtatttttggtagagacagggtttcaccatgttagccaggatggtctcgatctcttgaccttgtgatccacccacgtcggcctcccaaagtgctgggattacaggtgtgagccaccgcacctggcccaaaatgatctttcaaaataagtttgcttctcagatcgagatttattctggggcctttatttgaattcgagcaatagatatttagtagtagaaatatatatgtatagaaaaggggaaatagaatactgatgctcaatactataagaactttaaaaatcatttcccatagaaagttataaagaaattcttcttttgcccattgtattagttcattttcgcattgctataaagaaatacctgaaactgggtaacttgtaaagaaaagaggtttcattgactcacggttctgcaggttatacaggaagcatagtggcttctgcttctggagagacctcaggaagcttccaatcatggtggaaggcaaagggggagtgagacatctcacatggtgggatcaggaacaagagagagagaatgaggaggtgctgcatacttttaaacaaccagatctcatgagaactcagtatcatgagaacagcaccaagtggatggtgctaaaccattcctaagaaatccatccctgtgatccggtcacctcccaccaggccgacctccaacattgggaattacaatctgacatgagatttgggcggatccaaaccatatcaccgattcttaggaa

SEQ ID NO: 73735 - DNA, 1052 bp, Homo sapiens
gttttataggtttttttgttttttgtttttaagacggagtttcacacttgttgcccaggctggagtgcaatggcacgatcttggctcactgcaacctccgcctcccgggttcaagcgattcttctgcctcagcttcccgggtagctgggactacaggcatgcaccaccacacccggctaattttgtatttttagtagagacggggtttctccatgttggtcaggctggtcacgaactcccaacttcaggtgatccccccgcctcggcctcccaaagtgctgggattacaggcatgagccactgcacccggccattttatagggaatttgagcaggcactgacacattgagctaaactaatgatggtcttaaaatgtaaaagaatttgtgggttttggttaaaaaaaagcattaatagtacatgttcgtgatttagaatgaacatacattatttttagttatattaatctattattttatttccaattcatatgaacattttatttcatcgaaactggagatagcccaaatggtgaaacagcagtaatatcatgtaaatggtaccctagctgcaaactgagggatggtatttttgtgcatgtggtctagaatttatcctctgctgcatatagaagaagcaggaccaccagccgtaacatcaaaggggattgtgaaatatttactcttgataacactaattcaggttatatctttatttcactatattcagaacaaatcacatattgttagtacacagtccttcatttagtcacagaacaagcatttcttgagaaccttctatgagttaaactatgtgatggaaaaaggtgacaaaaaaacctgatgaatgaatcatgtcctctccagagaatagctcaaatatttgaaaggggaatgcaaacagatcaatagatacatagaataaagtcaataagtggctttaaaaaagaatctgtagtgagcacaaaagtagctgtgtctttgctttggagctggagtagagagtaagagaagaggagattcaagaggaaggacattttgagggagttggaa

SEQ ID NO: 73736 - DNA, 1033 bp, Homo sapiens
taagaagaagaaaaggaaaaggaaaggaaaatgtcttcagtgtatgagaggacagaaggagggacagtgcgatattaaagtggaatgaggagcacatgagaacattgatgtgaggttgtcttgcaagtgccagtgaattaaaagtggattgtctgctgtgagggtcttctcttctttcagatgactagagaataaatgaaatataggaaatgatcagctgaggggtgtgatggagaatgaatgctggtaaggaagtagaaataaagtgagaaggaggatatactaatatttggaacatactgtttgaactttaaaatagggtgatttttgcatttattttgtgtgcattttaaaatacggccttttggttatttatccaacacatatttatatgtttaattattcagcaaatatttgttgaaaatctttggttttatagggcttctgttttatcatgggaagacagacattaaaaagataaaaaagtacaatattatagcatgctaagtggtgagaagtgcttaggataaaaattttacaggaaaggggttggggagaaaggaagagaaggactgagaaaaagaaatgatgaaagactggaaaaagaatgagagaaagcgagagagagggtttcagtgagtgtggccaatggagttgtcactggaaagacaacaggtgagtaaagatctaaagagagggacaggacttccatggccacaggaggaagcctcctgctctgtggaggagcagtcaggaggccacatggctggagtggactgagtaagggagagtggcaggcgaggagctcagagagggagtagggcatcagatggtgcagggtcttgtaaaccagaagactgcatgaaatgactaagtggagcaagtgtaaatagaaaagaggaaagggccaatcatagagccctgggtagccccaaggattagagttctgagagatgagaaggaataagaaaaggagtctgaaggagagccagtgaagtggagaaaacctagcacagtgaagtgtcctggtagc

SEQ ID NO: 73737 - DNA, 1085 bp, Homo sapiens
agatcgcgccactgcactccagcctgggagacagagtgagactccgtctcaaaaaaaaaaaaaatgtttatattttgaaggtattcattccttttttgttttctttttcttctgagacagtctcttgtcgcccaggctggagtatgatggcacaatcatagctgactgcagccttgaactctcaggctcaagcagtcatcccacctcagcctcccgagtagctgggactacaggcatgcaccaccatgcccatctatttttttttttttttgtattttttccagacagggtctccccatgttgcctgggctgatctcaaactcctgggcttgagcaatctacctgcctcagcctcccaaagttctgggattacaggtgtgagccactgtgcctggccaatattcattctttctacttctgtttaaagctttttgttttggggatgctttttctttcatttagttttggacatgaatagtctgttgtggttattaagagacaagggattgcacaagattgcttccaaacctgtgtaggtatttgctcctgcaggtaagaaattgagccagtggctgaatagttcctgagtctcataccagtgttgctagggaataaattcaatgcaaggtgagtaagaacaggtattatttgatttatatgtgtttatcctgatgtgtctagaatcacagtctttgatatagccaataacaaatagggttgacctcctcccatttattagccggatacatgttttctgtgaagccacttagtaatttcacttatggttattttgataaggggacttgatctgtgacttaaacattatcaaaaaggattttttcccttttctacacatcctccccaacacttgtggtctcttctctttttggtaataggcttcctaagaggagtgaggtggtatctcattgtattttgctttgcgtttctgtaatgattagtgaagtcaagcatcttttcatatccctgtcggccatttttatgtcttctttggagaaatgtctattcaagtttttctcccattaaaaattttatttcaattgataagtaaaaattttatacattta

SEQ ID NO: 73738 - DNA, 1063 bp, Homo sapiens
gcattaggggacccaaggccccttcctatacaggtttttttaattatgactccaggaatcaattccacttaagctcaggaaacaccaagagccttaggatttgccacagtacagtcttgttaaaacacatgagtaacatcattacactactgcttcttgacaccacctctggtgagattgttatgactttttttttctatagtgttagtgaaaactcgatctctgcaggaatattggcaatactgtgagtgcgttaacagttaccaaatgcttgggtgtttgactgatggttattagaacatctgtcacttaaacagcagttaaaatatcactttacgtatcaatagtttggcagtttcctggaaagtcaggtggtagatcagcctgtaatcataaggttgtgttctacagtcattgcaaggacattattacccatgctttgctgaagctagataataccaatagatgaaatctgttgtcagatggtaagaggacatgagtctaggacacactgaagcataattatgagcggtgttacaagcagcggggaggtgggatgatctgtgatggtgatgagccaaggagggtcgtggctccaaggcccagacagggtccccaaataatgaggtgatctacaggaagacattactctaattaatgtaattaagactttatttatagtcatttgggctacattgtcagcaaaccaatttgcccaaggtggtaatgattctctcagctttggaaaatgatgctgtaggcattggtgtagggatggggggcaggggagggtacaatttagctctgctttgtcaaatcttttttttttttttcctttttccctctaccctccaccctcagaggtttgtgagtgctggaagaacatttagtcctggaaaaaggcaatattttaactcttctacctagtaagagataaagttctgacttgacttccccagaaagcaagcaagttataaatataacattcttctctttgcttatctattttttgaggtaatgtacaatttggtagttaccctaggtatcatattaaactttaggt

SEQ ID NO: 73739 - DNA, 1033 bp, Homo sapiens
gtgtattatttactgaagcttgcaagaatgattttaaagagactttacaaattgtgttcttaagattaaaaaaaggaatttaatgccagtgttttcccaactctcagttctcttaaaaacgtgtattactatctgagctttattcacgtaaccagtttttttgtcaatatatttttagaaggtcatttttcagttctttttcaaagttgatggttagtagctttgagaatatactagtaagaataccagagaaattgaaacctggaagatttcacctctctgtgctttctaagaagtttgttctgtggacagatagatctatctctttttttgtaatcattttttattctctctcctccttgcagtctgaagtggaggttaatttgccttggctctgtggtagaatcttgactgcaatatctggcggaaaggcacaaacatagcccagagactcccagccacaatggagcacattatgataggagccctaagctgaaaattgaaggtgttcagtgtcagggcttgattatcagaaaccagagattctcaaacttcagtgtgtgtgtcagaattacctagagggcttcttaaaagagaccactggaccctaccctcaatttctgatttaacaagttctctggtgatgctcaaactactggccgggtgaccacagttttagaaaccctgtgctaagttatttggttcatttggttggctgtatgaccatttctgttcccctggatatttttgtagtctttctcagacttgaaagttcaagtggaatgtgaggagaaataatatttgactctggaatatttttaagaagctcttcatcttctagcttaatgatttgcctgtcctttccctgatatagacattattctgccagacatcataagaccatgcaaatgttgaatgaaaactttgcctttcagccaaaagttttaagttctgcaggtggaataaacagttcattttgaggggaatacagataacctaaaaatctgaagtccaaagtgttttaacgtcagaa

SEQ ID NO: 73740 - DNA, 1024 bp, Homo sapiens
aggaagacctgctgtttgctttgttctgagttctatatttgaagtggagaattatttatttggacttaagatcattgttaagagagtctcctaagtgtttccctcagtcctcgacagagtctataaagtctacaaacgtagcctagagcagtagacctgcaaacatcccctaacatacttgtctgtggtttgtctgtcatgcctattcctttaatgcaatggccctatctgttggatgaccgtatactttattgtttgatatgggacaattttattgtcaaaaggggcaccactaataattatacaagcactgtgagtaataaacctggactgttgaggacaaaccgagatatatggtcaccatggcaaagtttgtgttcatgcagagccaccgagttggaggattgtggttactaatataaaatgataatgttttcaagagtatctactcacatattggagttggatctacatttgaccttagagctgggagtgctgtactaatcgcttgggggtctgttgtggggagttgccacagtgatgtgttccctcttggctccacacctccctttgggtcagagtcaatttaaggatgtgtgtcaggagaagcattcaaccagaatggctcaatgcaccactgtttctccaaggtgcaaagagaaatggagatgggggtgaaatgtatgccaatgcagatctgtctctagtcaagcctatgtagtcttatacaggaggaatgtcaggcttagcacatttcagctaaacttgaatatttgaactgggaaaagggcttaatcccattggcatgaagtgaattacagacttaaactgattggggaaacaagaatatctgattctctcccaaaggtctaggataggtcactaatactctgtaaatatttatccacttgcaaaaagagtctgtatggcattacccaaatttttctgttaaaaagttattttatgttatacatacattactacaataaaaaataaagcaggagttgttattgaaaatatgaga

SEQ ID NO: 73741 - DNA, 1056 bp, Homo sapiens
gggaggggcggggaccccactttaaggaccgactgaggtttggctgcaggcgcgcgcgctccacgtggcgcgctcaagcgccggctggccccttccctggaccttgggagtgggagagaaggcgttcgggggctgggcgagcggcgggagcggccggccggctacagcagggacccggagggaaaaggacaacggtcccgggatggagggggagctggcgcgtccaaggagcacgcgtggaggagcgcccgtcccgggaggacggcggtgtctggggtgtgaccggagatggcttgcttgccgtgtgtgtgtgtgtgtgtgtgtgtgtgtgcgtgcgtgtgcgcgcgagcgcgtgtatgaacgcagaaggttgggttcctagaggtcctcactagttctcaatcgcagtcaaatccttaaccggtttggctggtcgcgtcatcttcgcagcagcacctgcaggtctccggtctgggaggcaatttccgagcggggcttagggaaaagttactagacatcgtcagattgtctgcaaagaaggattctacatttggatattgaatggaaagaagccctttttttgcggtttttaaacacacttattggaggcagtgtagtagaacaggtttctaatatcattttttaaatgtttttttcacttttgtttttaatattttttttccagagtcttctaaatctaattaccaaacagtaaactttacttccttaaaaacagatatggtccttatggaacagggagaggagaacttgactatgcagtgattgtgtctttgaaaacagagttttccccctttaatttgtaatgagttttctccccgccatatcaaaagcttccaaaatgctgttttaaaaatggttatttactgtttgcacagtactttaggttctttggaaaaatagtgttgtctaaatataaataaagtctcaggttgcaccatgtggctttcttttggtaactgggaaattaatcgtagtcagatgagaaaaacatcctataaatatggctttaattttttttatttcacaattcttctg

SEQ ID NO: 73742 - DNA, 1109 bp, Homo sapiens
ttaatttttaaatgacagagaaataaacttctaccatataaaccatagttaatgttggatctctcttctagtaattgaacccataatcttaaatgagatagcccttaccacactgaaatgcggtcctttactagattgaaagtgttttgaggcctggaaccaacttgttatttttgcttttattttcagtgtctaggacagtgctgagtatttaataaatctggtgtgatcttaaaaggactttctcatgtgctttttgaaaagtttagtcataagataattatccaaccccacagtagtatttttgcttgcagtaccaaattgcacctatttcttacagcaaccttcagtaattgagaatgtaacactaaaatgcaaacttaatatgttatatagtctccggtagtcagatataattaaaataactacttaaatatcttctaaaagcaaaattaatattattttccccctttctctccagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaactgggtagtggtgatgaatgcaaaactttgtgaatgtgctttataaaagtgataattagacactttagaggatatacttggtgataatgtgaatgatgtaatcagactaacagttgaatcattgctgttggaggcagcacaaatttatgtgttacaacagtagtttaaaaacttgtactggatggaacccattttataaacagtcttatttggagtcatgtatataaaaatatatataaattagaaaagtagtatttgattaggataactttacaaattcaatagtatagccatcacttattataatggcaatcagaagagtgaggcttcttttttcaaacttttgtaatcagattaagattgaccattgctcctttacacagtattagtctagcattcaattatttctgttattaatggttgt

SEQ ID NO: 73743 - DNA, 1038 bp, Homo sapiens
aacttttatggttgattgaggcacacttgggaaccattctatttctttacctcaccatagtcctcaagctcaaatatttcattagtgtaaatagtgataaggtggtttggatttcatcattgttcatgatggatatgtggtaggatacgtggtgggatttacaaaaatcctaacttttccaagaagaaatgtattaacaagtgaagttttttgcccagtgagcattagttttgtagaaaaaggtatcagtcagtgagcaagtactttttgagtggctgctatgtaccaggctatgctttggaaacaagacagacagtatttacccctgtgttttatgttttagagttatgtgccttaatatgaggcagtattaacagctgcatgttttatgccatggcatcatttaacaatcattgacaggaattagattaaaagtattaagacaaccagtagtcactaagcatgtaatctttggagtcaaacagactttggcttcagttctgattccagaaatgtgtgactttatgcacattacctaagctctctgaagttggcttttgtcatctgcaaagtggaaacaataacctatagtgttatgttgattcagtgaggtatgtaatacatgtaaactgcatagcacatcacccagggtatgtatctgtcatgaacaatgatgaaatccaaaaccaccttatcactatacatgctaatgtaagtcttgagcatggaacagcaaagtgaactaaaagatactccaagcctgttaaaggaaaccaatactgccacatcttccttccacttccgttatacattggaggggagatttttttttttcactttttgttttttccattttaaactatgatggtgttttttaactgtttatatcccttataacctctccattttttcatttgattattgttcctctagcagtattaaaatgaagatactttatgtaaatatgaccagcgttgaaactaaaagttgagtgtaactgcagtaaaattgaataaatatctgcattccaggtaatgt

SEQ ID NO: 73744 - DNA, 1063 bp, Homo sapiens
ttttctagcgtaataccgaaagggaaataaatttactttagcataactattctatttagcctgtatgcttagagttagaaaaagaattagaggtcatctgctggcttattgccttaaataatcacaataaataaatcatataaattctcataagaattctctaattagtagataccattttaggaaaaaaatctttgttatcctgtcctccttgagctgctgccttacctgttttccttctttgtaaactttccacaaagaattgttcatagctgctgcaactgctacctcatctcacattcttttccttattcattcctgtgtagcttgcttctgtgtgtaccatttcgtagtaactttttttgtcaagttcactaatgattgccactttgccagatccagtgatcacttttctgtcaccatatttcttgacctttcagcagcatttggtagaatagctcactccatctttattgaaacattatcttttcttggcttctgtgagaattctgatggtcctctattttcctaattgcttcgaagagtctctgttgctagatcatctcccttccaacttctaaggagcgcctcagccacttcatcctagactgctcatcttttttatgtgttttcttgccctagtaatgttttctgttgtatagttctaataccatcaattgtcacatagatgaccccatgttccttgaaaccctaacattgccaccaaattggaaacctgtatattcagctaactctttggtatctccatctggatgtcttatagataccttaaagttaatatggccaaaaaagaaatatgggttttcatcttcccatctctgctctaaacccttttcttccccatcttccaagggcatagccatccatgcagtgtttgaggtgatgagttgatgccgttgattcttctttcagattgccattccagagaggccgtagtatcttgatttgattcttggattgtaatctctgctttgctatctaccagctctgagaccatggacagttatctaacctctttgtgtcttagttccttaatttcttt

SEQ ID NO: 73745 - DNA, 1066 bp, Homo sapiens
aagtgctggaaatgagtttaacatatcaaccaagccaacttatatgtatttgatgaagtccaggcttattaaattcaattccaaagaaatggagtttgaaaaaagaggttttatttcacatgttatgaatgttaaatgtttgttatgtgctataaataaattgctatctcttctcaccctattcatagaaaatctgctttactaccattctgcccccctagttttactgaagtataattgacaaaaattgaacatatttagagtgtgcattgtgatgttttgatatgtgctgctttactgcattcctactgaatgtcagttacatttgtattttatccctttataggtattagatacagagtacatatttgttgatcatttcccttttaacactatgtatagtatactagttttcttttaccaactaatgttccattgttttttttttctttctttcttttaccagtttcttaaacaattaggtctacatcctaactggcaattcgttgatgtatatggaatggatcctgaactccttagcatggtaccaagaccagtctgtgcagtcttacttctctttcctattacagaaaaggtaattgttatgtaaaatagaaagtttctggtaaatacaatttttgttttattctgtcttattttttgaggcagtatctcgctctgttgcctaggctggagtgcagaggtgtaatcatggcttactgcagtctcaacctcccaggctcaagcgatcctcccaccttagcctttcgagtagctgggaccacaggcatgttccaccacacctagctgatgcttgtgttttatttttgtagagacagggcctcaccgtgttgcctggtctggtctccaactcgggctcaagtgatcctcccgcatcggtctcccaaagtgctgggcttataggcatgagccactgttcccagcccaatttctttttcttctttttttaatttacaaagtttttgataaatacaatctttaagaacaaatgatccccttcttgcataaaattaggcaatctagtcagtaaagaaatcttaaaact

SEQ ID NO: 73746 - DNA, 1608 bp, Homo sapiens
aatctattatgctttatagtattctattacgatatgccataatatattttaaccaaatctccattgatgtcttagaccaatctcctacaaaggaaattgcttattggagtgtatgagaatttaaaatgttaatacatattgccatatgccctgtaacgtgatcgtacaaatacatacttttaataacagcataggagaatgcctttttccccataccttcaccttcactggctactgctattcatttttcaatcttttgtcagtctggtaggtgataaattaattcttttattttaaaccctttctttcataataatattttttatcatttgcattttttcttttacagactgagttttttaatatgttattttccacaaatacactgttgactttttttttttaatagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttggtaaatgatttttcattactgcattttttcccccttaagatacaagttaattgcattgagcagtaggtggtgctctaattctttcttcaaactataaaataaagcattccctgcttccttgatgatgggaatgtatatactgttagaagaaatattaatccttctcattcttttatattgttgactaataggggttaaacaaatggacaaatattaataatgtaaggcttatcatttataacatgatccttacatttctaacctaccaatgaaagaatttaacctgaaaaatagtagcatacttctagtattttcatatattggtctctctgctgtatcaagcctttttaattttatcttctttcatattctcagaatctggatcaaccttgaaaaaattcctggaggaatctgtgtcaatgagccctgaagaacgagccagatacctggagaactatgatgtcggtaccttctttccgttttgatctcatgtgggcaaaagtttgtgggattgtagatgtgtttgggggttttgtcttgaaaccatagttttgagcaattatggattttattgtatccattaagaaaagccttttgtacttttcagataactttgaaatatccacaaatgctgataagttgccatttcttttctatgttcagagctgactgaatggataaaatcagtttgatttacaaattttttttttttttgatatgcagtctcgctctgccgcccaggctggagtgcagtgatgccatctctgctcactgcaacctctgcctcctgggttcaagcaattcttgtgcctcagcctcccaagtagctaggatttcaggtgcgtggcaccacacctggctaatttttgtatttttagtagagacagggttttgccatgttggtcaggctggtctcgaactcctggcctcaagcagtccctccacctcggcctcccaaagtgctgggattacaaacatgagccaccgtgcctggccctgatttacaaattaataaaatatcttatgattgactattccttac

SEQ ID NO: 73747 - DNA, 3196 bp, Homo sapiens
cagctgaactagctaacagggtaaagatggtaaagatcattacattaccctgaaacaaatttattgagcaaagaaaatgatgtggttttctgctggaagcaggacacaataaagacacaggctatttaactgtacaacagtgcaggtatttttctcaaaatagttggacctcacaggaatctgatagggaagacacaggccaccaagccgcacaaacagcacacaatctgcattatctctaaatgattagatgaactgaaacagcagacagcagcatcttaacagcttgtcaaaacatgtccttttgctactttatgactgcttttgcttaagcaaattctctcaaaggaaaaaacaaaaagccaagtaactttctaaaactttatgtcctacaataatactatggttaaatttacagcaagaaatttatatggttaaatttatagcaagaaaaatttagaaaaaatgtgaaatacctcagtctgaccttcatgggcactggtctcatgagtaactcggatggcctgtaataagaataaaggtattcattggaaaaaatgcctatactcaactttttaaatgaagacaacaaagctaaattttaacacctaaagtcttctaaagaaacaacaaattgaaggaaatttaagaaaagcttagtactagatatttaagaatgatatctgggtaatcaaatgaattgctgtactgtgtaacccgtaaatctctgaaaacttaggaaattgaatatctgattatttgtaatttccaggctctaagtaggggccatttaacttattcagttgttagaactaacacttaacactttattcaattgagactagaataaagtaagcatttcacagatagagactaaagaagcttatctcatctgtttctccaggttccatgctcctctgcagctctggctgtatttatgtttaatcatgcagtttcagtcagcaattgagaaatgtggagcacaactcatgcatttatcagaagctacagaatttagtttcctgaactaaaaaaaaaccactcttatagtacccactatttgcaaacatccagagaaatgggcacaatagtaaattacaggtgaaagtacaatctttataaatagcaatttggcaataaataaatatccaagccttaaaaacatgcaaactattttatccagcaacttctcttctaggagtttatatatttacatataattgtacataattatatataattaaggatatttacaaagatttagctacaatgatgtaccttgcagtatttattaaaatagtgaaaaagaagaaaaactattaaatttctaacaataatttattggtgaaatacaatactacataatggaaagctatgcagccattaaataatatcaaatatatacttactggtatgtaatacgtttctgataagtgaaaaaagcaagttataaaacagtattacagtatgatcaaattcttgtttaaaaaattgtgtatatatatatacactccctaaaaaatattaatgtttatctacctctcattagtaagagtactgattttcatgtttatttttatgtataataaagatgttttatgaagtctccagtttttttttaaagaaaaaaacaatttaaaattctcaaagtatattggaatgcataacaacataatcaaaccaattaatttatcaggcacaaattctacataaggcattgttctaaccaaataatttgtagattatacgcctaatttcaaagaacttacaatctatttaataatgttattaaaaggtcaaaagatttcaaaagaaaaattgattccaaaagcaataaattttaaaaaccatttcagaacagttatatgaagtggtaaaatcactatcatctgaattaaatataacctatattatatatatagcctagtttatgtggcctttattacactgatgaaatagctacagtatggtctaatgtctacctttaaacctttgctttctcctttcatcttcagcctggttccaaattcccaataaaagatacacagggtactggcaggtatatatttatttattttagggagggaatagtaaggaatagtcaatcataagatattttattaatttgtaaatcagggccaggcacggtggctcatgtttgtaatcccagcactttgggaggccgaggtggagggactgcttgaggccaggagttcgagaccagcctgaccaacatggcaaaaccctgtctctactaaaaatacaaaaattagccaggtgtggtgccacgcacctgaaatcctagctacttgggaggctgaggcacaagaattgcttgaacccaggaggcagaggttgcagtgagcagagatggcatcactgcactccagcctgggcggcagagcgagactgcatatcaaaaaaaaaaaaaatttgtaaatcaaactgattttatccattcagtcagctctgaacatagaaaagaaatggcaacttatcagcatttgtggatatttcaaagttatctgaaaagtacaaaaggcttttcttaatggatacaataaaatccataattgctcaaaactatggtttcaagacaaaacccccaaacacatctacaatcccacaaacttttgcccacatgagatcaaaacggaaagaaggtaccgacatcatagttctccaggtatctggctcgttcttcagggctcattgacacagattcctccaggaattttttcaaggttgatccagattctgagaatatgaaagaagataaaattaaaaaggcttgatacagcagagagaccaatatatgaaaatactagaagtatgctactatttttcaggttaaattctttcattggtaggttagaaatgtaaggatcatgttataaatgataagccttacattattaatatttgtccatttgtttaacccctattagtcaacaatataaaagaatgagaaggattaatatttcttctaacagtatatacattcccatcatcaaggaagcagggaatgctttattttatagtttgaagaaagaattagagcaccacctactgctcaatgcaattaacttgtatcttaagggggaaaaaatgcagtaatgaaaaatcatttaccaaagtgcatcttgtctttattgtttgcaatagcatgaatcagtccaattgttccacaggcatt

SEQ ID NO: 73748 - DNA, 1040 bp, Homo sapiens
aatacagccagagctgcagaggagcatggaacctggagaaacagatgagataagcttctttagtctctatctgtgaaatgcttactttattctagtctcaattgaataaagtgttaagtgttagttctaacaactgaataagttaaatggcccctacttagagcctggaaattacaaataatcagatattcaatttcctaagttttcagagatttacgggttacacagtacagcaattcatttgattacccagatatcattcttaaatatctagtactaagcttttcttaaatttccttcaatttgttgtttctttagaagactttaggtgttaaaatttagctttgttgtcttcatttaaaaagttgagtataggcattttttccaatgaatacctttattcttattacaggccatccgagttactcatgagaccagtgcccatgaaggtcagactgaggtatttcacattttttctaaatttttcttgctataaatttaaccatataaatttcttgctgtaaatttaaccatagtattattgtaggacataaagttttagaaagttacttggctttttgttttttcctttgagagaatttgcttaagcaaaagcagtcataaagtagcaaaaggacatgttttgacaagctgttaagatgctgctgtctgctgtttcagttcatctaatcatttagagataatgcagattgtgtgctgtttgtgcggcttggtggcctgtgtcttccctatcagattcctgtgaggtccaactattttgagaaaaatacctgcactgttgtacagttaaatagcctgtgtctttattgtgtcctgcttccagcagaaaaccacatcattttctttgctcaataaatttgtttcagggtaatgtaatgatctttaccatctttaccctgttagctagttcagctgggttgcttttcctttccttctcttgcctcttttttcattttttggtttcttcatttttccttccatcttttctttctttctttccttccccccagccctgactg

SEQ ID NO: 73749 - DNA, 1415 bp, Homo sapiens
ctccattgctgtttgtattccagcctactgatttttttgtcagttcctacaaaatacataggtctttgctgtctgtattagtttgcttgggcattcatcacaaattgttaccaggtgcctttaacaacagaaatttattattacacagttcttggggctggaaatccaacagcaaagtgtcagcagggttggcttctactgagatgtcccttcctggcttgtagactaccaccttctcactgtagccttacctggcctgtcctgtgtattcatatggagggggtgtggagagagacggggagagagagatcaattgatctgatgtctcttcctgttcttataaggataccagtcctgttggattagtgccccattcttataaccttagttaacattaactacttccttcaatgccaagttttcaaatatagtcacgttgaaggttagggcttcaacgtatgaatttggcaggggggacacaattcagtccataacaccgtctttgtgctttctaacaacccagtacacttccgggtataccgctgctctttgcagagttggagacttctcatctttcaggtctcaccttaaaagtcacttttcaggctgggcgcggtggctcacgcctgtaatcccagtactttgggaggccgaggcgggcagatcacaaggtcaggagatcgaggccatcctggctaacacagtgaaaccccgtatctactaaaaatacaaaaaaactagccaggtgtggtggcgggtgcctgtagtcccagctactcgggaggctgaggcaggagaatggcgtgaacctgggaggcggagcttgcagtgagccgagattgtgccactgtactccagcctgggcaacagaaggagactccatctcaaaaaaaaaaaatgtcacttttcagagaagccttctttcatcactgttaagtaggtccttctgtatttttttttatgataaaatcctgtttattttcttcctggcactttaaaatagtcaataataagttttttcttccttgtgtatatttgtttattctgctaactagaatgtaggtcccatgaggaaataggccttgtttgtcttgttcgctttgaatccccaagacaaactggacatatataggcatgtataagaattacatagtttgaaggtaagagcacaggatataggtttgtatactgactccactgcttattagcttaggcaggatactttcttcagcacaaaatagaaataatggcatttaccttatgggattgttgtgaagactaatgagttaattatataaactgcttagaatagtacctggcatttaatgggcattcaataaatattaggcggtaattttattttactaggcatccagtaaaatgaatctgaatggcagaagatgaggctgaagtaa

SEQ ID NO: 73750 - DNA, 1011 bp, Homo sapiens
taaaatcgcctccaaaagattaagtcatgttgaaataaagaaaatgaggtatgaaaagtaaagaaaaacaaagatcagaaagttgcagtttcagacttttgacaaaactggactctacatcttgaaccgcatgatacatgtattgtttccgcctgattcttacaagataatcggcaacttaaattttatattatttaagaactaagcttcttcctaatatcctcagattctttcaaaatgaaggaagaggaaataaattccaaaaggagggaaataaatatgtgagcacctcaatttgtgcgtaaatcatttttggcttattggaatgatttctgttatctctttgtaatcccaaaataataaaaataactaaaaactatacttcagagtaaaatgaagccatgcaactatacatatacatctaatgaagatgaaactttatactatttactgccactgacagtctgtactggctgggccaaaaaagcccagtagattctaaacagaggattttcttaaattaaaaatatacacacccacacaaacacacacatgtatctttaattatgtatatatatttatgatgacatacttgaaatcagaaattatgcactgtttaccccagtggtcaaataatccctcttttataggtcaacactaaccaaaatagattacatattaatatttcattgtaaattaattacatattttatgatttaaattaacttcaaaaacttttactaaagatcttttaagtatcattagcaatcaaacatgttatttccccctattaaacaagcaaaaatttagaaatggaattcaatactggcaagcgattttcaaagctgcagtcaccactgaagtaaaagatctttgaagacacaaattatgtctcacttatctttgtatgtacaattataagcacagtgcctagtacagtaggtgctcaaacaggttatctgattgaacaaatgaaagaaagacaacttcacattatttaacaagaatcat

SEQ ID NO: 73751 - DNA, 1029 bp, Homo sapiens
ggttcaagatgtagagtccagttttgtcaaaagtctgaaactgcaactttctgatctttgtttttctttacttttcatacctcattttctttatttcaacatgacttaatcttttggaggcgattttattttattttatttttaaaaccaaaaatgctctgggactccctagcttgtctctgtctctcttctatctttttttgtttcttctgaacattgcttgaatagaggccttccctttccccttttctctccctccgtctgtcttcccttctttttttcctctccatttctctcctttcctccccccttctttcttcttttctgatctcagaattttagaaatggagatattaaattattacttattttaaaggaaaattcttagaccgaacttaccagttcacacttccagatctgactagatgaaactcgtctaagaatgctttcagcaataaaaatagaactgatgttgtgtttggtgatggtgaaagttttctgttagttttgttttatatcacaactttccagagtagagggtaatgttaggatataagatttttttgatttgtaataaaggagaactttatttggggctactctcaaactgtaaagaaaataatttctgggaattagtttgagaagtttaacaatggtaagcttaggtttaatgtaacatttagatgtacaggtattatattaatagatatttctaacatggagaattataaactgaagggagagaaaacataattgttaaaccagtcagggaaaaaagtctttttagaatatcttgatgtctgtgggcatcttgatttattaggtgagcaaaatgaagaaacttaccattatccagattttccatggaatatgtagtggtattttgtgtattttgatatctatcccatatttaacttgtgacttctttgccaaccgaacatggatactctgtaggaaactttgcatcttttgtatggatctggctttaatttcctttttaaaatttgaaccttaaatttactgtaatcc

SEQ ID NO: 73752 - DNA, 1043 bp, Homo sapiens
gaactggttttaagtttgacaaccagaagatagatttggattatattcaggaattcagatagaaatagtaatagatgtgcccttatgaatcagtcaaattagttgacagttgatgggcgagtgaccttgcaatggaaaacactgaaattggagctgggagtcatgagtctgcctctggctttcacactcactagttatgtggctttgggcaagtcaagtaggtccttgtgcttctgaaaaaaccaaaactgtcatgcttatggtctgtattctcatagctcactttctctgtgtgtgtaagtgaatgtgtgtgtgtgtttaaactcagaggatttaaatcagaattaatgcttaaaaatctcatgcaacaattacttattaaatatcttggcattcttcctgaagagtaaaacatttaatctgcattttaaaattcctcaggtttctgaaaagcctagtctaggtttttttgaactataatgaagagatgagtttatatttcatgtaaagtggtgtatctacagtcacattatactgttgcagtgcccacatagtcagcagtgagggcacaggttcactgttaatgtcctggcaaacattggtgtcgttaatagttttgatgaaataaataattgttagtgattttggactcttcaccagaatgaaaaaactgaggaagtgagttctttattcagactatctaaaaagtgaactctctttaagacttttatgaaagattcaaaaataaactgtagacatttaatcttttccaattagtatggaagacaatgtgaaaaattagccatctagctcaagattcagctcacagtttaaattttcatatttgaaagcagagctaaaaattaggttgctttaacaattgcattaacagttaatattataaggatttaaaagttggtgtatgtatctttaatctttgtaattctaagaggaaagcctgtgaattttacgtttccataatagcacactttatttcaaagtccttccatctcttgaaatgttattgcttgaaagtctttttc

SEQ ID NO: 73753 - DNA, 1868 bp, Homo sapiens
atattatgcattatctctggaaattatacagttggagatatttgtatagtgcgttcatttagcatgaggaggtaaaaataagtctgactagagtaaaaatttagaattattgattctaatgttttaacattttgacatacttgttagaaacaatctttagtatgctatcataggagcagtaaggtagtagacaaaagctttgcctgcccccaggccttacaaagtagtttaaaaataaacaattacaatatattgatatgctatcctattttgaatgttgtaaaacattagtcacatacaaacacacacacccacaagctttgacatatgggactcatttaacagagtgtacttttagactcattatccttttcttattccttcctctgttatataagtttttattagaaaacatgatgctcaaaaagaaggctaaaattactagtgtgataacatttggggaaaattattctttgtctttaaaatagaaataattataatatgtaccttataggattattgtgaagatctgtagcatctatagtttagaacatctggtaaaagatagtaagcacttgatattagctattatggttgttgttttataacatcattttggataccaatattattactgttgactgatgcatatatagatacttgtgtgcacattttcactaaagcgtaattgtagaaaaccagaaacaaactaaaggtgcagtattacatttatggtatgtctatttaaggaataatatgttgccatgaaaaatgatgtagagatatacttactgagatgaatagaagcccaaaatttatgggtaatgaaacaaaatagctaaaaattttaacaaattgcttaaggtcaaaagtaggctaccataagactataaaattcctgtaaacagccctgaagggagagctcatatccactctctgcagacctcaatgggtgctcatgagattaagtggggacaagatgggagagaatctttaagtgcaggcctaggggaggagagcagttgctgctgtgggaaaggcgtgaagcctggattcttctctcctgtagaacaaagcctaaagaccttgagacagaaaacctttcctggggaagggaagagataaaaccaccccttttgcgggaggggcaggttcttctaccactggaggaaaagacccctgagaaagtcttgtccttgatatccagggacagaggctgatctacaacaacaaagaatgcctccacaagcccaccattagactagcaagcaccaagaaacaggtctcaaatgtgtggggatgggtcaataatatggagagagaccttctctgaggcatagcctctgagcaaaagcctaaagctgagagtggaacaagagcattgaaaaagaaaacatcctacaacccaacttccactctaagcacaaggttatgccagataaattttaaaccaatggtattctcaaggtaatcatagcaacaataaaacccaaacagtaaactcttgactaggttggcttatccccatacactaagttgtagcagaagatgagacacgcccatttttaggcatacatattatttatcacagtctctatactcctagagaaggtgtctggcttttaaccaaaagcattcagcagagctagactcatatatgatctagatgtcaaactatcagacagggaatttaaaataattaaatgctcaagtggaaaagatggaaaacatgttctatcacatgggtaatatcagcagaattggaaactattaacataagaaagaatcaaatggaaatgccagtaatgaaaaatacggtactagagatgaagaatgccattaacagattcaccagtagactcaacaaa

SEQ ID NO: 73754 - DNA, 1034 bp, Homo sapiens
gtcctagccaatatagtagggcaagtaagggaaataaagggaatattgtttaaaaaggaagaagtaaagcagtctctaatcacagagatcatgactttttaaatagaaaatgatttattaaaaaatggagaagggcttgatgtttaaaatataaaagataaagactgttagaaatgttccaggttaaaagatactaaggagacatgatgaataaatttaatatctgtgcttagattagatcctgggggaaatgctataaattacacaactagataactggcaaaattaaaatatgggagattaggagaaagtattatatcaatataaaattttgagggtgataactgcactgatattaatgtaagttaattcccttagtcctaggaaatactgaagaatttaggattaaagggccatgatatatgtaacttatcttcaaatgattcaggaaaaaaagttatgtagaaaaaggaaaagagtataagtgcagatgataaagcaaatggaagtaaaatgtcatagtcaaatctgggtgtttcctgtattatgcttgtttttgtaactctgtaaatttgaaattatttttttaaaaagaagttttcaaaaaggttcttcaaaaatgacaaaagaagagggccatcatacctgaagttggaaatcacatttctcacaggtgtgtttggagtaagcaaccttaagggatgaggtaatgtctttgcctctggaacaaagagcctgtttgcttactgcttgctgtaaaccagtggtttcccccagctcagtattcctctcttgtaacacagcctattcttttgcaaccatccaccctagctctgtctgttgctctcatgtgaattgccacaaacgtattgatgatcatgctccttgctgtgctataagtaataatttttttttttctctgacccaggcatctcatgccttttgccaatacccatgaaaaagtaagaggctaactgattaaattgaaagaataaactcaaatttcagatctgacagattactcttctaaacat

SEQ ID NO: 73755 - DNA, 1070 bp, Homo sapiens
cagagaatggtggtagtctttaatgtattaattccctactctaataaattgtaaggttaaccaatgaaaaggactgagttatttctcttttgttatcaccctcccttttccttggggcctcatatagtttctggcatatgtaaaggggaagaagtacatattttaaaatagataaaatgactccttgtggatatagagtagagcattgggatttagaggtggatttggaactgattgaacaatcagattaaaaaaccattaactaataaattattgtctacctgaagtaacaggaatactttgaagcagttttagaaattttattttgaagtaacttaagatgtttgtagaagttacagaaatagtatacagagctcccatacatcctcccacagattacccagattcaattcatatttctgagccatttgaaaataagttgaagacatgatgccccattatctttaaaacttcggtgtgtattttctcaaaacaagtggatactctcctacataactatagtatgaatatcaaaatcaggaaattattataacattgatccagtattatctgatccacagaccccattacagttttcctgattatcacaataatgtcctctattcaggagccaatccaggattatgtgttgaatttgtcatgtttctttgtcttctttaatctggaacagtacctcagaatgctttcttgtctttcatgactgtaacatttattttaagagtatagggccagttactttgagattatcctccaatttaggccatctgatttatcctcatgatttatgcatttttggcaggaataactgcagaaataatgctgcgttcttctcagtgcatcatatcgagaggcacatgatgtcaatttgccccattactggtgatgtttagtgacttttaggtagtttcttcacaataaagttaagaagtatgtcatgcagttgctcatcaagcttttatcctccagattttgcatccattgattattcttgactggattatcattatgactattgccaaatggcaattaaaaaaaaattcccccaacat

SEQ ID NO: 73756 - DNA, 1046 bp, Homo sapiens
aggctgagataggagatttgcttgaacccggaaggcagaggttgcagtgggccgagattgcaccactgcactccagcctgggtgacagagggcaagactctgtctcaaaaaacaaacaaacaaacaaaaacttactgtatcttatacttttgtacaaagcaaattagggcacccatgttcacttttctggtgttctttatttctcatttggaaaaggaagtttgcagtgtaaaattagtatgaattagaaaaatatgaaatgtttatcatttgtaagtaaaacacttttacactgaaaaatcatacttttttttttcctccataggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttgccttaacctgtgttttatgttatttttgctccaggttaaaggtgcaatgctttcctcctcttttcttgtgaaggatttatcttgtttgaaaactagcaatagctttcttattctttttagattttacaggaaattttgtattgggatactaggcacaatttccatctgcataacatgaatatatattatctatgttaacatgtttatttagaaaacatttgtgaagcgtctacttgtaacgagatggatgccattctgggttcagaagttaaagcatagaacgctgttgaaaaatgtgatagtcatggagcttatgttattgtgagaagagataagtaacaaacacatcaagataaataccaatgatagatgctgtgtggagaattaaaataggatttgtgttagggaatgaccgagcagctactttagattttgttgtcagggaggcttctgtgaggaggtgactttaaagttgagatctgaatgactaagcctgtcataaaggtggtgg

SEQ ID NO: 73757 - DNA, 1691 bp, Homo sapiens
tatgcatttatcataactctgaattgtacatttaaaatctgtactttacatacattttatcttaagaaaaaaaaccagggttgggttgaaatgagtataataggagaaaaaccagattggtctagaatgaagtttttgaccagtaattgaatatagatgtttacgcacaattcactgagttaagagtagtaaggcgtggcttttagaatgaattagatctttgttactcaagtgtggttgcatcatagtacctgggagcttcttagaaatgggaaatttcagaccccacccccaaaaccttttaacaagatccctgcttattcataagcaataaattaagctggaagcactagattagattagttaagcatttttaacaagatcccttcttattcataagcaataaattaagtttgggaagcactagattagaaaaatagactataacgaggaaaataacttcggaagatatttaagcttaccattattctacagtgaaaagggcatgggtgaaatgttggcaatagggatgaaaaaataatctgaaacaatttgatagactgtatatgcagatgatgcttaccataccaataataacgacccacatattctattcttgttacattatcttttctgtgttatcttaaatattttaaacattcctaagcagttttctgcctgttgccttgctggatttctcttaattatatgatttcttaatagatcctaaatcagtggcacattacctagaatttacatagtttctcaaaatatgctgtgagaaacactaactttgcaggactcttaatgggtaagaaagatttgaagtcaagtatcttgaaaatattgggttaaacaatttttttgaaagttacaggtatatttggagggggggcaattatagaatgcctcagttttttcaaaaaatattccatgtattatgaacaacattttctaaacattttagggagcagcacttagagctagccttctttggcacacagtttaaggtggtagtcccttgtggaacagacagcttgaaaacttttcttgcttctctcttaggtttatgtgtaaacttctagttctcaactctattccctacaatactttgtttagtcactttcttaaaacttggcacttgtagaaaagattaatagtttactttgtgtgaaaactcgtggagacactaagtttgataagttgtgggttatttctgtatactgctgttaatgaccgtgatagcggggaaaatagaactaaaatgagaactagaactaaatgtttttgcttggtggacttttgagaacatcatctttcactgggtataatggtttgctttaaattactgaaacagatgagcttttataagccccataatacttaacctgaatattttcaatgttcatttgtgagtaaagcagaaattacctgtattctatggcaagtcgaagtttaagctatcttaaatgaaaactatctttgattccttataaaaatatttgaacgaatctgatttaaatttattttattccatctttgatttgtgtgcaagccttatttgataagctttatcactgggctgtgtataacatacaacctgcttatttaatgaaaatagtagagcttaaaaggtatttttagacattaatgtttgtctactactgtatctttcaaaagaagcattatag

SEQ ID NO: 73758 - DNA, 1021 bp, Homo sapiens
gctcagttcctcagtgtcaggaagtggcatatacagatctcacttaatcactgaagctataattttgggtcaagtgtatgggtagctgtattatctggcctttttttggtaatacagttaatacaatggcctggaatatcagcttagagttcaaagaagcaagactagtatgcatgatataatccatcatccttcttattcatgaaagtgcttattaaacaaccacattttgataaatgtataaatacagatgagtaaataacaaaggcaattttaagtctttttgtgtagcactgacatttgttctattattagcctgtttctggaatatgggcttcattgtgcagccattaaggaattcatcaaaatttcatatcagctgtgtggatctcccctgtctgtggctgccacctggctctgcttcaggctggggtgataattatttcatgtggcactgggagccctcctccctaccgtcactgaatctgttctccttttcctccggcttttctgtcttctgactccatgctctgttccaggacatagggtaattatcattattctctgttgtggaggaaaatattagttaatgctgggtttcagacttctcctctcctgtcaaggcatttgttaggtctttcctttcctgccaaaggctcagagtgttttcccccagcgtaggtgccatctgtctgctcagggactcttgtttctgcatgtggccgaggagcatgggtggcctggctgagaggcagtgaggctggttttctttctcaccctctcctcctctttgtgactgccttctgtggttgttgggcagctcccccatcttgctgtctctcattgtacctaaagtcaacatctttttcctgatttgtgctctttagtctctgaaccttagttaaaacttctctgtatgccttgagcagtagtctgtcttttcttttaatcattttgcttttaggggaccttaaaataaaaaaaaaaactatttacgaatacttactgtcatgcatgtcat

SEQ ID NO: 73759 - DNA, 1039 bp, Homo sapiens
ctacatggctggggaggcctcacaatcatggtggaagatgaaggatgagcaaagggatgtcttacatgatggcaggcaagagagaatgagagccaaacaaaagaggaaaccccttataaaaccatcagatctcatgagacttattcactatcacaagaacagtataggggaaactgcccccatgattcaattatctcccactgggtccctcccacaacaagtgggaattatgggagctacaattcacaatgagatttgggtggggacacagccaaaccatatcaggcagtgtcttccttttctttgttatcttgaaagggaacatgtgtattgatcttttatatttctcaatataccagaaagtattttaagatactattcttcatgcttcaacttttataacctttaatcaaatgattccaataagtggaaataaaattactacttgatcaacgggaaactaataattagatgcattgtagagctgtcagtgtatctacttttgagataaataagctggaaactttgttgagatcgcttaaggccctagaaagaatctaggaaaaactgtttctgcaagttgtttgaggaaagctgatttctccacaattctgccattgggaatgtaattaactctcaacagggagttggagaattctacaaacccatttaatgtggccctctttgtgatatctttcgtgtgttttcagctttgagaccatacaattaaagtgaattatggaaaaagacaataaatgtacctgagaaaaccttgtcctgtggaattatttatatataatgcaaagatgaaacacttaagatagatgcaaatatatgaaaggaggaaatatcagaatttcatattaaaatatttctggatataaagtagctggggtagaaattccactttgcaaattaagacctattcttgtgaaaaaaatataaatacatatatgtaatataatatacttatatatttttaagagatagggtctagctgtgttgctcaggctagagtgcagtggcaggatcatagctt

SEQ ID NO: 73760 - DNA, 1022 bp, Homo sapiens
taatttctttcagaatactgaattctcaacataagaatgagttcacatttaaagtgtgatttattcttatttttaaacaacctactttcactatgttttgagatggtttgtagatttataacttttgcaatgttgtcagaagacagaaagtaatttaataactcagtttcttcctttaaataaaggatgttgcatctggcaaaacagacatttatctgctaagatgcagcttcttactttcattctacagatggatagtaacaggtaataataacagctagcatttgtgagtgcttgtcttgggtcaggcaagtgctaagtgtttcatgcatattatctcatttaattctcaccataaccctttgagatgggtacatttaatctccatttcacaaatgggataactaagatgttatgtagcttgttcagaattgcaggtagaaagtggcagagcagggctttaaacccaggcatcctaattccagtgcccctacttggcctcaacaggccaccattgacatcatgttgtgaccttaaggtaagtagctgaggcagcctctgtagacctaatagtcctgctataaaattgtgctttctttttttggttttaaactcataaaaaatttttgttttattttagggggagtcttaggtgagtttacaattatatggtataagagttgctaattaaaaaatcagatttttcgagttattgaggttggagtagctagtatgtgcagtacaaatgttttataatgcttgtgaaaatgcccacagaactgttaaaacatttaaagagaacttatcttatactgaaatttagagtattatatttttattatcttcctctgtctctcacacctacacccatgcacacacacagtcattatgtgttaacacatctttttatccaggaaaattggatgaaaagattaactgaacatttttatttactgatctaccttctatacccttaacagaggaggattatttttgaagctgtattatgttgtaaaataccc

SEQ ID NO: 73761 - DNA, 1011 bp, Homo sapiens
aatattctaatgggtagaattgcctggtttggaagttaatacacaaaatctttgcttcatcaataaatcatgatgattggagtggtagatttttcctttaagctttaagtggagtcattacattaccaaaatcaatttgagttgtggaccattcattcaattaatagacaccattgagaaccacaccccagactttgcttacaaagaagtaagataggctagtaccatgattgatagtataaggcctacattgtatgtgtagtgtaatattttgttccccaatggatgcatagtacagttagtcaagtatatgaactttgggaataagggagaggcaggcctgtgaggcataaggatgaaatcctgggtgaaggtagaggttgcagaagcgagcaaataaattctaagaatgtacttgagtactcacccacatttttgaaagcacttaattatttcaatctagacacttatcgcacaggtatttatgctatctgtccacatgtaagcagtgagagtgtatacactagtacttagagattttgattatccttttgaaggagttgtttgcagcaaaaggtctggagtcaaagggcctaggttagatttcttgctccattatttttggacctttgaataagtgacctcacatctttgaacatttgaccaagtgatttaacatttgagccttattttctcatcggtaaagtagagatcaaggtatctgatgtgcctaattcacagagttgctgagttcaacaatatatattttaaggtttttataaacgatcaaactttgtatatatacaagttgttgctagatgatgggcatgtaaataacagtctatcttgtcagctctgttggcaagtgttcaaagttctttgtcttaaggtgatattattaattttgttccatatgaagttgctgatatttaaccatttgtgacctaaagaagtgtcaatttcgtgtggtttcacctaacgtataggtgacatgtataggacacacatgtg

SEQ ID NO: 73762 - DNA, 1087 bp, Homo sapiens
tagtgagtgagttctcacaagatctgatggttttataaggggctcttccccttttgctcagcacttctccttccttctgccatgtgaagaaggaggtgtttgcttccctctccacaatgattttaagtttcctgaggcctctccagtcctgtggaactgtgagtcaattaaacctcttttcttataaattacccagtcttgagcagttctttatagcagcatgagaatgaactaatacaactagacatttatatttttaaacacattaaagaaggcatctttaaaaaataatttgagacaggtacactaaaatcccaggcttcagcactatatagttcacctgtgtaaccaaaaaccacttgtatccctaaagctattgacattaaaaaattaaaaaataatttgaggtgaaattcacataacataaagtattaaaaccattaaaaaccattttaaagtacacaatttagtagcatctattacattcacaatgttgtgcaaccattaaacatttctaatatttcaaagtaaaacctcttaacatcaagtggtttctccccatttcctcctcctccattcagcttctggcaactaccaacctgcatttcgtctctggatttatccattctggatattttatacaaatggaatacgtgacttttgttttctggcttctttcacttactgtaatgttttgtagcacatatcagtacttcattcctttttatggctgagtgctattccattgtatggatagaccacaacatgtttatccatttacctcttagcagacatcagaacggtttgtaccttttgatatgtacatgcacatgcatgtacatgtaatgtacttatttgggaatctttttaattctttgggatatatataggatatatacctgggggaaggcatctttttaatagaaaggaatgggagtgagtgggaatgtgggatgaggaggaaaataattaaaataacaaaataaaatgagagagcccttatactgactgataagagcttgcttaaataggaatgatgaattcaactttgggtcctgacatttcttcccaagcacttacattactg

SEQ ID NO: 73763 - DNA, 1037 bp, Homo sapiens
agtgtagattactgctcagtggctaggcacttgtcctgtaacaggtaatgtttaacgtgccagtcacaaagatcacagaaacagtgtatgcccgggcataagatagcacgactgtgtatgctctggaggactgaaaggctgtacaagccctatgtattttttttcaaatatacatatgcatgggtcttgctgctgcctcttttgctgactgtaattggactttgaagcttcgaagttatatcataaaaatttgtaacctttgtctgagagagagctcagctaagcaatcactttccacttcttttcacaggataatataaacgttttcttgaaagcttgtgaacagattggattgaaagaagcccagcttttccatcctggagatctacaggatttatcaaatcgagtcactgtcaagtaagtttcaacagtttgttagatatatatatatatatttaaacttagggcttgtagcttaagtgaaaagaattgctgagagttcatgattacagaaaaattcttctgttctctctgttttcctctgttctcattctaaaagagactgttttaaaaatggcttagggactgtgaaggtgaagctgtttgtaactcataacatagcatagtcttactataaatctctataccgacaaaaatggtagtgttaatattttaatgtgtgtccaacatggtagtgtttggttgctaatgttgaggatactcataaagtgaatttaggggttatattatagcttgcagagtaacaacaatctttaaatttttttatatatttggaattaagacataattattagcataaaaattagataggacagtagtaaaaaagaatctcttaatattgtgaaggcagcagcgcctgggaccaacatgtaatgccaaggaccttgtcagttgtggctgacttttaaaaatgagctgtttttcacgattttaatagtgtggatgagaaagtgaaagtgggggtgagaacacgtatgccagtatctgttagatttttggtgaaaaatggtgtttgt

SEQ ID NO: 73764 - DNA, 1068 bp, Homo sapiens
aaaaagaaagggaaaaaaagccaatttcggttatttctagggatttccctccacccccaggagacatttggcaatgtctggaggcattttttattgtctcattgggtgggtgggggtgtgtgtgctactggcaactagtgccttcatagccagagatactgctaaatgtcctacagtacacaggagtgccctacaacaaatagttttctggccccaaaatgtcagcagtggtgctactgaggaaccctcattgagactataaatctataaatgaaaaatctacatcacattgcctttttattatagtgtatggtaattccaaagcctcttgcccaagttttagcattgattgctcttcagagaattcctatagtacctgatggaaatatacttagaggtacataaatcagtatgttcctatctccctctgaaagttggggagccttaaccctagtatcatggaatttctgtttgccgtataaggctatccatgattttatatttgagaaaatttgccacatgctggttcttttcgatccttactccttagatagtcacctataaagttcctgaaagtgagttctaaaaggaaatgccttaaaactagccaaaaagtgacaggagcatagtaggcaatctgcatagtgggagaagagagtaagactttagcaaccttgttttatgattgacaccttcttccttaaagttcctctttttccttctaaatgttatttttaaaaaattctattcaacagaaaggcaagatgctagatctgtattttttggaaaaaatccagttgcagttctaaattggagcctttccaaataaggaaatacaaatgaagcaggacttgtaagagacatacgatgtgatttgccagctaatcatccttcattcaacacaacatactagagctgtgcaatccttcatagttttcccaaacaattttcctgatgctatctttggtacttatctcaaatctgtgaggccgacagatagggatgtggagatagagaaacaaatattgccgctttcccaaggacatgtggcttgtgagtggtagaacc

SEQ ID NO: 73765 - DNA, 1918 bp, Homo sapiens
taactaggttgtgtgttgtgtatagctacagcaagacaagtattactgctgttttatattttaaaccttgatgctggtaacatgtgtttcttccttattgtgaaagggtgttacaagtggtatcagcaaaatcatttgcttttgaactctgaggtatttatatggcccctatgtgaagagtgctttggaaatggtttaagcccagtcaactctcttttatctgtcggtgggttctgagccttcctgctgcagctgtccagtcctttcctggatgctgacactgaggttggagaaagtcaaggctgggcatgtactggtggggggtgtgtgtatgtgtgtgtgtttttctctctctcatcaaattccaaagccaaatagaaatgatttctggaatcaccattgtaaaattgcccatgccttttctctcctccaaaacaaataatagagagttgagtgtaatttatttctattgtgagcagttcatttttactccatttttacaaataaagaattccagagacgagacactgagacttgcctagctttatcctaagagtgagtgacaggttactctttctacctcattgggccactttctgagtgatgactgctatgtatcccagatggcaatattcacgtttctgaatctaagcacttttctttcttttctccttgcccgatcagctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatctttt

SEQ ID NO: 73766 - DNA, 1010 bp, Homo sapiens
gcttgtctcaccactagggggaaggcaaatacaactcttgggtgcttctgtagctcacacgagggtaaataacgaaaagttttaatataaacttaaaaattaaaaaacaaaaataagtaaaataaaacttggggtttctgatagggcctttgagtactctcaactctagcccttcttgttgtttaggttcaattacatgcattgcatgccacaagaatgtctagcattttttgagtgtttactgtgtggaagacactgtatggaacatgttacctttaatccccaggaaaactgtgcaaggcgggcattatccacgttttacccagaaggatcctgaagctcacagaggttatgtagcctgcctaaggttacccagctagcaactggcaaagctaggaggtaatgcagatctgattgcttctaagccagactctgcttttattttttgctgattcccatagttcccctctctcacagcccactggatgtgtgcatatggtccactccatcactacagtcatgaaggataatgccatgaaaacattttgctctgtgtttgagtgattctgatttcatgaaatgatagaaattataactatgttaaatattgtcagaacattatttctggaatagtatttgattaacttgtactgtctccattcatcccacagagctctggggcccacattccacactcctttgttcttccaggaggctgttctccaccagtacctctcctattttctctctctgcagcttacagctaccaatgaccgtaggaatcaacacaaactctcccatccggcctctactgtttgccatttgcccctccccatctcaccttagctaaggttttgcattgacctgctatttccaatcacgtcagtcaatgtatgtttcttaacagtagccaccatttgaactattctgtcatacttgccacgttcagttgcttagcatttttaacatcaaattcaaaatgtatccttcaaaatactttcattgaatat

SEQ ID NO: 73767 - DNA, 1073 bp, Homo sapiens
aggcaaagagctttattaacctttgtttcaaactttattcccaggcttcttcagcttaattagctgcaaagagtgaattgtatataagcaaaaactgaaaagagctgcagtgtccaaggggcttaaaaatattagagatctagattttattagatctgtaaacaaaacatttttaaaaagcagtcataacataaaacagcagctctcagtaactacttcaagttttatcttcttcagaagttgacttaattcagtttgcctcattgttggaagcctcatcagaattctccacaagatctagaacttcatcatcctctccagtagcaagtggtgcttttccacccacagattgtttgggcagtgttagccagtctctttgaactagtcagaccatctgcagcactggtttatgatcgatgctgagtagcatttctgtcagctgctttgtctcagcatggcctgtcatggtgaaagtgtttgctgccagcgatgcctgaacttcagggttgttaaagtgaatcactgttccttggtgtgtaaacatattcacctcttcaataccagggatattgtttacccctaatttctttaaggagaactgaaattttttatcctctgctgtcgctaggtttatgatcaggactacccttatgtataaaaccgttaacctctgagccttgaagggacaagataaatgccagctgccagtcttttggttgtaccagaaggcctggacaatgagaaccctttttctggattggttccattgctgttttgtccctgaagtcaagaagtaccttaccaaactgacttttaaagttcttttgatattggccaatgtccctggacattcaaaacctcatgagttcaacaccaaaggtgtcaaaggggcctacttgccctcaaacacagcgtctcagatgctgtgaaccacctttttcctgtgagcagttcctttccgaccagtgtgcacttctgcttgccgtttggtgagtttttggttcatgattgtttctttcatcttatctgagtggaaaaggggctgcgtgggggactagggttggcacttgggg

SEQ ID NO: 73768 - DNA, 1034 bp, Homo sapiens
tccctggtattgaagaggtgaatatgtttacacaccaaggaacagtgattcactttaacaaccctgaagttcaggcatcgctggcagcaaacactttcaccatgacaggccatgctgagacaaagcagctgacagaaatgctactcagcatcgatcataaaccagtgctgcagatggtctgactagttcaaagagactggctaacactgcccaaacaatctgtgggtggaaaagcaccacttgctactggagaggatgatgaagttctagatcttgtggagaattctgatgaggcttccaacaatgaggcaaactgaattaagtcaacttctgaagaagataaaacttgaagtagttactgagagctgctgttttatgttatgactgctttttaaaaatgttttgtttacagatctaataaaatctagatctctaatatttttaagccccttggacactgcagctcttttcagtttttgcttatatacaattcactctttgcagctaattaagctgaagaagcctgggaataaagtttgaaacaaaggttaataaagctctttgcctagtaaaatatgtgtgtgcctgtgtgtgtgtgtgtatgtgtacacacatatatacatgcatacacatatatgcatatattcacacacatatataaatacatacacatatacacatacacacatatagtattcattaagtagaagtggatcaccacaaaggtcttcatcctcgtcatctttacattgagtaggctgaaaagtaggaggaagaggagggttggtcttgctgtgtcaggggtggcagaggcagaaggggtgaaggaggtagaaggggaggcaggagaggcagggacgttacatgtgtattagtccgttttcacgctaataaagacataactgagactgggtaatttataaagaggaagaggtttaactgactcacagtgccacatggctggggaggcctcacaattatggtggagggcaaaggaggagcaagggcgtgtcttacatggcaataggcaagag

SEQ ID NO: 73769 - DNA, 1012 bp, Homo sapiens
ccacaaatcatctgttaattgtccttttagtagccaagacatgaagtacccatctcccttctttgcatttggtgaaaagattcgaactcgagccatctctgctaaaggcatgactttagtcaccccactacagttgcttctctttgcctccaagaaagtccaatctgatgggcagattgtgcttgcagatgactggattaaactgcaaatatctcatgaagctgctgcctgcatcaccgctctccaggcagccactgaggctctggttgttgaagtaaccaaacaacctgctatcatcagccagttggaccccgtaaatgaaagtatactgaacatgatccgtcaaatctctagaccctcagctgctgatatcaaccttatgattggcagtacatggtatggagatggtccaggtcctcctaagatggcccaatatgacaatggaagcggatatagaaggggaggttctagttatggcagtgaaggctatggcagtggctatagcagtggaggctatcgtagcggaggctatggtggcagctccagctcctgtcgggcaggatatggtgcaggtgttggtggaggctatagagaagtttcctgaggtggctatagaggcaactctggaggagattacagagggcctagtagaggctacagatgatctgggggattccagcgaggaggtggtaggggggcctatggaactggctactttggacaaggaagagaaggtggcatctgttaaggcttggttatgtcagttcctgtgtgtagacagtaagaaaaaaaaagccatgctatgtgtgacatttttttccaatgtttatttcccaccaaaaagtaaatgcattttaacccattctgtggttcactgtagcttaaggaaaccaagcatatagatgcattagtgattttgtttatattatgtaaaatgtaacgatctatcttagaaataccacagtttgtatttttctttaaggagtaaagatttgtctttaaaaataacttg

SEQ ID NO: 73770 - DNA, 1014 bp, Homo sapiens
aaaattgaacacattggaaaaatgttcatttattctgtaaacatttgcaaatgtctactatgatctggagctataaaaattttaagacaaaattcctgtcttcaaaattttcacagtgggatcagggaacagggaagcccgtatttatcagagtgcttttagtttatcatttgctattaaaaacattattggaagtttgttcacaagataacaaaatgtgtgtttatatttattaactatggtccgacctttgaatggtcccctaaaaatgttactggattctaaaagacgtgagaagaatcagattcattttagaatctaagtagatggtttctttttctttattaggcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttggtaaggatgcatcttggtcttataactttggttaattcaatgatttggttattaagttgatttttaaggagtaatcactatttagatggctgactttagatcatgttggtgtttgtcttagtacatttaaaatgagtagtcaaaaatagttactatcagattttgtaatcttgacaacaacaaatgtaatcaccattatccattgtaatattatgaatctgaaaccagctcctgtacctagctcctggaaggtgagaagaggcccagaagtggcagggcaggcaggtaacacctcttgatttccatactctgttgtagtcacttttccaggttaacccatcaccatgtgaggtctgtagagctgcttccagagactggcatgggggctcctcacacttattctaagctctaaggaaattatcagcttgtccacataacatgcaggcctcctatttgagatgagccaaataggggtgtagtggccaaagctggggtggatg

SEQ ID NO: 73771 - DNA, 1117 bp, Homo sapiens
tttcccatgcatgtttatagcagcacaatttgcaactgcaaaaatatggaaccagctcaaatgcccatcaatcaatgagtggataaagaaaatgtggtgtatatataccaaggaataatactactcagccataaaaaggaatgaaataatggcatttgcagcaacctggaataatggtctccaattccatccaagtgaagtaactcttcaggaatagaaaaccaaacattgtgtattctcacttgtaagtgggagctaagctatgaggatgcaaaggcataagaatgattaactttgggaagtcggggaaaagggtcggagaggggtgagggataaaagactatacattgggtacagtgtacactgctcgggtgatgggtgcgcaaaaatctcagaaatcaccactaaagaacttattcatgtaacttaacataaccagttccccacaaacctattcaaataaaataaataaaaaatacaaataagagatgaaaaaaattcccaaagtttaatggttccaaaagtacattttacaaatgacctctaagtaaaacattactgaaatgtttcaatggaagtataacaatttctttcatttggtttttgatgcaatgatcaaatattgctatattttcacaacttacctgatatagttgctacttgaactaatgtcccattttccttccagtgaacatcatcaattccctcaaaaaagcaggcagcgccttgattacaccagaaaggggcatccatttcaggtcggagatggggaaatgtacagttgccaagttggaaaagttcataccattccattgtgtagttcttgccagttaatgtacttctgaatccaatggcatcatgcataattttctgtgtaaagacagtacatgtataaaagcaactgtgacacaaccatgggtccaggtaacctgataggagaaaatgtggcacatcacaaatgcatatcaagtagaacaactgttcagctgttcttccatgctgctactgtcatatccactctgtggccccaaactccaggccctcatccaccccagctttggccactacacccctatttggctcatctcaaataggaggcctgcatgttatgtggaca

SEQ ID NO: 73772 - DNA, 2203 bp, Homo sapiens
aagagagggttagccatcctggagtatgaactcggcctaaaacatttccagtttagttgatttgttggaaggacttaacgtggcaggtggagaggtcatcagcagcatcccagcaactccaagtacagggaagaaagaaacgtaccaaacacacaaggtggatggggtatggtgcttgttctcataacagtaatagccagccttctagagcagtggctcctcaggcagccattcatactttatgtgtagcatgctttgcaacagtgaagctccacatttcccacacctccattttccttacactgtctttgcccattctgcttttcctctttcgcaattctttttgtgctttccttttctcttttgcctctgaatccaagatttggtgagttgggtagagaaagagagcttctgcatttgtataatttcgctttgactatagcttaaatgattatagaattagtatgtaagatgacttctccttatacacctattatatctaatgtttataattcagaaatatcttgtgccttgaagaatggaataaaattggctgagcttggattcctgttgtgaaatgcaggtgtggaaattcaaaaccattgtttactcaggcatccagtcttaatcaagttagaacattttacttaaaattaatatgattaggccagccatggtagctcaaacctataatcccagtgctttagaatgctgaagcaggaggatcacttgaggttgggaatttgagaccagcctgggcaatacagcaagaccccgtgttgcccaggctggtctcaaattaaaaaaaagaaaaattaaaaaattagttgggtttggtggccagcgcctgtagtcccagctactcaggaggccgaggtgggaggatcacttaagcccaggaggtcaaggctgcagtgagctgtgatgttaccaccgcactctagcctcggcaacagagggagacctgtcttaaaaaaaaaaaaaaaaaaaattaacatgattagctttgttcactaggtgactttgttttgtttttttaaactaggaaacatgttcaaccaaatggcaaagtgggtgaaacaggacaatgaaacaggaatttattatgagacatggaatgtaaaagccagcccagaaaagggggcagagacatggtttgattcctacgactgttccaaatttgtgttaaggacctttaacaagttggctgaatttggagcagagttcaagaacatagaaaccaactatacaagaatatttctttacagtggagaacctacttatctgggaaatgaaacatctgtttttgggccaacaggaaacaagactcttggtttagccataaaaagattttattaccccttcaaaccacatttgccaactaaagaatttctgttgagtctcttgcaaatttttgatgcagtgattgtgcacaaacagttctatttgttttataattttgaatattggtttttacctatgaaattcccttttattaaaataacatatgaagaaatccctttacctatcagaaacaaaacactctctggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcagttacactttttcacttaagtgctttagtttagactaactttacaacttctataacttttggaaccaagtttagtatagtctgattacattccattcacctaactttagacattcgtttagacaccataactggagtgattgtgcttctagatgtggcaaatccagtgttaacacatatttctggctgagattttggaactagctagtaactggcttgtgttctttaagcatactaacatcactaaa

SEQ ID NO: 73773 - DNA, 1057 bp, Homo sapiens
tcaaatatggatttgaaacatttttaagtttaaagtcaaatgtttgtgtagtttttaaaaagtaaaatacaacagcattagtaactttttattctcaaagtgataaaagcatttaacatatactttacagtataaacaaattaagtactatgcattttgcttataaagtgacaaagtattttaagcattatataattcaatttgtacaaaaagtaaatttccaaatacaagctttggttagtagaactgattatgtactgtcaaatccatttttccaaagttgttcaaggaaaaacaacaacttgactagcacaggtaattcttgtacaatcagagctttttactatttagaaggaggggatatattactataattgctgttaattttcgaatctagataagccttttttcttctcatatgttgctgtaggagagcatatcatcacttttggaaagcaaaaattatgtagaaaatcaccttttgctttattcttaagaaggccatccgttttaaaagtagatctaagactgttagcttcctcaaccactgagacacaatctaaaagtcacaccactgaaaagagccgctttaagaattaatgtattccaccggggttaaatcatttctgatttccctcaggagggtagtaatatctactagcactagtgcccagcatcaaagtttatatcatcttttaaaactcaacattttatagactctacaatgcatggattacttttattcatatgaaagtaatataaaatgttacctaacttaaataatataaaatatcggtttaaccaaattaacaatcacaaaactgcagacatttttctattaaagttttccagttcactgagcaatatttactgaaaaatatgattatgaacttaaatatgtcctctttaaaatttgctgtttatgctagactgtacaatggtgctccctttatgatttttaaaaattttacttacataactatgtaattccaaaatagaaaagtgagtgagccatcactaaaatttactggaaactaatattctttcatggaaacaa

SEQ ID NO: 73774 - DNA, 1940 bp, Homo sapiens
ttgtgggacatgtacttgattgaatttttcaacagataaacttttacaaaaacttgcaaataattttttttttctttcaaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatga

SEQ ID NO: 73775 - DNA, 1092 bp, Homo sapiens
attgagtttgatatgaaaatattaggagaaaaatattaacatttaagtagttaaatagtttatcaaaatctagttaaccagttgtttaatcacagtagggaaaaagtaaattagggaattgtgatcaagaaggtagtgttttggttgggtgtggtagctcacagctataattggagtactttgggaagccgaggcaggaggttctgttgtggccaggagttcaagatcagcctgggcagcatagcaagacccatctctacaaaaaaaaaaagttagctgggtatggtggctcacacctatagtcttagctactagggaggatgaaacaggattgcttaagttcaggagttcaaggttgtagtgagctaaggagtgccagtgcactccagcctgggtgacaagaacagtactctgtctcaaaaaaaaaaaaaagtaatgtttcattatactttcttggctcttagcctgcccttatcctttttcactcctgtagagaatttataaagcttaactggagcatgaagttggttttgtagagaggaatgtgttagaccatgtattagcctttctttactctcctagattctttgcccagtggtttcaactcatatcttagctccgattgagagctgcatactttgagaatgctttaattcctgtttgcctacattgattcctttagatcaaatcctgtccaacagatatataacgtgtgtgtgtgtatgtgtgtatatacacatatgtacatacatacaaatatatacatatatgatgaatgatactcattggtgcttttgtggatcaaaatacattaaaatagaagacttgaaaatattgtagataacatttgaaggagttttaaacttggaattttaagtattattttgattgttttataatcaaattttctatgagttttcatatctcaaatgagtctgtcatagattttgaataaattattaatttttaatgatggtgttaatagttactatttagtggtcataactatcaaacagaaaagaaatgcagtttagtgttatagaacactagggtttccagatatggcaaaatgaagtgtctgagagagattct

SEQ ID NO: 73776 - DNA, 2133 bp, Homo sapiens
ctgtttggttttagttatctttgaattgtgtaagagtgttctaatggtaaattgtatacaaagatgagtataatacaaatacattcctctgataggtcttaaagtccagttccacctagtagatttgctgggtcatttttatagccctgtgatacaattcaggtgtatctagtataaccctcataaaatcatttgtgcaaaagttgaacatttttagtagggttttttttttaattttcctgaggaaataatttctgatttacaaaaaagagtcacatcacaggattcttctgggctctcctgatagtcttcactgattatagaccaaggaggcttatagttagaatttttagtctagaagagtggttctctaactttatgtgcatcaaaatcacctgaagggcttgtaaagccaaaaattgctggtcccacccccacagtttctgattcagatggtctgggttgggtatgaacatttgttcccatttaagttcccaggtgatgttgatgctgctagtctcagggaccacatattatctataagtagctctgaaactaatataattagcacattagttttacaatccactcttaacatttttgggataaagtagtgtatatgaatctggaaattaataatatccttttaactgttttaaggtgcttcccaggaaacaactaactttttgatggatgaactcctttttacatccttgagggattttttggccctttatccttcccttaggaaatgtctttgcagaagtatgtgtgagaatagctacatcttatttagtttagattttcatgcctgactggtccagtacactcattttacttcacatctttccattaataacattaatgatgaatcccaggttgtgatacacgtgaacattttgagtaaatacttagtttttattgcataccatagacactgtatttacatctattatgtgatccactaccaaatacataattattttttaaagactataaattgatttactccattagtttatacagtcactttggaataaatcagtgtaaaagccaacattaaatatgtctcttatcataatgaaagctaggtcttgtcttgacaattgcccttatactttttcagagagacttagaaaaggccaagttggaggtgagggtggagggtggatgattgaaagaatattctttaagttataatgcaataaactagtaatgatacttctataaaatgaatatgtgtacagagaaatataaatatatacatgagtaatcttgaagtctgggtatttggggaaaaaagtaaaaaaataataaaatattcatgagtaaacggtgtttcttttctaaggtggacagcagcaaggaatcagctgaagcagcttgtgatatactatcgcaacttgtgaattgctctttaaaaacacttggacttatttcaactgctcgaccaagctttatggatttaccaaaggtatctgctgtttttgttttattatctattactgagaaattcagtgaaagtctaatcttttttttttgtattgacagtgtgagtataaggaaagttatatatatacataatggaaaaccagttactatttaggatgaaaataaatagtatttttttaagcttttttttttttttttttaaatcaccatacttctaaattggtatggttaaagaaatttacagaggcgtctataggaagtattaaaagaaattcagtaagtaaaatagagtcaagcatattagaaaaaaagggacacatagatactcattttggggcttccagagcaggttggtgaagttagaatcaaagaaaagtagagtgccaatattgagagcaggtatagcttctaaaatcttttggcaaatgttctggaaagatttaatcatgaccaaagttagtctcagcacagtttagattaatttacagacttaaagacatcctttctttgggtgaaaagttaacatatattcttatatatattctaacatgatcctgcatataatcagagatcgtgtctctctctcacaactattctcttaaaatacaaaaataagaagggtgcatttttagaaaggcaactggtaaaggtgtctgaatatgttagctaatggttaatagg

SEQ ID NO: 73777 - DNA, 4514 bp, Homo sapiens
gatgctctgagatgtttaattttatgtatagcagagtttcatgtgtaaatagatttaataagatactattaaagtagtgtaaattttttcatacataaatgaaatcaacttggaaaaattgacatttaaaattttaagtgtccactcacttctgttattttcatgcacaaatgaggatagtgcagaggatatttttattggaatttggccttacatttttttcaattgcttaatgcactataattgtaacatagacatattacgtatgacaattaacagacttaattcagctatttgtaaactggtaagttcttaaaataggctttggtgatcatatagtgtttttatatctagatcaagagatactgtcccttagtgttgcatactgttaaaaaaaattttgtcaacttctttaacctgaacttggaaaggtatttaagtacattttatttaaaacagtactataatagacaaaagaaagtttctatttttaggaccagcaaagtatttattagcaaagactattatgtgaataaggctaccattttatttttgtttatatatccatatactctaaagtaaaatgaatcattccgtctttaagttgtctagttctggttttagaagattgttctccagaaacaggcaatcagtattctataataaggtgtagaaattgcaaagactgtcattcttttttgaatctctgtatctcaaaattgtgagtagttttaggtggtcagaagagaaattataagctctggatagcaaacactttgttctttgacccaaattttatatactaaaattaaagtaagccttcagggtaagttaaagcagaaaaatgggtcataataacagtgttatctcagcctctagtgagggattattattagaagagacttaatattaaagattacagtgtagactatacacttttctctaaacttattaaaaaaaaactaatctcaagtcacacataatttccagtcttccatcagactaccttcttgctgtcacctctgtcattctattttctctcttgttctctccctgatcagtagggtatacgtaatatattttattcacatagttgggaataggagcagtgaagaataggcagtttattgcacatatgctaagacgtctttgactgactttcatggcattaaggtcagaggcctctgccattctctttttactctccagccctcaatcctctttcacaagttttgcgaggtactgggtggagaaagtctgcagaaacatttgttttacagtaatgcatatgcatatccttcatctcacacaggaatgagaaattcttttatgctgataggccagaggagtgttggagcaacaagccatctttctgaaagattgtgaccccaagtttaggtcgaaaccactaccctgccagaactgttctctagaaacaaaagtattacaggctctgaactaagtaactaccagtgagtggtctgcagccatttagtttagagcctgctatacttttccaaaaagtccgattacacggtaatgcattgatagtaaaagaaaatgtgtaaaacataaaaagggaagagatgtttgcaagaaaaaaaaattacctgtaatctgccgtctactgttggttactataataattcagtgagtctacttccagggtgtgttttctcgtacacaagctcacttgccctgtctctctgacacacacacacacacacacacacacactctctctctctccattttaaagcaaaaatagagtcgggtgtggtggtgcatgcagatactctggaggctgaggtggaaggattgcttgatctcaggaggtcgaggctgcagtgagccatgatcgtgccactgcactccagcctgggtgacagagcgagaccccatcttgaatgaatgagtgaacggaatgaatgaatgagtgaacggaatgaatgaatgaatcattctctgccttctgggtagtaaccctggtttttagcatgttgtgtactttaatgtcgttaatgctggactgctttcctacacaacagtcatatctcaacagttcaacagtcgtatctcccctttgaaaagccttaatagtattgcatttctcacagaaaccctgttttattaaactaattttggaaatttaagcacaggaatatcaagtaatttgctcaaagccacatagccagtgagaggtagagccagaattcaaacccaaggagcttggttccagagcccattctctttagccataatactgttttgccatgaaaaaactatctttcaaagaaactaatggaatgaaagtgctaagaatacatagaataaacaaataggtataattcagaaacacaacttggggaaaacagtgcaatattaagtgatgtgtttgaagaagcagctacattccagaccaaacaattcatagtaggggtggttttgcttattttaggcggagttaagaaatgtctggcagtaacacatagcatagcccagtgcctgtccgtggcagggggtgatttcaggaagaaactgttccacctcagatcatcaggcattaagagtctcataaggagcgcacaacctagatccctcatgtggacatttcacaataagattctcactcctatgagaatctaatgtagctgctgatctgacaggaggaggagttcagactgtaaagcttgctcacttcctgctatggggcccagttctggtcctcaggccagaaccacaggacccctgtatagactattaaatgtggaacatcctctctggaggttcttgggaccctggttggcctggaattcaagaacaaatatccttagatgacttttaagaaacctttacaaagtatcgctgtaggttcccttttatattcattttagttaagttgaccacaacttttgaaatataaattcttagcatagtttcaaaatcataatactctctcccatgtagtatatactgtatattatactgataaatgtagatgtttaaaaacatgccaaaaaagtgtaaaatttataaaaccattgttggccttcattggcatttttcataatagtttgttttggtattcttgaattactgatccagtttttcctgcatgtttgtgtatataaacacacatctcagtgacagaagaatgaattttgagtttatttctattcaaaagttgagtaggaaaaaaactgatgcatttttcggaataggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtaatattttaaatccttcttttaaaaaataaagtatttttagtggctttgtttcctaaaccagtacatcttctcatgcctttaaaatatttgctttttcagggaaaatgcttaaaaatttagaattattgtataccttagaagctgtcacaaaatattatatttgatggagctaaattactctattaattattaataatttcttaaaacagcaaaagcagccactaaataagcataagtcattgataaagctgtgaattacattgaattattgtgaacgattttgaggaagaagaaatatctaataaaataaaaattgggagattataattgagtagagcttaattgctatttctatctaacaggaacttagtgttacttactgatggctttttgaaatgggatcttcagatgaaaaggaagcatagaaactttatgtagaagatttagatgaatatattttagagagaaatagaaaaaggtacatgggagaatgccaaagggaactgtttatttctttttgttgctggaaggaaggtattggaaatcatgcagtgatgagataaatgaagtgggtggctttttgcgatatccagaataatttaagaaatcatagctggatgtgggtacctgtagtcccatagtcccagcttctcaggaggctgaggcgggaagattgcatgagcccaggagtttgaggttgtggtgagctatgattgtgcagctgtactacagccttggtgacagagcgagaccctgtctctatttaaaaaaataaaaaatcacagtggtttgtgtgaggcttgtcatgttttgtttgggtgatgaataatgaaatatggacatgtttactggatctttaaacaccagattttgtggtagcaaataacttattgaaaaaaaaaaacaatgcatgaatacttgatttatctggacacaagcag

SEQ ID NO: 73778 - DNA, 1701 bp, Homo sapiens
ccttcccattttaccagtgtgggctttttcatcagtaaaaataaaagggaaaacatggcttctttaaacttaaatgtttttacttatagaaaaacattctacacaaaaatctccctgttttctattcagaaaaataatgttctgccagactaaattgaggggttttgtgaccttttttgttcattactctgttttaaaatgatatatctgatgcatttattaatagaaaaagatctgtagctcgaagtgatcctctctaggcaggatatagtgagtaagggaccccatcacttcttccattgtacatatctgtgttgaattttttatagtgaacattttttacttttgtgatcagaagaaaaatttctaaatgttatatttgtataaccatagtcatgttatttctttgaataacctatcagtgatttatatttctgtgaggtttatatgtgtgtattcttaaaacattattttcctttgcctccttcaaatttatacaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtctaccactgtgggaggtattgtttaaaaaacaaaatttgaacacctttaaggtctaaaagtccagttttcctcagaaagaaatttactaacacaacacattcataattttcaaaactgttagagaaaataagaatagtaatgaagtgcaatgttggaatcttaaaccctaagcagaagatcataaatatatatatatatattcgtaggtaaatatattcataccaaagacagaagaaagcatttaggaaattaacttctattttaactagcagcatttttaactttatttatttatttatgagacagggtcttacactgtcacccaggctggagtacagcggcgtgatctcagctcactgcagcctc

SEQ ID NO: 73779 - DNA, 1013 bp, Homo sapiens
gttcacagtacatctgtgagattataagagaggttaatttcattaattttcagtttgaccagccataaaacattcataaagaaattaagtaccttgcttattaaatcagatagattatgatggaaatggaattagaacttggatctttgtccagaccttttggacaggccacatatttatttgttagttttcaaacatgtgtatcatcagtttttcaatcaatttttagagttatgtaggccctcaaaatatgaattaaggagctgtctatgtatatgcctatcttaagtgtgattgaaatagtctcactatgatcttgtgtctgtctcttctcttttgctatagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtatgcttttaatattttaaaatcacgattatgatctatataccatagttttatgtaaacattatatgaaagctctgtttcaagtgacagaaactcaattcaaactagcctaaagaagcaggaggaattccttgatccttgtaagcttatgactttctgggtgaattaggaagcaggctcatcatcatgagtgagaagttagctgtgacggagcagatctcatggggagtgagaatgaagtctactaaggattggtgaaaagatggctgttcagcactaaaaagtcatatgaagttcaatattacagaaccatttaaaaggattctgtgatttttttttttttttaacgaagcctggaaccgttgccataaaatgaaccaagtgatttaatctagaatggctgggaatcagtagtgtagtgagcatcagaaagtcaagggaattaaagaaaccactcagaatacaggagaaattattgtctatggaaagcaggctgagggga

SEQ ID NO: 73780 - DNA, 1618 bp, Homo sapiens
aagagtgaagctatcacaactcctggtgtgaggttttataatgacccagctggctatgcaatgaatagatatgcatattatgtgtgctacaaatgcagaaaggtatgctataaattatactgagaagttttaaaaactagagcttacctatatgattaagaattcaaattgtacagtgatatctaattattccatcttaagcctgaagttaaaaataagatagcttggtacaatgtttcccaatgtttccagtaaaacttgtttacttaacttgtttggggattctttatttaacctgaacaaacttttcgaaacatgcagtatttctgtatacaagctgcttcccatcagtaataacctgttggcccagggcaattccttctcgaataaacttctctcacttgactctgctaaccattccttccttaaaacccttaattccttggcttccaggacaacacactctttttctgtcctccttcctttctagtcatttatctttaactacttcttctttttttttttttaacctaccccttacatatttgttttcctagagctccattcttgcctacttaataaatacttccttaccttgggtgacctcttttacatctataccttcacctaccatgtatatgtttatgaccccccaaaatttttgagatttagttacaaataaccaactgcgtaccagacatttggatctctcacacatacttcagagttcacatgtcaggtattatattcatcaatcttggccgggcacagtggctcacacctgtaatcccagcactttgggaggccaaggtgggcagatttcttgagctctggagtttgagaccacccagggcaagatggcaaaaccccatctctacaagaaatacaaaaattagacaggtaggttggcatctgcctgtagtcccagctacttgggggactgaggcaggggaatcgcttgagtccagggggttgaggctgcaatgagctgtgtttgtgccactgcagtccagcctgggtgacatagtgagaccctgtctcaaaaaaaaaaaaaaagactttaccaatctctgatctttattgacaaaatcctatcaattctgtctccagatctctcttgagtccttttttctttccattacatctccagcaaacctaatcattttccttggtaattacagtagccttcttcctgagctcgggtgtagaacccctaattcctctgttgcatcccttacactgctgctaattaatacttctagatctaaaatctaactggatcactcttctacttataatacggtagcccagtctccctctccagtctcatctcccaagatgctaccatttgctctccatttgctgccacataccaaataacttgcatttcccaaactcagccctgtctgctcacccactgacacccccatgccattgcacaggccattggtgtttaaaggatgctcttctctacctccccctgcatattttactctgacctgccacccccaaccccatacacacatgctgtcatgcagagcctaatctgtcttgtcatacctcgggcttcagctcaggtttcacctcctctgtaacatacccccatctcacttccatc

SEQ ID NO: 73781 - DNA, 2486 bp, Homo sapiens
ctgaggaacttttattatctagaaggatttaatgtgtacctgactactcatgggactgtacacaatttagcagttgctgtaccaccttctttggcatttaatgatactaaatggaaaaatattcagaagacattagtagtaaatattaaatatgccaattcatttattcatatgttgtttacatagtagaccaataaaggataattttatttgtcagatagaagacagggtggttcatcagagaaacagtcacttgttcagtagatatctgagtgcctcctgtgtgcatggcacataggacagtgatcgtgtatgcctgctaccacatcaggaagacttgagtgccactgagtatctatgtattttcaaaatcagccagcatttattgagctgttgtgatgtgtcacagtcagcatttcataagtctttcctaaaaattcagtggtgtaacagccttccctttcaacagctctggcttgctctcgcatccctatgtgttcttgatcaggaccacgtagatcgtctctcctcggggagatggatgggaaaggatggacaacaaaaacaaatggtaagatcagaattttgtaagaatttatcttgctttcctttacagtaagctttagcttagcttaaaaacaaacaaacaaacaaaaaacacatcaacataaacagttagtggatctcttgaaagattgtgtcccttcggccaagttcatctcacaagtctatttcagagagtccctacttcatagtatatggaaactttaggggcttttatttaagtatattaaagagctttcttcttctctgagtcatgtttgcatcatatcaaaatttatttttagccagagtctgatttagtgactagatattttactaaaatgtaatcagtcttatggtaggaaggaaataaagcaataacacaggcaacatgacacaccacctgttcacatatatacttaagtaggtttgatgggtatctttaagttcactagaaaggaaaactttatataggccctttcaccattttcttattaatgttcaagtttcaaaaataaacagtttcttcctttggcatacagaatgtttagatatataatggggcagacatttcttaagtctctaagtaacaaagtatacctgttcattgtattaatcattgaacctgcaaagcacattaatgattggatttggagttttgagagatttttatagttaagtacatttgcaataattctgtttaatattcagattctaaattcttaatagacttccgaataacggtttatttttgtaaataaattatattcaatttgtatgagagtctgagacttgcttgttaatctaagtaacgtggaaatgtcttattttagcctatgtgtgataaccatgatgatggtgaaactgcagcaatcattttatgcaatgtctgtggaaatttatgtacagactgtgacagattccttcaccttcatcgaagaaccaaaactcatcaaagacaggtgaagatttttgtctctggagcataaaatatgttcagtgaattttgaaataaatgtgtgaaagaggctttgtgtagtagggggaaaaagtggactttggaatcaaagaccttggttgagttcacagctgtctcgcttaccatctataaatagcaagttgttttatccttagaaacacttaatttctccatttataaaaaagggactgctgtgaagattaaagagaagattggaaatattcaaaacttcttagagtgcttaaatgaaagccattattattattgaataattaaattttatactctccctttcagagtgataaataagcatatttttccctgttctttaatgaaataataggtcttcaaagaagaagaagaagctataaaggttgaccttcatgaaggttgtggtagaaccaaattgttctggttgatggcactggcagattctaaaacaatgaaggcaatggtggaattccgagaacacacaggtaaaaggtttaaagattgagccatgcctttaaaacccacaaaaaaagattaaaccgtgccaactgattaaactgtgaataattttgagtgatattctgatgtttaattatgacatcattgatctatatatttactaaatatatagagtgttctatggtgaagagagcattagaccaaaagtcaagaaacctgatttgccactaactagctgtgtggtgtcgagcaagtcacttaacctctggaactcattgacttcatttataaagtgagaggatcacaactaatggggctccatagataaaatacatttctattgataattcccttctagttctgctagttgttgccccacaataaaaattgctgcactagatgatcactaagatctctatttattataaggttgtatgattttatgatatttagaggtttttgtagacctaatgcttctgaaggtgttgtgaatggtactgtttccattgatagc

SEQ ID NO: 73782 - DNA, 1070 bp, Homo sapiens
taaaataatatcaacttaatgtctatttaaatcacatagaaatcgccaggtcatttcttggttattaaatgccataagaacagtttttattttatgaagggaatagtgtcaagaactatttcacagtatattaacatttaatccttgaaaaaaaaagtcatattctcaatgaaaattagtgaaataaggaatcacaagtgtgaagttacatattatgtaatttttgttcaaaagtaaaacatattaagtaactgcactttaaagtcccttatctttaaatggtactttaatgtgaggatgcacaaaaaaagaacccttttctgatcttgtgaggtttccacttacagatgatatagataaagtacagtcatataaattatttgtaattatttcactcatataattttgctcggaagccatatcgtagtcaggcctggattttaattctcaattccaccatttactgaaaatcccttaacctgtattaaccttagtttcttcatctgtgtaatagctactataaataatattacttatcttcacctggttgaaataagaaaatcagtgtgaaataacctcataacctttactctgtgcaattctttgttatttgagcttgctggtatcaatgctaagtccagcacagtgataaaagtgatccagctgaatcaggttcctgcctcttttctactcaaccaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtgagtgtccttacaacatattctagcacaggataattgatgtaatatattttaagagtgtaacaaaatattttgtgaaacttattacagaaatttctggctataaatgttgcccattttttcttttcata

SEQ ID NO: 73783 - DNA, 1087 bp, Homo sapiens
tttaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggtcagtcatttcagttattatcctggttgtcctgttagttaataatacatcaaaggagaaactgtaagttattcataatcaatttgatcctgtcttccattatgttttatcttatacctgtttgttttatcatcacgaaagatttgcttttaagtatcataagtacttatatttgtttctgataggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttggggtaagaaagcaaacgtgatttacggctctttagctcttttcagatcttagtattcatgcactttcatttctgaatttagcaacaagctttatcacctggaatttcaccaaccaaacatcattgctataatccccaaataaatcttaagtctaaaaacaaattaatatgattgggagcactgtggaattccatttctgaaaagaggtctgattacaaatataccatggctacagctaagcaaaatgaaagtctgctctacaattttctgctgccattcccttggttaagattttcccgtgacctggaagtcctccccttaaactctgctgatcaattcttccagggtctctcaaactcagcagagaaattctaagtaactcctctaaaaaattactctttccctctgctgattctttttgtattactctggtggcacttaataataatctttgacctatagtgtaatcagcttttttttttttttctgagatggagtctccctctgtcacccaggc

SEQ ID NO: 73784 - DNA, 1473 bp, Homo sapiens
ctgtatgagttagtgaccaccccaacttctaaacatatgttattttttatacataaacatacacacaaaacatacctacatatatgtatgtgtatatatccatacacatacatatatatgcacacacactacacatacacatgcatacacatgtggattcaccctacaggtatctttgtgagtacactagaattgatacatttattcatttgcatgctgattttgcttgtgactaaacttacagcttttttccctaaaataatacaagcataattagttaaaattactgtatctttctgggtacaatttggttttgttgtttgtatttctgttacatgaccattttttaagtatacataatagtcttttgtgaagaggattccttccagcacacaaactgataaacttgtttcaatttctgccttaggagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtaattttggtatccacatatcctaggtacattggacaagagagtttatggaatattcaaagtatgaaatgctccaaaaaaagctctttaaatagtaagatagaatccctacattatatagatggtgcctccctccttacagtcataatttttagaatggtccttcctcttagttaacatttgtttgccctcctgtaaaatgtggctaatgtaattcttagtgccctaaattatcactgtagcaatctccctcactttccccagtctcctacctcaaatcacttaaatgtcccaaaaagagagagggaaaatgaaatctcaaaaacaaaaaccaaaatagagttttgacttgaaaagaatcttggggaaaacagagcctggttgtatgcacccagtcctaaaagcaccttaaggagcatcacagatgctcaacagattccaatttcaatttgaaatgtgttgagaatttagcattgcttttacactgtgaaccttgttactagattcacatactggactcacacttataaataaattctcctaattaatgtatacaagaaatagattgatggaatgcttgggcttcccatgttactaatgataagaccagtggaagagagatttctctttgtcctcctcacaagatttttgaactacaagataaactataccctgatgaattagtatggcattgtaagagtaataaatttgaggggttgttgcagttggtgtaccacttgtttacacaatagattcattaccctttttgcttctgtagccttgatcttcatctgtctaattcttttatatttaaaatgggtcaactttccttagaatttaccttgttccaaagaagttacctttatttctcaaaaacaaaaacaa

SEQ ID NO: 73785 - DNA, 1071 bp, Homo sapiens
tgacaatctattccaggatgaaatgagatatctacgttcaacatctgtacctgccccgtatatatcagtaactcctgatgcaagtcctaatgtatttgaagagccagagagcaatatgaagtctatgccaccaaggtattttagttctctcctgtctgttgaatagctagtgtttggtggaagaaagactttgaactagaaaagagtcctgtagaagttctttaatacatctgtgagccagttttgctaactgctggagcagtaagaaaaagcatacatgtatgactaaggtaaggtccttgatgggagaggcagactagttggagagaagagatcaactagtgaaggaattaaagattacattatatgacattacttaatgctgtagtaaatcagagtagggaagggttactttgagttttcatgggagcagtggcattgaaaataaatcttaaacttcttggattattgtttacagtgcctcctaacttaggtatggtagtatcagagtaaagagcttctcggaaagctgaatagaaacttgttacaataatgtaatacacaagaaaatagaggccaggcgctgtggctcacacctgtaatcccagcactttgggaggccaaggcgggtggatcacctgaggtcaggagtttgagaccagcctgaccaacatggtgaaaccctgtctttactaaaaatacaaaaaattagccgagcatggtgacacacacctgtaatcccagctactcgggaggctgaggcaggagaattacttgaacctgggaggcagaggttgcagtgagctgagattgcaccactgaactccagcttgaggaaaaaaaaaaatagagtaccactgaaacttttttagaggacgaatgatgtgataaaaatgcaaaggtagtctcacagtgacaattgagaagctgacatatggattaaagagatatattttgtaggaaaaataagtgtgacttgttgactaactggataatgaaaaagataagtttaagatgacatgaagatttcagtcacgaataactgtgaacatggtatcattggaaaggaag

SEQ ID NO: 73786 - DNA, 1493 bp, Homo sapiens
gaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggtaaatgata

SEQ ID NO: 73787 - DNA, 1096 bp, Homo sapiens
agcataaaaaacattttcctacatcatctgaatttgttcacatccttttttcttttaaaaaataataacatgcagttatagccagttaacaaatctaccttaatttcctaggaactgtctttgaaaaaatataaatacttccagataggtttatggattttcagttttttataccacttgaaacccttcagtcagattgcttttctcctaacaactaactggtatcacttgcactaagagtagaagtttttattttaaggaggaaaggtgatgttgaagtttgtaccatttacttgggtcacagacagcctggctctaatgcctcaaagaaaagcataaaatagaatgaaggagagacactgaatgaaggcagggtgctaaaaacaattaatgtccatgcagaaacatctaatgctttgccttagaaaagggaggtgattcttcttttcatcctgtttttctgtcattctcctgactccttgttttgagggtccacagttcagacttttaccactcattctgaggatccaccgtttctgtggtttccaagggaacacaggctctgagttctaagcagctaagcttcctgaacttttggagtgtaacctgtttataaataattaaataacagcttcagggcattcatgtgctcattgtaaactagtctaatctgatcataaaacagagtgcctcttaagcaactctttgttagcctaattgtatgcatacacttaaaaattataattgtgtctatgcataaattcagttctctaattcaacaaaacccataccgttgccctaaggatgcgaggtatcactctgctggaaatttagctctactctacatttaaaatacaagttttcacattaaataatttcttattccccaaaagattaatttctgtctctttctagtccctcactgaatttaaattctaactagttattgcactagggcagaggttgagatatcactgatagttcacactggatttgttcaacctgttgttttgcgtccatgaaaatagtttttggtggtaatgttgtgtaatgatgtgtagaaattttattagaaatatttcccccttctttcctt

SEQ ID NO: 73788 - DNA, 1092 bp, Homo sapiens
ttttagcaaactgtttatatttgttggtattttgagcagccacaacatacaatttttagtaatatttaataacatgctgcaaaacatttgaaacacaaatgaagcagataaacataaattagcacaggggcttaccccacttaacaagcatagttttttttaatatataaaatacgttttggaaaaataaatttttcaaaaagatttagttatcatttgagaaatacatctgaaaaagaaatatttctgccattatttgtatgcctaaacttcaacaggtatttagctgtcaccacttacagatcttaagaaaatattcaccactattagagatataataagatatacaaatgcctattctttctaacactatgtaataaacttttttgctcacatatgacaagtggtgttcctggtatttggcagattccatttttcaggcaaccacagaggttgttttcatgatgagtaaataacctaccattgtaagttcatatgcattcctagaatagaggtagcatcagcaggtattcaccattcctttgcatgcagctgttgtgcaggtcaaccactaagacacatctgacacagggagtaggtaatctttgtcacgaacccttcctatttgttagaaatcctacacaagttgtccttttttataaattagagagaaaacctctttcagtttacagatggattttttggagaaagggataccaaatataaaagacttactaattgtttgtctagattcccattatgtgtggttcagtttctgaaataaatgtgatgataaaggtgataaacatgtctccagctgtcagattaataacaaaaaacaagtattccaaacatcacatactcaaaattaatggccatgactactgatttaatctaccaaatataatttgtttaccaaatttgccatatgctgttactaggtcagtaagattagatgggtagcaattttttgaactacttttgaacagtttaagggtacttattcatagatcacatctgtttatctgtgctctcccaagacagcattgatagttagaattctaaattgggatttttttaacccttttttca

SEQ ID NO: 73789 - DNA, 1032 bp, Homo sapiens
cccagaaaagtagccaaacacagtgtcaccccgagtccattctgagatacatactggaaaattatagtaatcggttcattcaggaaaccaagtgacaataggttaagccatgagtaatataagtaatataagtaacatttctttatcttccactattaaaaaaaaacttgtaaatctttatttaaatgaacaccaaattaaagaaaactgagccaaagaaatgtaagtctaaaatgaaatgctcaattttgatttatcagagatataagccttactaagttttaagttaacaaatttggaccttaacacatattaatctaaattaattaattcgacctttgttttcagttttagagaaatgtaaacttgttcaaaaatatagcagaatataaactatttaaaataacagtttatacttgcataccatttgaaatgctttgtttttgcttgtgttctctgctaaattttttttccattgaatctgtgctgcttctttgccaatgttttccactgtagaatctccatctcgcaaccttgcttctcgtgagcgcatttacaaaaattatggtgtagctgggcctgcctctgctctctcatctctgtctcacaaactgaagggtgggtatacatgcattcatggatgggccattcttaatgaacataaggagtgtcattaaagatgtttccgttcgtctcagtcatgttcatgccattccatttttttaattaaagtttatcattttatttacatttatatatgtttgagtaatttatgatgctcctattcagtattataatatagattatcccagtagctatgcatgtttattacatctataggttaaacattactcttacttaattttaaaactttatgagatcattaaaattaaaataggtataaggaaagaattacctaattgggggaatttttgaaatcatttttatcagaaaaagatgatatatgtgcaaggcataaagcacattttttagtcttaaacttattgttatataatataaaaatcattttac

SEQ ID NO: 73790 - DNA, 1257 bp, Homo sapiens
atttctgttttatgtgtgcttccaattaagatggtattcttctgatttcctattcctgtgtcttcctgctatgtggagtcttcacagatttttagcagccaggccaggagattgtattccttcctatattggcaggttggattccccctgaattaactcttccattcagaggctgccaccgttctagttcgtgtcttgaagaattgtatcaccctcctaactgatattttaacaatagctgcaaactccttattatatgacacttaaatagcataagagctccttttgcagcacctgacatcttttgaggtttatagatttgttcaaaatgaaggatgtacaaaaatattaaaaatttaactttttaaaacttagattaagatggctttatgccatggtatgttgctatctactcctcccattgtctcttgagcccactgcattccagctttagtccctatcctcggaaactgctgtagtcagtctgtgacttttgtgttgccaaattcagttgtcggttctaaggtgtcagttttacttaatctgtcagcagtatttgacagagttggtctttcttcctagaaacacattcatttgcctgccggatatttcctgccttactggctgctgaattctagtctcctttctacatcctcatctatttggtcatctagaaatgtcctagggctttggcctcttctaggcgtcactcccaaagtggtattctgcagtcatggagaatgacacatctgtaggcatatgactcccaagtttctcagcacctgatgtgatgtatacttatttgttcattccctctctcctttctcctaaatataaactctgtgagaatagggactttgttcctgttcaccactgtgtctgcaatgcatagaacagtatctaacacgtaatatatactcatactttacattgaatgatttcttaatttatgggtcattcatcattaatcttgatcataataatgaatcagccgaaaacagcactttttttaagaaaagtgtgtgttatgtctagtttatttcaataatactaagacaactatctccttactacctgaatttatttcagcacaaccgattaattttaattgctatgagttaaaaactttaaatacagtgagtttttttaaattcagatagagatgttttttagcttactgcttttaaaagactgcaatttaaaggttctgttaattcttcaaaaaaagataaattaagtgcttcattttcctgcata

SEQ ID NO: 73791 - DNA, 1048 bp, Homo sapiens
tatattgtccttctgaatagcctgtttacaattctttgaacattgcctgccaataatttagcaaattgttattgaatgtcacagcttgattatagaacatagtaagaaatcaacaaattgaacaccaaactgaatttaatgctaaaaattatccttttaaaaaataatgtattactaatttttactcatgaaatttaacatttccaatcattgcttagttgttgactcaacactcaaaaataatatatgctacttttaaaatcccaaaacctccagatttgtgtactgccaccaggtgttgacaggtgccttgattcttctagtttgtggttccagagataaggtcagggtcctgatacagcaaaaccaccatttgtctttgttaaactgaaatgagaatgcgttccttattggaaagaaaagttacacggttttattattatcatcagtacttagagaagacttaaaaagtacaacttaaaatgaactcaaagtttctgtgactaggaaatgatatgactcagggaatttaatacttgggatccaaaacaaagaaaacaaaatgacccataaagaaccatgttgtttatgagggcaaactatagtaagcaaacaatattaacttcaaatgagcactggagaaaaatcctgattctttaaaattgtttttaatattattctcttaaacttagtgatacccaaaaaagaatcaaaattttgtggagaggaatataataactggttgtcttatctgtattaacaggattttgtaaaagcattattatttctgtcaattgatttttaaaacatctatcaactttttttcttttgtgtatagatatcaatgtatctcatagattgcttcccttttttaaattaaaaagtataaatctttataaaaattaactataactttatgaaagtatgtttaaacttgagcagattttgtaaaaatttaatgtgtagaacatgtgttgttttcagcaacagcttaatttctttagtcacttaaccttttttagacttttgtttttaaaaatatttcttt

SEQ ID NO: 73792 - DNA, 1045 bp, Homo sapiens
tcacttgaggccaggagtttaaggatgtagtctgctatagtcgtgcctgtgaatagccacacgctccatcctgggcaacagagcaggatcctgtttccttaaaaaaatattaataataagcctactcttgttaacaagcttttaaaatatttagaaggagcaaagaaataataagaaacttaaacttgatgaaatatatctaactttattatctgtaacagtagttcccattttaactcttaatactgtccaagatcgaagagctgttttttgtaagtttttttttcttaaaacagtattttagaaaattcttcatgatctctaaattttttcctataatctacagcatttatttattatttcaaaaaaagatatatggctcgtgtacacagttctttccacataaatctatcccgtgtaggtacttcagttgaaattttcacatatgaaactttattatatttcagaaatatgactagaaagatactattttccagtttctgcatcacctagtctggatgtagttccctctccccacctccagcatcatttaaactatttaatgtatactcacaaataaggagttattatccatcacataatttcattatcttaaaaaaaatttttgtaaaaccttttggtacaaggaaaaatgttagaatcgatattttagatactattcaaattaggtagctcataatcctttttgtcatataggacttacagatttttaaattattcatctaagcaaaatatttcatgcttttaaagtagaatttctttggcagtaacaacttaaaaaagaaagtattaatttataactataatgtaaacacattgctatgttaataacatactttgccccattctgctttttgaagaaaaactgttaattgcttattttctgcatgaaatatactgccgatgaggcagggtggtattagtcattgttgggaactatggaaaaggcatcatttacttaaatcttcatttatatatgttcaatattgaagcaatttatcactgattcttcatagagtcttcg

SEQ ID NO: 73793 - DNA, 2098 bp, Homo sapiens
ttttccaaattttggaacctgaaagatttgaagtagagttgaagagaaagtatcatttgttaatcttgtttgtatagcttcacctgggttaattgataaaattggcaaatgtttcttgcattttaaatccaatttcattcctttttacctaataacattaaatccaatttcattcctttttgcctaataacacttagcagtcacagctttaacataccccagatttcctgattttgttaatagctttgtgtgtatgtgtatacataacccgtgttttaatctcaataatattaacttaatacaacattagtaaatgtgctgttcttatatggttaagaacagctttatttcattctttagcttagtgttaaagtttcgtaaacagaatgagattaaaacagttaaattaagattgtaataatatatatacgctattcttaattttcctgagtcatttcatcattttgctttaacaatggcaattcttagctttgtgcttatctaacacaaggaaagatttttttcttttatttgcatgagcatttggcatggttggtcacttattttcactgtgataattattcacttgttggtctcttttctacgccatgaaagattatcagcttagagttgcaatttggtgttcattaatttagttagattcccagtatgctttaattttctaattttcttgacagaacttttctgcctttaaaatagtatttgagaatgaaatgttattttatatatatgtgtgttcgtatatacacatgcacacacaagctgtgcttataataatctgtgaaattatactatatgaaagctaacatattttaatagtgagaaattggggctttggaaaaattaacattttcctgaatgttcatatctttagactaaaacatttctaaatttccaaagaacactattcaagtgtgtgtgtgtgtgtgtgtgtgtttgtttgtgtgtgtgtgtgtgtgtgtgtgtttgagatgaagtcttgttgttgcccaagctggacttgaacttctgggctcaaggagtcctgccttctcagcttcccacgtagctgtgactacaggcatgtactaccatgccgagctatatttttaaattattttgtagagacgaggtctctctgtcttatccaggctggtctcgaactcctggattcaagcaatcctcctgtctcagccttctgaatagctacgagtataggcatgcactactcacccagctattcaagtatattttatttttaaactccagctttctgttagtcaaatttctgcttcttgataaatgcagttttattaggacattgcattttgaaaataatcttagggtaaaccagtgtgaattaagaattttctacaactgcagaacaaaagcaaaaaagtataaagtttcaatttacatggaagcatatacagaattgattttattggcaatttattaccacagttagcagttaacatcattttaaaatatcattgtacatgttgttgactgagaaagcacttatgtttgcacattgacttaaaagagagacataagctttaaatattgtcaaccagtcatcacattgcttctttatcactaactttacctgcattacttttaacaattgcctttcatgttactttaatactagaataatttatgctaaaaaatagaatacgctaaaaaaaagtgatattgttttatgtcaaaaagtctgtcccactatgctttgtaagggagaaaaacccattgaccaagtactctacaaattcttatatacgtggatgaaccagtatagacatttttcccctaaaacatagcacttcaaaatgctctgcaatatgtttttcactttacctaaagagaaaggacgtattccctatccacttttaattagggggcagttggctttggttttggtttacatttatttgtaggcatattattagacactttgtttagagttttatatgtcttatatttatgaattagtatatatttatgtagatgggtgtgtacccacattcatctgtacatatatatgtatatatccatatatatatatggatatggaaaatatagaactagaaaacag

SEQ ID NO: 73794 - DNA, 1047 bp, Homo sapiens
attaaattgcattgtgataagttgtggaatggcttcacttaagtgacatttgaggaggacttgaagaaaagttgccaggaaacagtaaaggaatttctagacagagaatcaaatgttcagagttatggggacatgctatgtatgtgaactaatgaatagttgatataggtaaagcagagaattgagggtggaaaacagatatgtactggggagaatagctttctctcttccttctcaggcagcacttaatctgtagaagtagagaaggcttacttctttctccagctacccataatatttgtttttcttgccttcagcccatttgtgtttatgtacctcttatttctgtttttaagctacttaaggataaggactcattcaggatcccttctcactcacatttgtttcttcctaagcattaaaaattacactttgctcatagtaggttttcacagtttgttgatgctttacacatttgtggatgcttaattttagttctttgcatttgatatgatcattctgtttaaaataatttctaacatatatatgctccttgccttaattatctcatttaatcctcattgtgaccctgtgatgttaagcatattataattctcatttttgcaatgagtaaagatagccactcacccaggatcacaagtagaaagtagtggagctggtattggaacaccagttgatatgattccaaagcccatgcatttatgttccgtatgcattaatctagtggagagataaggataaatatagttataaaaggatgaagcaactatagctgtaataatcctgttactttgactagaactgccaaactacagaaagataaatacttataaccttaatggttgaatgaggatgaataccatatgtattgaagatgacatgagttattctttgattgcatacctggggaacattgattgattttaaattaaaattctgaagatgtggaatctgcaaaatgtgagctagtagaatgtttcaaatatcagggacaatgcaagtaaaaagatgaagagagaatttatt

SEQ ID NO: 73795 - DNA, 1050 bp, Homo sapiens
aaaagaacaatgttcgacatagtattcagaacctgtacatgtattcactgaaaatgggtatagttcttcatgacattttaaaatgttgtttgttttgaaatgtgtttcttactgctttaactttggacagtatatttttctggtaatataaccaagtaacttctgtttcttaaaatataaatataagggaaggaagactcatattcctttgggaaacatctgattttactgtttatgtatcttaaagtgtggtttccttgtgtttttattcctaagtgaaattgtttttacagtcttgccacatgaattaccatattgtgttggcactctttgctgctttttttttccctggagggtctctcagacttactttctgcaaaaactagatgcttaatctgcacatgcaccatcatttttctgctttgcagactttcagaccttgctagcctcataggacttacaggaaggcctggcttgtttctgttgcttttttctatagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgtaagtaaaaggtggttttaaaaagcattatagatacacgctgtttgttttacagagctttctttaattaaggcttttcagttctgaggtaacccacaactaagtaacctttactttacaatttcttgaattcttaagggcttctgtgtaatgaaagtgaagtttggcaaggttaaggcccttagtgcagattatgatccatcacagataggcaggaagtagtaaatttaattaattgctacttaattaaaactactgaattcctttcaaagaggtagaaaatgagagtggttacatttttttctttcttatttatacagctgtgtggaatgaattccaaactaaagtttatgaactcagaattatacattcaaaaacatgtataaatgtatgttatgttcacattttgc

SEQ ID NO: 73796 - DNA, 1026 bp, Homo sapiens
ctttctgcaaatctatacattattatatgacatctctatcggcaacctagaaaaatgctataaagtatttatttatagaaaataaagttgaaatgcaggatgattttagttgcaagcagctgacaacacatgttttggttatactttgagaaaacgatccttacctcttaggagttggtgatgcaaaacgtagttcttcaaatgaataattttcataaacctttaagaaagagaccagtctgaacaatcgtaaaatcatttaaaaacattctcaattaacagagtaatatattattcaataaatggttgtgagacaactggttatacatataggagaaaaagaaaaaaaattacctactttagaccatttattaaagataaattctacaaggtttgaagatccaaaagtaaacaccaaaacttaaaaaaaaaaagcaaaagaaaaaaacagataacatcttttgagtacattaaaattttaaagttttccaaaacaaatactatacagaaaggaaaagcttccaccttggagaaggagatttgtaactcgtataacccaaaggtgatatgcatccataacatatagagaataaatccatacaaaagagataaacaacaacaaaaaaagacagtcaagacaattctctgaagaagaaatctgaaaggtcaataaagactagaaaagttatttaactaaacttggaggaaaatacgaattaaaacaaaactaaaataaatcacatcatggtcatcaaattgtgttggtaagaaccaagcgcagaggagaacatgcagcacctgctactttcatacattgctcgtgggagtgtgagttttggcaatacttaatgtagttgtagttgtgcatgccctacaacttaacaattccacttctaagtatgtatcttacagaaactcttgctcatgtacaaaaggagacaaatacagaatgtttatttcagtacagtttataataagcgtccatcaatgggagaatggacagattatggaatagatccccaatgg

SEQ ID NO: 73797 - DNA, 1052 bp, Homo sapiens
gtagagttagtagatcaaagatagtcccgttttgttgaagaaattgagttgcaaagttataattcctggaaaatatatctaaaaggtatttttataagacaatttgtattttcagtatattaacatccattaacgaatctgttttttgcatctatactgtagagttagtggacgaaagatagtcccattttattcttaaagaaagtgagttgcaaagtttaattatttaatagattgcttaaatcaaatgttgatgttggtgatagggctgtctaataatattctttcttcacccgagtaaagaaacatatttgggctttaggtataagatttgttttattaagtgttaatttttgaaacttctataaatagagtacattttcttctgtagaacagtgcagctcaaactgacattagtgctttaaaatgtgctgagattgtgggaaagcatttacacttgcattacctgataaaataatttgttagtccctgcaataacttaatgtagattcattccactatcttttcctgtactttattagtggtgcatttgtttttatgttttgatatctctgattatgtattccaaaactatgaggccttgtttttacaccgtgttcatggttcatattgtcaacccatcttgaggtcatttgaactcttttcaataagcctttgaagggaatgccagagacagaccaatgctaacataaagtatacataattatgagtttataatagtaagttgcttattttgatgtcagtgacaattaaataataatggtatttggtttctataataccatgtttaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtaatttattttacttatcagaaa

SEQ ID NO: 73798 - DNA, 1102 bp, Homo sapiens
agttatgatagtatatgataagaccaggtgcaatggctcatgcctgtaatcccagcactttaggaggctgaggtaagtggattgctagagcataggagttgaagacaagtctggccaacatggtgaaatcctgtgtctacaaaaaatacaaaaattagccaggcatggtggcacactcctgtagtcccagctacttggaggctgaggtggaaggattgctcaaaccctggaggcagaggttgctttgattgtgccagtgcaatccatggtgaaaccctgtctctgcaaaaaatacaaaaattagccaagcatggtggcacacacctgtagtcccagcttcttggaggctgaggtgggaggattgctcaaaccctagaggcggaggttgctgtgattgtgccactgcaaccagcttgggcaacagagcaagaccctatctcaaaaaaaaattaactaattaaattaaatttattatagttgttaattgattatttttgttgctttttgtttttaggatgaaaagggaaaaaaatatgctggcctgcatgattttactagtaaaaaaaaaatcccaacttttttctggttttaattttaaaattgcagagattactctttagtttttaaaaatcacaaaatagtgattggagaggaatgtcaaatcacttaagtcagcctcactactatactatgcagacgtttttatgtaatgcatggtagaattacttattactcagctcacaggacaacttgaatgtgtagatcacagaatgaattcaggaatgaacatcacaaattacacaacattgatgcattttaggtggaaagcaaggtaatgaggaagatagttgagaaactgtgaaaaaaagatgggcagtacaccttgaacctggctgctgtcaggcaagtagagggccatttctacccctgcttttacagagacactgctttttccaggcttgcaggatggcagagtaaggtggagctccttcagagagaatgagcctgctcaggacttcaaattatgcacaacctacattcgtgttcttggtgattttaaattagccatagttaaaatttcaagtttcctggttttaaaaag

SEQ ID NO: 73799 - DNA, 1742 bp, Homo sapiens
cccttaaatataaccatagtattatcacattgaagaaaacaatttaatgtctgcaaacatcatgtaaatttttaataatttgagttagaatccatataaaatccatatattgtgattagtatgtctcttaagtcccctttaatcttaagtccctttaaatctataagtctccctctgtctctctctctttttgttcccttgagttctatttgttgaagaaactggatcctatgtatttgttagatgggagcctcttcagcttacctgctggttctttcagacacccctcttgcagtcattcctagcttccttgctttctggtaggataagatgttccaggctccctttatatgtttgatgcctcagacttggaactaaccattttttcaaagtgtcctgatttctgttatacatacacacacatgttatatttatatatgtatatacataaatgtatatatgtttatgtacagatagatttatgtgtatagttttttaaagataaaatacctcatgagtttatactgttgatactaattcaaacaaggaccacagacacacctcagtctcctttctcttatatctaaaattcctattagtgacactgggaatatcagaattagaaaatcattaaattatttcatttggtgtgtgtgtgtgtgtgtgtgtgtgtgtgtgtgtgtgtgtgtgtgtgtgtatgtgtgtgttttgtctttgaagtatatcccatctaagtgtatgtcaaattactgtgtttaaagtaagttggaatgctccctctgcatgattatgcattcattggatatacacttagagagtcatttattttatcttagattttaggaattgctttttaaatttggattttgttttataattctttacataattacatactttgaagtcaaatttatgaaacaaatctagcttttatctctgtcctctttactctgttcctccttctctgtcataggtaacattttattctattttaattttgtactttatcctgttgtgtcatttaataaaagcatagacacacacacacatacagatgcagatgtgtatgtttgtgtatatatatatctgtattcatgtcactttgcctgttgacctcaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggtaagttttttttttcttctgttttatgtggtaaaataagtgcatttatgtatatttagtaagggtgtatcattgaaaatgtttatctaatttttagagaaatttattaaagacctactatgtatctggattgcattcgaggaataaataaggtaccctgggcaaggggcacagcctgatctgagttttggagaagacaatgttttaaggattttgtgaaaaaaagattagcttgagcaaagcagagtgttaacgttgaggagtagctagctgtctgtgtagttgggtccaaattatagaaaacaatggattagatcttttattttcccaggaagtgctaaattttcagaacttacctaaggactgaagtccttcattgtaagagaattcgtaaacc

SEQ ID NO: 73800 - DNA, 1051 bp, Homo sapiens
tggatcatgttttacttaccattgtaaaataatctcatgtttgctcatgctacaggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatggtaatattttttctttctcagtagtcatattttagattctttattcactaaatttttgcatagaattattgaagaggagccttctattatacaattttatagaatctaagtgttatttatagatccacccatggattaattttggataggtcacactctccatactgtaatgcagaattatttagaatgctcaaaaggagttaccatatattcttattttcttagttaatttagtaaaagaaaaattgtatttgagttaaactgggtctttattcttcttttagtaatcaaaaagctttttcttcctctctgttctttttccagtaatgtatcgctatccacccaaaactctggggtaccctaaccatctcctcagaggcacttgtctaaattcagctctatgagtttttccattggaatctctctagtttgtattctcctctctttcacttcttctcctgctgtcatttagactgccatggtgcaagtacatttcattttttaatatagggttaatatcccgataatctcactgctgcctttcccccattctccatctagttgtttagttattcttcacactggcagcagagttatcattatgaaaacatggttatggccggacatggtggctcatgcctgtaatcccagcactttgggaggccgaggaaggcagatcatgaggtcaggagtttgagacgagcctgagcaacatggtgaaagcccatctctactaaaaataaaaaaattagccaggcgtggtggcaggtgcctgtaatcctagctactcagaaggctgaggcaggagaatcgcttgaacccaggaggcggaggctgcagtgagccgagatcg

SEQ ID NO: 73801 - DNA, 1928 bp, Homo sapiens
cagagaagtaagaaaatattgtttttgactcactaattttttctcagagaaaaatatgcaatgatgtttgatgagcctgttctcctgcaagctgggtggtggtatgtggcatgggcccgagtgtcaggacccagcagtgactgtggatctcatggacaggcatctattaccacagatgatgggtaagtaaatgcccaagtgttacttaagcaatacttatttttgttagaggaatattgttttgaaaattcagagtactttcagcaggattcaaaagcttaggaagactagagcataatataactgctaaaaattaaattcatgtaacctcatgccaaattgaggtctagacagaacaaggagataataagaccactgtactttgctcctgtcagatggtatttgtatatatttctgggtattacattgtttacgagcttgattaccaaattagaaattatatagaggaaggtgacaaggaaaatgaggagtttggaaccataaaaaagaagtagatatgtgatattaaatttgatagtgcatgagaaaacagtttaaaatttcaaagcttcagcaatgtgtgttattttaataaaatatagggaaaattttgctgttttaaaataactttcacgtatagagtacttttcagttcatattcttatattttatctgatttgatgccctcaatagctttgtgaagcagttattagccccattttatactccagggactagagaaataaaaaggtgaaattatttgctatttcctgagagtcatgtggttaaaaccaaggtcagacctgtaacctgttgactctaaatccaacatttcaatattctattactatgatttatgtattctaaaggactatcatttgtaagataaattcagtttattcttgattactcctgagcataaactatttgaaatcagttgaagttatataacagtatatattccagtgcaggtcaattcataacaaagctgaccaaaaaaagaaatagacttatttgtgaggtgaatttcctgttgctgaatattcaaggagactactgtagaaaaatcacatctgttgttatgtgcatcaacttaagaatgtctttagaactaagtgactactttgaccctggactgtatgattttcatagacagttcattcagacttggaatgtcatggcacactgaggctaaagcttatcatgcagctagtcaagcagatattatactacttagttgtaagtagaaattttagaagtttactgctgtggttaaagctgagttggagagctaggagggacaggacagctactcatttaggagtcctaatcacgttcagttctttcattttactgactaacccattcagagctagaatgaaaatctagaaaatacctttttgcttttctttatgtaaaagagtgaatcattttcattgacataagatttgaaaacatgtttcttaaatttcttatttcctgtaatgatcatgttgtttttggtatcattgttttctcttcttagggttgttttccagttcaagagttcaaagaaatcaaataatggtacagatgttaatgcgggtcagatacctcagttattatacaggtatttagcatatttatactgaattagtatggtttattattttgctataatgaagtagaatcattacaaaacgtggcataatagggagaaattatttgaagcattcagcaaattataatatgctggtagaactataaatatatttaacaaaaacagttaatattttgtatatttttaaacattttccatacaggcttaactttaaactttgcctgattactcagattatctgtattataccaataacaatattttactgactttaaaaaaaatctatccattgattttcttactaatttcaaatgttgtaaaagaataa

SEQ ID NO: 73802 - DNA, 1093 bp, Homo sapiens
attctacagtattcacttactttttaaaagtactgtgagatgggaactgttagtatccacccaccttttatggatgaggaaactaggtcccaggatctcagttagtaagtgatgaagcaacattctacctcatttagaatgaggtagaatctcacttagtgagagactcacttagttaaaattttttgttggagttctctcacctttttcagatgcacatattaggtacaaaacttgtatagaactatttagagcatttgatgtaaatagatgaatatataaattaggaaaacagagattaatgtagaccataaaaccttgtttcctaatttaaatacatatgtttgtgtatttcacatagtaatgttaaaaaagcaggtactctgattttttacatttggtatggtccagcatacattcatcatgcacaaaattatgaacacattgttcatcagatatgtatagctgatttatataaatgattgtctttctcctttccttagctgtttgaattgggtcctgatggaggagatcatgaaactgatggtgaccttcttgcagagactgatgtattggcttatgactgtgctgctaggtaaataatttgtgcattattcattgtaactcttgcatacttaatattaaaaatttattataaatgaataaacatactttaaaaggaagttttaaatctgctatgaatatcaaatacttgagaaattaaattatatattaagcaatataagtattgctttcaaaaatgctgaattaaaactaatatacttcataaatttatttcataagtcaactgtttcaatattgaagataaaaatggaaatatgcatatattttatacacctttactttcatgcatctcttacggaatacctagtttgctggtgttctagtaataatacagttatttattactcctagcattacaggtaataaataattagcgtcaagtggtcatgtttgaccataattcagattacccatgtactctgacatcatgctgctagaatatatttgataataacacacttggggaggtgactagctttactgaaaccttttgggagtttataaaaat

SEQ ID NO: 73803 - DNA, 1486 bp, Homo sapiens
caacatattcatcttagggaaaatacagatgtgctcatacttaaatggccaattataagattattcacatctgtcaattttttattgacaatgtttaattttttatatagatctaagctttggtcttattgctgctcattaacactttactgaataatgagcttgaacagattttttttttttttttgagacagggtctcactctatcacctaggctggagtgcaatggcatgatcacggctcactgcagccttgacctcccgggctcaggtgattctcccacctcagccacccaagtagctgggactgcaggtattcaccaccacacccagctagttttttgtatttttagtagagacagggttttaccatgttgcccaggctggtcttgagctcctaggctcaagtaatctgcctttctcagcctcccaaagccctgagattacaggtgtgaaccaccatgcccagcttgagcagaattaatcttgctgaattcacttgctggttcttgaatttggactaaatttttggccacttattaagtgccttttttctttgataaactttggttaatgtctgagttataggaattatactcaattttttgatatcaaataccatatacagatatatatataaaatatatattttaattctgccactgctgctgataaagattaagaccctcatctcaatttttttacttgtaagattttcactgtctataataattgagaagttgttttgtacagttacagtttgtttcaatgaacaaaatgtttctagtattattttgacctctaaataacagctgctacttttttagtcattgtggttgtattcactaaattaccaacctttaaaaataatctccttccttgatgctatgtctctattgtgggatttatgcctatatttaatctcctactcaagggaggagacaaaatgctaaattcaaaggtaaaaccttataactaggcatcaatacatttatataaagtggaatgatacttgaaatgtttaattaagtctggcagaatcatatgaacacaatgtattttctatgttaaatctcatttggttttaataattagacatttttaccaattgagataaagccgtaaaatttctttacatctggcgtcttattaaatagcctttggaagatatgtatttgtgtgtgtgtgtgtgtgtgtgtgtgtgtgtgtgtgtatgtgtgtgtgtgtgtgtaggcttttgcatatattttaccattccactatctttccaacatgaggaggctttgaactgagtatattttattttggatggagtgaaactaaatgttgttggttttttttttttttttttagtccatccattctttgatttaatttggcaaacccacattagataatttagcagaagaggaattatatcttcatcctattatagtaaaacctctcactaattctgaatttatgatatttgagatgcagtatttgtg

SEQ ID NO: 73804 - DNA, 1142 bp, Homo sapiens
aaatgatttaatgaaagatgtttccaaaatgttatttgggttaggtgccccctttaccatcaatataaagcccaagctcctttctctctctctctctctctcgttctctctctctctctgtgtgtatacatatatctatatgcagaatatagacatttttgttttgtttttgatcatctggttttcttaacctctatttatgatttgtagtaaactcggtaacatttttattttggttttgtagcaagattaatacaaatattaaacctggaagagcttgttaaaacttaatggttaatttaaaaattagtttttatgtttcaatggaaaagatatctgtcttcaacgaatacatggtttactgactttgaatatatatgatattaaaaaagtatttgtaagataatttgattgatttaaattgaacttcttgattatctatttgagactattagtaactacacaataattttatgagtatacaagacgggttttgtactttataaattatatttaagatattaacttttatgtgaaatggtgattaggttatgggtgggggtggggggctggagtggggaaattggaagaaaagtataatgtccaaaaccgttaagaataaatttttatgctttttagtttgaattattttttgttcattatagtgttttcattttgtgagtttttctatgcacatacaaaatgtttctcctcaggcccccttgtatttgctggtcctatttttatgaaccatcgagaacaggctctagccagactcagatcccatccagcacagctaaagcataaacgggacaagcacaaaggtatttggtcttccttatcacctaggtgggatactttcccaatttcttccactcatttgaattttgtctctgggaaaatgcacaaacctgattcttctactttgcttctatcatgatgtagcctgaggagaaagaacattctgaaagtgataccgtttgtcagtgactgtcatgcttcttgtttttttgttgtcgttagctttcataaaggagatattttacaatatatcttttccttgtccatttcttttcaaatttcaaaaagttaagggaaggtggaaaaaataattattgctttctgtcttacatcctttatta

SEQ ID NO: 73805 - DNA, 1060 bp, Homo sapiens
tcataattgtgagctgtagatgggctaaacccatgtcctggcttacatgggagagtcccattttataggtgtccaggcatatttctttttttttttttttttttttttttgagacggagtctcgctctgtcgcccaggctggagtgcagtggtgctatctcggctcactgcaagctccgcctcctgggttcacaccactcttctgcctcagcctcccgagtagctgggactgcaggcgttcaccaccacaccgggctaattttttgtatttttactagagatggggtttcactttgttagccaggatagcctcaatctcctgaccttgtaatccgcctgccttggcctcccaaagtgctgggattacaggcgtgagccaccgcgtccggcatgttgctattactttttaagcccttaaaaccattatggttttcttgatttgacgcatcaaatccaatattagctgatattccagtgacacataaaagtctctttttaaattaaagtattatatgaagaatttagagagtataagtaagaaaaaatagatcagcataaccctttatacaaagagaaccattagtagaattttggtgtaacttctcacacttttttacttatttcatataatttcatactgtgatagatattggtgtcctgtttgtattccctttaatattatatcatgaaatttttttgtgctttattgcaaataccatattaaagtaatataggaatttaggtcaaggttttgcataaacctattccttaattcaattattgtttttatttcgttgtcatcttctaatcaagttttacttatttctagttatatcattgactgaattttgttttacatttttgcttagtgttataatacatatatttttatgttttgcttgtattgtacccctaccttcccatttccatccccccctcaaagtaaatgttaatagtctaatatcttactctattaaaatataatcatgtacagagacttacacatatgtgaaagtgtagacatatgtttatttacaaaagtagtattctgtatatacat

SEQ ID NO: 73806 - DNA, 1044 bp, Homo sapiens
cagctactcaggagactgaggcaggagaatcacttgaacctggcaggtggagcttgcagtgagccatgatcgcaccactgcactccagcctggcgacagagtgagactccatctcaaaagaaaacaaacaaaaaaaatttaactgtggttataattggtatttgaatacgcaaagataaatatatgtattactaaagatttccttgctcagtaaattttttttttgtaggattaagacaaattgttatggaagtctatgattttattcctccaataggcaaaattttgattagaaatgtttactgatattgcatattttaaatgcttattagaaatggcatgatatttgatgcatgaaataaaccttttacccatttaaccatcattatatttttttctagctattctttttgttaatatatggaataagtagtaaaatgtataatacacatggtgaattctagttttactaaacttaaattgtaaaacatatacttggcacatgaagagtgttcttcatagcatctgataagtgatgttgattgataaggtgaatatttactattgtttggctttgcttgcataatgtcctttaaaggatattttaatgagattaatatagatactgtcagtatttacattatataagtatatgggaaaattgcatgttaaatatttcttacaaaacaggatagaattaagtttctgatgtggtaattaataattttttatgttgatataattttttcagattagttaccattctatctgtttgctacctgtttcttctttctttagaaatattaggttgagcgacatgaatgaacctacaaaatgcagctatttcttacatttaaactacagtatagcacatccttacacttaattattcacatttaattacttgcctaatgcggtgtatcttgttactctttttctcttccctctaaaaaagctattcttctctaggtatagtatatttgtgcatataggaaataaaggaacattgaatcgtgcattgataacttgacataacttggtgat

SEQ ID NO: 73807 - DNA, 1190 bp, Homo sapiens
gccatcttgtgcctactgcctcttgctgagttttgttcttctgaagaccttggaaggtcactggaggtttgtaaattatgaagttgtcatgtgctttgggagggtgattggtggcagtaggaggatgatctagagtggggaactcttggcttggagcatggttgggaggctttctttggtctgttgaatgaaagtgttggtagtgaggatggaaaacaggaaaagatttaaaagtatgattgacagaaggtaacagccaagagacatttgacaatagccttccttgccttcttttgcagaaatgaaatggggagagtgtttattagtggtccctaaattaaaatttatttttgttactcaaatttaagcatttctttgtataattgcttggattagcatgctgtcattttttaaactgggaaatatagtcatccatcttttatacatgaaagtaacctgtataaaaattacaaattgatctgtcaaatagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggtaagagacaatgattcctactaaagaacatgtgcagaacacatttctttgcaaaatcattccggagtatactctactattaatatttttttcttaaagaccagtggcatcttcacttgatcttagccaaaaggccaagaaagtattataattcttataattgttttctgttataataatttataatttaatgtcatctctaaggttgcctttctttcatttgattcatttaaaccattatttaaaaacagaccataagtttttcaagacttggggctgtacttttatttgtattatttttcaaagcctatttaatgctagatatctattatatttctttctgttgaacatgaatcttttctaaataaaattatcgatatcataaagagtacttgattagatatatagttttgttttaaattaaatgtaccatttataaatttagaaacgttgtatgcttgcttctaaagttacatcatacctgctatatttatc

SEQ ID NO: 73808 - DNA, 1188 bp, Homo sapiens
tgcactattccaaaaagtaccataattcctttttttttttaatacataagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaagtaagttgagtgatcaactatgcatttaataaaaataaatgctttattttagtaaaaataaaactttattaagataaagtttatgaatttcaataacaccacaccaactttatatatatatcattgacttgatgtaactgcttaataaatacatattgaatgaatgaggaacttattttactttccaggatctaacaagaatacatgtgaattacaacttgggaaaaaaaggagattttagatatgtgttagtagaatggtattaataatgcaatagctaatttagagattgggccctccaggagtttggtagaaaactaatattactcactgagaatttgaatgtacttcagggaatgaggatctagcaatgatagcgtaaatattaattgaccagatgaggctagcaggttcactgattttaaatgacatgttgggaagcccaggcctttgtgaaaataaacaaatagtgtcataaatgcaaataatatgggttttttttttagctttatatacaaaccattattattattatttgtacatagaggtcttgatttaatctaatttcttttttaaagctaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtaagttaataaaaagttttacttttatgcaaagaagtttcaatactagttatgtatgacaaagacatatctagaaaatttatgttggtggcatgctttctctacattttttacatttccttccaaatgtgaaatatttcgaaagagaaattttctgtcatatcttgtcactaggagcactgtccctagt

SEQ ID NO: 73809 - DNA, 1650 bp, Homo sapiens
gtgtgtgctgtattagtggtgaagaatgaaccaaacttcaggaagatagtcccatatttgtcttcagaactggcagatgttgcttgatatattcctgaagatacaagcttaaaatattacatgatggataaagaaaggataaagagaaaatcttgaaatcacgtggcagaagactcctccctcaagcctgaagaagccttttgtaattttcttgtttctttgacctggactgaattttcatccaatagcactttttgtttttcgtgggtaggaatagctctgctctgtagccttccaatcaaggagcagaagtaaattgtcaggtttatagatggtaatgaataccatgtttcaagttgacataaatcaggtaattccttgagcttcatgttccagcttgtcttacagtatagtttatttaaaaagtatttcaaccttgttttgatgaacttaaaacatactttttttatctgataattgtcattttattctttaaacctcggcttatcttacagattgtatctttatgtcattttctctccatgtctggtgacaggttgcctcagttcatgaggctttttgctactcttcttgcgccgcttcactcctcacccctgcgtttatctgaaattataatgagtttttcttctttgctttttagtttaaaatcttactgcttagagcttgagaagcatctttcttgcgcctctttgtgttctgtacagtggactaggaactctttcttttgatttctcctctctttgattaccaagtctcttgggctaccagtgggccttgtctcccagtttctatttccagtttgtgatccctgaattctctatttggtaagggtctgcctgtgttttgcatatttatgataaggaagtatgctagtatgaagctcctgggcaaagataaagaataatccagcttattcgggtgggctccattactgcatttcaaaatcagaattttatgttttgttgattcaggtgcaactagaaatgaaatgttattttttgttttggtattgtgattaatggagagattcatcctagttttctgcagttattttgggaagtatgtgtgtgtgtgtgtgtgtgcttttaacttgcttgctgaaaatttgtttttccaaaaggacagaatttatccttgatgttgattttgcttgtagttttgtgttatttagtagcaatcactaacacgtgttcctgtggtccttctgtaatactggtatcccttgttacaattgagcttgtgcattattttgatcaaagtatatggtgtactattctatggagatacatgcagtattgatgaaatatggtattctagccaagatacatgactgctttgagataaaaataaaagcataagcatatatttgtctgctcttgttggacaaacatttaaaaagtttagagcacactaaatgctaaaaatgctgtgaataaacattgaatttttaagtgggaaatgtacaactggttttgaatatccattttacaaagcaagggatatctgtagttggacacaatagatgtcaaatacagaagctttaggtcgtatttttctgtgacactaatgactgtgatgtatgtctgagagtagagtgttgcctccattgcatgtgattgtattgaaatg

SEQ ID NO: 73810 - DNA, 1050 bp, Homo sapiens
ttttatctaagaaataatgccgtggaaagtatattattatagcagtgtgttcaatggcataccacaccttctgaaaccactatgctattcattttcaaatagcaaactcaatacttgttatttttcttaaagtacttgttaaagtaacagtgatcattcatattatttacttggcaagtggtatggtcattttgaacaaaatgtttgtaactgtactgtcctgtttagtatacctaattatgtttctgggaatatgttacatcaattttcaataatgtatgacttttcctctaattgagaggaatgttcttatatttttaatcattaatatcttttagacatcaatattgatgtattattgtacctcaaaaacctgtaatatggagctgtatggctgctgtttctgctgaattagtaataaatattttaacaggaaaattttttgctgttatcagggttatttattatatagagatgtgaataaccacagcatgacagccataaggataagccctgaaacactggagcaagatggtactgtgatgttaccaggtatgtttcaagtagtcattttttctccacaagcaattttaagaaatgtgcatgttaagctatttagacacataaagaatgattagcaagggatagtgcttgcttataaaagggttttaaaaatcttgacatacaaagcattttatagtctacgtgaagttaatacatatcaagagaatagacatagaaatataacaagttttaatatttgttttcaaacttggccgtctatggcctaatctctgacctcaccccaccactgctgaattagtggggtgatgtaactgtgttgctcttaataaaaatcagaactctggctctcatgtgactcagtataaagaaccttctgtttatttttactttaacaacagtgcagttgggttttcctccttatttaatttaatttaattttatttaatttaatttaattttattttattttattttatgttaaaggggtttcagagacagagagtttagggtaggtcaggaattttt

SEQ ID NO: 73811 - DNA, 1166 bp, Homo sapiens
attagaaacttaaaatgggttaactattgtataatatggttgaagatggaaatggtgaactgaaagataaagaggaagaaattatctagaatgcaacagagagacaaggagagaaatatggaagataaaataagaaacatggatcgagaatgacaaaatctaatgtaatacaatctgagttccacaaggcaataatagatttgtggagatagagtacttgaaataatggctaagattttacagaattggtgaatgacatggaatcccaagagtaaggaagtctaccttgcttgagatttgcttcttatagatgaacttttagttggtactttttgctggcatgcgaaatatcattctgaacaatttattgtcttatgaatgatgatgtattaccaaagtatctttgttctgtgtttgtaacatttaaaaatgttttttcattatttttcttctcttttgattaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttagggtaatgtgattccttacagttccttaattatacagagttataaccataatgaattgtgttctgtgtgtttctagtttcatttctagaatatgatctaattttagtgtaataatatttatttgaaaaccataattgaaatacatgcattaaatgtcattcacccatttgtattatttttcattgattattaattatgaaaccactgatatactaacttttgttttttttgcagggccatatatacaattctacatcccgtattagaaacagaaaagaaaaaaagtcttggttagggtatgctcaggtaagaaactatccacaataaaccaaaattttcttatcttttacaacatgtgatttgtccttgtttaatcagtaatatcacttctatttaaacagaaatgataatatatttttactaatatggccataataactgaatagtgtagcgtaaagaac

SEQ ID NO: 73812 - DNA, 1245 bp, Homo sapiens
tccctgaagatgtgacatatgagatttagagggtgaataggagggagtgaattcgattataagtgctctaggcagaaataacagcatttagtaaggctctgagacagaaaggagaatgaatgaaaagaagagcaatatggctagaatgtggagagtgaaggaaacagtcttgtgacaggtgaggaaggaggcagggacatgcagagctttacatgccatgttaaagaatttgattagtgggctaggaggaatggaaagtcattctctatttcattacatgaagaatattgttttttaaatagccttattttcttaaattatttgtttaaactattgactattttctttccctggattcttaacctttttgaaagggtagagacattctttgtcatgtttgccaataccctagtgtagaatagttgccagtgtgtgagagttcggtatatatttgctgaataatcaacagatgtactcactgaaggataataattggaggaaggatgggtagatggaaatatggacaaacagggatagatgaaaggatggagggaaggaaggatagctggaggaaaaggtagaggaaaggataaatggaaaaaaatggaagtataggatgtgtacagacaagtgaagagaggaagggggaaagaaaagaagacagaagggaggaagaaattaacaaaggagtgaaagaattttaagtagacaatcagatttttggtttgaaattctccctggctattggggcaaaagcgaatggtaagagataatttcttaacactttttatcaaagagatgatgatagcatggattggaaagatgatgatgagatagggaaaagtggagttatccattaggaagtaaaataaacaggacttaatttgggattagctatggaagatgagggattggtaggggctgcctgggtttctgtaagttaccagataacccacaggtggcattttagtttttagagaattgcagtacattactcctctttctcttgttctcctccttctctcccttccctttccctctcttcatgtttctcagtttttctttttctaactctctttttccctctccatctgattattcactctataaggattttcaagtctccgttctatggaagaaatacccagatgtctgttgattgaatcttagatggaggtgttcagggaattttgtgcagagacctctgctggttgtaaaacatttgtgtgtgtgtgtgtttcatct

SEQ ID NO: 73813 - DNA, 1033 bp, Homo sapiens
attagcatgtatcagagttatcggggacttccctatggtgtttctgattccatagacttggggtggggcccaaaagtttgtatttggaattagtttcttggtgatacagatgctggtttgaggagtacactgctggtttagactaaaacttggtcctttttttccgacttggctatttagattttgtaggacccacctgtgagaaccaaactgcatgaacctaactacatgtcagatttttcttttttggtcgcatgtggggactcagttattgtgtttgacttttgtttgttttaatgagagggaggatgctggtcattgaatcaagctgaggattttttaaaaccacccccctcacatacacagttattaaaagctattaccaaatagaagctgtcatgttggcaggcaagcaccgtgttggttattgttatgatagcaccagtgatcatattaatattgtgaagtgctgcttggcttgacagcattttactgaagatttgatttattttatttaacaatattttgctcggttttcttggatttggtttgttagttagcaaataattggaatgttgaaatacccgcgaagacttggatgtcgtatttcctactttgaacatgttatttctttcctcctaagtcttctaccattctcatgtctcatgtcagttgttatatactttcctttgtatccattctgtacatactttctttcctttattcttttaaaactagaacttgttcttaatactggctttggcatataatatgtgctttagtcttatcttccatcaaaactttcacattattggctgggtgtggtggcttatgcctgtaatcccagcactttgggaggctgaggcaggaggatagcttaaggctgggagtttgggaccagtctgggcaacttagacccctatctctccaaaaaaaaaaaaaaaaaaaaaaactgggcatggaaatgagtgctactcaagaggctaaggtgggaggaccgctcgagcccaggagtctgaggctacagtcggct

SEQ ID NO: 73814 - DNA, 1167 bp, Homo sapiens
tgttacttgaatgagaatgaaatgagctgatgaaaattaagtgtttttttgggaggccctcatttctgtgtaaacttctatatctacttttaaaagcattcaaaatgcaatctaatgtttgtagtaggtcattgagactctacagtgtgtctagagtctcttaggaagtcgtaaaatgaatttcctttgatacagaactctaagagttaagctttgttgagtctattcctgtcatggcgatacaagaatatttctaagttttttgcccatccttttccagcccttgtcagattggttggttattgctgcattgctcaaaaaatagtgaggtatagaaaaggggactagaagttgggtccatagacttagactgtctctgctgtgtcacataatgtgtcttctgcaagtcagttagtgtgtctaatctttacttttatgtaaaatgggacttgatgatagaaaagagtgtgaaatggaaatattctgttttgtatttcagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaaggtaagccactgagttctattaatatttagatgtgtaacctgcaggtgttctggctataatgcatatatacgcattgctaaaatactttgctttatgtaaaattgcacactaaaaataacacggcttatgggcaaaaatagatttggagcagaaaaggaaaactctgcaactttataactaaggtgctaacaaagtcaataattgataattcactggaaagcgcaggaagggagatcagtgggttggagtctgttataggggcaattaaaaaatgtacaaaagcagtagggtggaaatgctagtatagaggcattgagccatggcagatggaagtagagctctgagccagtgagccgagagtaaggtgggcacaagagaaagccaagagccctggaaagctgggaggtgctcctcacctgggatgcaggtatgcgtttttatttttcttgaaa

SEQ ID NO: 73815 - DNA, 1021 bp, Homo sapiens
ttggcagctaaaactgattgcagctgagtcccactccacgcattgccctgagccaagagttgcctcccccagagtcatgcctcctcttcaggggcagtttacatctaatatctatacagtgtagggatataaatgcctagcgcttttgctataagacaagccaaccttgaagtctatcccaacaccagagagctctcccatgggtctggctgagggcttcctgggactgcattgcagatcaactccttcctctgttcagtcttacgtctttcactgccccacagttgttggttcggagggcactccgcaataaacttccggtgtgcacatctgcatttgagagtctgtttcctgggaaccctcctacccaaagcagttggtgccaggagtggtctcagaaagtagactttacagtgaggttttgaagctggattattggctggctggctggcaatgagaatcgattctggtgctagatggagcactaatactgataacgcttggcatgcactgtagctatgcaacttaaaactttcactggtggtgagttggaatgctattcctgttgaagggaatgcactggtgagtgcactaggcttttgagaagttcagagaaattaattatgaggacaatcatcagatggcttttggtaaataacattgatagattggagaaagatgatgcaaggtggaagataattgggggcaaaatgtaaaaggaaatttatttagcatcatgtaaagaaacacatatacagtaagaggaaaaatctaaggcttcaacccaaaacttaattttaagggtagcagagcaccaaggtaggtagaattctctctcagctatgctaaggtcagtgttctggttgggcaggaatcctgacccttaggatggggcatctgagtgcacttgaaaaccctgaaaccccaaattcctcttaaccctctgggcctgcagaagtggccttcttctactagctagaggggttgcttgcagactgtgctgtccctcttacccccagct

SEQ ID NO: 73816 - DNA, 1025 bp, Homo sapiens
cagtctcctccagtagctgggactacaggcatgcaccaccatgcctggcttgttttttattttttgtagacacagggtctcaccatgttgtccaggctggtcttgaactcctgagcttaagtgatcctcccacctccacctcccaaagtgctgggattatgggtgtgagccaccatgctcagcttgctcagggattattacttggcactaaccattggccctataaaaatttataagacacaaattctagacttgagtttactgtctatctggaagtgcaagatacaaaggcagatacttatagaagtgttaaatgaaatgaccaagaaagtataacctactatgacaaaggcatggcattctaggctggcttaaaagcatcagcagagacaggaaagcacagtttgtatgtaggtaacagtaggaattctgttagagctagaatgcaggtgtcatgaaggacagtagtggaattcattctggaaatggaggctttggctaggatggggcatcttgaagaccaaggtaagaattagattttattcagtagacactgatcacccttgatggttttaagctatgaagagacgttatttattgtaggaatatgtcaggaagtaatgcgggattgaatctgtatgtgtacatctgtatttgtgcataggtagtaattttcttcatgtagctgttatatcagtggaatcctgtatagtgtataaacacaagttaaggcaaaaactgctctattggtatactggtaggtagaaatgtgaaatgaattagtttcctaactcaagagaagaaaaaaatcttgcctctgggcttaaaaggaaaataaaaatgtcaatctaaaaatacttttgtcctttaatatatttgtttaaaaaatcaacagaatagtctcacttttttctcaaaaaccagattaaacatttaggttttctgaggaggggttaggttaattgaggtttaatttatatacaataaaattcatcctctttaaatgttcatttgaagagtcctga

SEQ ID NO: 73817 - DNA, 1024 bp, Homo sapiens
ctctaggagagtggattgaaaattctcagaagtggtaaatgttgaagaaagtgagaaccgttttcaggtcattgataacttttgaggaagtggtcagaatagagggatgtggtgaggagtgaatggaatgtgtttttggtaactcaaggggatttcaaagttgagggaaggatattcaagtataggaggttgggtgggatatgcaaatatgggaggctaaatggagagacagagtgaagaagtgagagaggggataattgataggaaaaggtcaaagggatctcagggacaggaagaggtcaaagggatctcagggatagagttaaggtgacaggtggagaggttagccattgaaaaaaggagcagttaatatagaaggggtggaggtgagtacttgtaaatataaagactgggagtttattgaggataggcatcatatcctattcgttttgataatcccaatgtctagcacattttttggcatgaattctgtaaacatcaagtgcctgctctgtgccaggcagtattgcagatgctgaagatgtagcggtgagcaagatagacaaagtctctgccgtcttggaaaatccactccaatgggagaaatagacaactcataatttcacttagtaataagtaactgtgaaggcaataaaacctatttcatgtgatagggcaatttgtagtggggctattttaggtaacatggtcaggaaatgtctctttgagagttggcatttaaattgaattgccatgatgaggaggcagatgtagaggaagaatgttctgggaatttataaaggccttgaaatgggaacaggcttgtgttcaagaaacaaaaacatgatgagtgagttatcagtcaatgtcaaatgaattaattactctttgctttaggtgtacagttgagaagttgagagtttcaaacctaatggactcagtgactttgatgacagtctaacaaagtggttaagagcttgggcacagaagctagactggttttgcatcctggttttgtcatttg

SEQ ID NO: 73818 - DNA, 1045 bp, Homo sapiens
tgtatgtggatttacctctgacataggtcaaatattatcctctgaaacctagccacattcaacaaaaaagcctcatctaagacaatctttgttcaatccaccaatatcagcattatctaaaggctctactttgtgggagatgggataagagagcagaaaggacatgtgtttgagtcagacagatctggtttcaaatgccagttctgccacctcgtatttctataatcttcataaagtcccttaatgggtttggatgttaatattctaaatacctccttcacaaggtcacagtatgcttttgaggagataatatatgtaaagtgcctagaaaataggaggccctccttgaccctatcgtacaagatactgtgaatgattgatagctttctgtgttttcagggaaccagtgtggcagagtgaaaaataataggttggtgcaaacgtaattgctggttttgctgttaaaattaatagcaaggcctttgaagttgtgtaaaatcaggtctcactctcctttgccatttttttggtggtctgactttaggcatattacttaacctctttgggtttctgtttcctcatgaagacaaaaagaaaagctcttctatctgcagacacatgaggaattagtgagttaagatatataaacatctagcacaatgcctggcatagtaaatgctcagttaagagcagcctcagttacagtatgttattactgtgggattaagatttatttattaagatttttttcaaagttctttttatttccctttatgttcaaataatcaaaacctcccggactacaattaacaatgcgaaggctcagattaatttctgagatgagtactgggtatttcatttcattcctgcccctgtttatgaaggagcagaaaagcaaatctcacagttccacatgctgcagagcagaaagatggtcatcagctccatggaggtgatttttcatggctccaacaacctaatcttcatgattgatgattgctgctttaagacgtttaatagttccttccaaaagaatttgtatttc

SEQ ID NO: 73819 - DNA, 1046 bp, Homo sapiens
actcatcacttttgggaactttaagccattttttcaaagctgcacccttatttctgtaaagtaatctcagtttcagtctgaatgtggtactagaaaatgctctcatgatggtccttagatttcactaataactctcagcccttatgccactttcaaattattttaggttgatttagtccctacttagccttttctgatggtatgtatgtaaacagtggaaggaaacttgtttacatttttgatggggagatatatgggatcagttttatgcttaaaatatttgcattttaaaatttattgtgatattgtttgtaaatatgagattagtaatctattaataactttccttcttttgaatggatttctgtcatatttagttagcatcctattactagcattttggtacctaggctttctttttatagtttaattttgtccaaatagcattgaaataatcaactttaacagaaatcacccacttagtggtattagtatattagctcttcagatggtttgaagcaaatcaaagttgaagcaggttctatttcattcaacaagtacacaggtgaataaatcaaagccttgatgctttacaaatgtttctagagacaaatggcagagaatcttcctgaaaacaagcctgagattagaattccaggtggaaaaacaaggagggttcattaatcttagtgggatggtcttaaaaattttaaagttacctgatttacataattttattattacattttatgcatcaagattttgtttgcattgcaaatctttttgatgaagaaaatatcaacagggtttaatttttaaagtttaacccacttgttaatgcttgcaaagcactctgttcctttatcactgcagactatagtgtcccagtagtgtggtctcagaaataagagtgctgttcatttggttccctgatatgtttgcaggatggcaacttatttttatttcctgtgtttattaagaaacaactggagtgggtatatagtaccttattttaaaaatatttaaaactacaagttttacatgct

SEQ ID NO: 73820 - DNA, 1105 bp, Homo sapiens
ttgagtgacttctatgtaccaggtaccattgtaggtgatggagatgcatcagtgaacagcacaggtattaagtctctgccctcattgagctcaccttctggtattcagattttcacttagtcctccagatctgtaaggtatttttatttgtgtttgtaaaatctagtggctttctatttcagtttattcaggtaatgaagcctgtctttgatcaaagtaggagaggagcagttgcctgagcaggcggggtggggagctggagggtttaggtgctttcctatagattttcagtcacctggtttttttcacttcaccacaaaactccctaccctctgtggtacttcgcacctacgattccagaaccttgctaggtccttattagtttctttttgctgtaaggccatagaacagaggatgtcaaaacccaagtctcttccgcttttcatttctaagatgttgtgaccatcccgagtgtgataattgtctcctgtcccgttcagtcttcctatggctttataagagtttgagtttaactcttactgtagtgtggttttataagagaatagggaggaattcatagttaatcccccatattgaagaatacttactggcttccaattaagggggtcctttgtcaatgatggttaattgacagatatcaaaaattatggttttgacccacactttattcataacataaagatttaattggaataatgcgagctttccatatttttggtttcaataattctctaataaagcatttttcttttttttattatactttaagttttagggtacatgtgcatgatgggcaggtttgttacatatgtatacatgtgccatgttggtgtgctgcacccagtaactcgtcattttatttttctttttgcttagacttaatttctcccttgggcagtccgcatttttgagtaacagatattactgagtgttttctttgagactagagttgtttcttttcatttgaatataaattgcccaagggaatggactttgttttgttgagcaccagttctctaattcctagaagggtacctgacacaaaatagatgctgttgctaaagtaaatgaatgtttttttgag

SEQ ID NO: 73821 - DNA, 1050 bp, Homo sapiens
tctttgttcttttaagattaaattattaagtttgatttaaactatagcagacacacagacctaaagggaaaatggcttctataaaagggaatttttaaacatgcctttgaagtgtaattactactacattttttttttttaaatctccactattaattgcagatgggaagtcagaagatgacttgtgaagttgtagcagtcactctggtcctggataatactggatttgatctggtgtgcttaaagctgttgtcttatcttcagttttgaccaatgattaagtggaaacaagttgatagtcaagataacttcccctttctgacctttatgtttcagctctactttgagactgttgtcctggttaaagaagtcccgcagaaggatccgataatagtcatgagggaagagcattagatgtgtgatcgtgcagtgggttaagatctgagaagtagataaggtctaatcctttaattatgattagatgccttatccattaagattatgtttcctattaaaacctaagaaacacttgaccttttaaacttagtgtcaagaataattataaaactctgatttccgtggaataaatgttattcagtagtactccttatgcaacatggtggaatttgtaactctcattcaacaaatatttatgaaacatttacctgccaattgtcaggagtatacaactgctttgttacttttgaactgaatatattttaaagcttaatcctaatatcaaaagtgattttcttcattaactctgcatattaattacatatgaactaatgaactcttgcattgggtatttcttaaagatggtatataaatcatgttttaaaaatattacattttgagtaaaattggaagtttaaagattgagtatctgtagtatcctggtatcataggtactcatacatatatatgatggttaatgatttttaagttattacattcattgtcatagtttgaatgaatgggaactgcaggaaaagatacaaactaactttctgataagtttttcatagctaaatttgaagactgtgagac

SEQ ID NO: 73822 - DNA, 1016 bp, Homo sapiens
aatgttggctgggcggtggctcacacttgtaatcccagcacttttggaggctgaggcggatggatcacctgaggtcaggagtttgagaccagcctgaccaatatggtgaaaccccctctctactaaaaatacataaaacagccaggtgtagtggcacatgtctgtagtcccagctactcaggaggctgagacaggagaattgcttgaacctgggaggtggaggtttcagtgagctgagatcgtgccactgcactccagcctgggtgtcagagtgagactcagtctcaaaataaaataaaaataaataaataaataaataaaaaagaatgtagaatgtttttgctacaacttgctataacatttcattaaaaaaagtattaccatttgtgaatgcttgctgcaggctttcatcctgtacccatgaaaagcctgtttatttcttcctacaaacataactttttttcatatgagaacactgcaacatttaagatgttatgatttgctccaaatttcaaagctagtatgtggcaggatgaagactggaactcgggcatctgaattcttactgaagtgtcctttcagtcttttcttggtctttattacaatatgttatggaaaactgtagtgaagaagtatcctgtcagccatcactgctgtgtctcaacacctgatgctatggttccagccctgcacgtttttctgagtgactattataaaactggtaatatatgttagcccggggttgacacactatggccatatctgtttttctgcctgttctgtatggcctaagagcatttaaaatgtaaaatgttaaatgccttttatgttttttaatggttgaaaaaaacaagaatatttcataacccatgaatattaaattcaattctcagtgtatataaattaagtgtatctatgcttctataaaacattttcatttcagttttttcaatagctgctttcataccataatgtcagcattgagctggtgtgacagaaaccctatggccagcaaa

SEQ ID NO: 73823 - DNA, 1043 bp, Homo sapiens
tccagagatatgcttttcagactgacccaggcagtcactttcatggttaaccattttccttgtttccagtagtggccatcctagccttttactacatgaggttctttattccagcctctggaataaatattctcagcatatttattgcctgtaacttacagattaaaaagccttaaactcaccttcctctccctcattctctgtattctgtctttacctccctgtttcagaggaagtgagaaccctccctttccaaggctgttccccctagctaatctctgtcccattcctctcatctccaggaacttttttccatgcttttctttttccttagactcttctcttgtctgttatttctaatctccaagtctccttgatcctaaaagccatcctcccttgagccttatactcctcaagctacagcccccctctttttttaaacaacaacaacaacaaaacaacaacaaaaacatttatagccaaatctctcttcaaagactttttcctcaccttatatctgcctgacctgctaacactgatttttccttatgtcttctgctgaatctgctctcatcagtggcctggttgttctagccagtagcctctttttagtccttatcctacatgccctccctgagtagttgccactattaactattagctcccatgttgaaactcttctgcattagtctttttttttttttggttgggactggatgcatctttgagcctctggaattctcctccccaaattatctttctcagtttcctttactcattctccatctgtctactctaaattgttccttccagtcccttctcttttccttgtgtattttctccttgggtgatttcaatcatgcttcatctaacacctatttgttgatgtaccctgaatctgtttgtctctctagccctcttccctgaactccaactccatactggacacaagcatgtaggcatttccagtaaccatcttgagttcaactaattttttttttaatctaaacatgagtatctcatgctctccatgtgcgatggca

SEQ ID NO: 73824 - DNA, 1055 bp, Homo sapiens
tgaggacctcccctggagcctgtgttgcctggatgcctagatctagctgtttggtggacaatgagtgtctcctttagtcctaaagattcctgagtctttgttcatagagtgatgagtcttgctgcctctttaatgtgagcaagctcatttgaattctttacttggtctattcttccagtttcctgctgcatctcagcccttgaagattaaactgctgatttcttgtgaagatagaactagaacattacttttggttccctgaactttaaagaatatgtggttattaaaacgttccacattgtttgacaggaaatgtacctcatttccagatggtctgacacaagttggagatcacagctttgttccaaggggaatagtgtcctaaatatttacacttggaagaccttatttttaagagcatatttcaggattaaagctttgtgaaactgacttgttgcttaaatatgagtaaagattggttttaaagactaacacagattagaggcatagccaaatgtaacgtatggaccttgattggatcgtggtttagaggaaaaagcttgtgaaagatattcttgggatgtctgaaaaattttgtatgcagattatcatatgatattgttaatttgtttacatgtgattacaatattgtgattccatagaattttctcaggagatcaatatgcatttaaagtgtcaagatgtctgaagttttatcttgtttagcaaagcaaacaaaagtacatgtggagatgaattaaatatggcaaaatggaaacaaccagtatagccaggtggaaaaacaggtgtttatgatactattttttaacatttctatatgtatgaaaactattatagtaaatagttggagagagattttaaaaagaaatatagaagctcaattaattttctcaatagcatataattatgttcctgtgcctccctgctgcttaaaaatatatgtattggaaatatgtatagtgaaaatagtctagtactgatagaggctgtcttttttacaccagtttttgtaatagtcaaaagatctagatatg

SEQ ID NO: 73825 - DNA, 1016 bp, Homo sapiens
aaaatcatcatttctaagtcaagcataatactgagagaaagcccccaagaagaatattaaagtgtaggagaaggaggactctcataacttttgtttcaaatcttaagattatgttctcatttactttcatttctgagcattctaagccactgttctttatgcattctaagttcctatcatgacaatttctggttctgggccattttgctttctggaaagaacagaggtaggatagagagttggaaaggctgcaagtatagaaggaggaacacagttgtagtcaaagacctggttttgggtcttttcttaatcataaattctttggaaagttaagtattctttctcagtcttgttttctcagttgtaaaattaggattatgcctattaattctaactagtttctcttatgtgtttttttttaaatcaagggtggttatatatgttacatgtaggagagatagtaggactctattcctgaataaactgttctgtaatttcatttcaaatgaaattggttggcatttcattgactctgcagatcaatttttggaagatcttaacaatattaagtctttgcatccattaatatgtaatagtcctccattgactcaggtctttaatatcagtgaagttttgtagctttctatatagaggttttatgtttctatagttaaattaatttctaggtattgtgatttttaataagtagtatttttataaatagtatttcctcaggtttctttcagtttctactagtttgctggtattttgaatataattgatttttgtgttttgatattgaatccagcaactttgctaaattaatatctcctaatagttacccaacataatgagtgcatatgatcaccaaaacatgttcaaggaggttcataaaaccccaaattagaaataacctagctttctgtcatcaggggaataatcacatttatacaatggaatactgcttagtaatacagcaacacaggtgaatctcacagacaaagtgtcgagtgaaa

SEQ ID NO: 73826 - DNA, 1031 bp, Homo sapiens
tgggagataagcatgcagtgaagacccgtaagtgtgaaccacaaggtacacttgagatggtgccagtggcttctcattactgcagtggaagaacatagatgggagagtaggtcaaagtgagtgatgtgactcataggattattaacaatctctctctctgtttttcttgtctctttttagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgttt

SEQ ID NO: 73827 - DNA, 1067 bp, Homo sapiens
attatttatgatttggagatttgcagcctggggctggtttaccggaactgttttgaacaaaaacaaaaggaactcttttcttggttgctccaggattctttgattctttgatccaaagaactctgttgtctgtaggagacgtggaggaggagtacacacagaagaaaggccttttccaggccagtggccttgcttgttttatatgagtttaactttcatactaaatctcatccacttcagcaatttctttatggttaattaaaactccctgtgattgttgtggtatggtagagatggaatggagatgacttaggagtgaataagatgatttccaggcactggcaggtgaaatgtgtaccattttgcaaggcaaaattatattataaatctttgtccctggtatattgagcaaaatggataagggtcactcataaaccctcatgctgcagccgccaacccctttttaagactcagccaatgcctcaatttctccaggaaacttttctgatctcttcatgctccaggctaggcagccaaactctatgctccacagcaccttgttattgcattgattacattagcgttacaatagatgtttgtgtttaataatagtttgaaaaataggaccataactttgtcttataagtctttatactgccggtgacagtttccaatgccctaaaatttctcaatataagtctttgagaagacctgaattgagtttcatttatttatttaataaatatttagtgaacacctattatatggagacataaggaagaggaaaatcagacattttcagcttttcatttttgctactaaaagtcatcagtttgattatatcagattgaaaatttgtttcaggatttgacatctgaagccactcagacttgtctgtctatagaactagtgtgcttccttcaattaggcaccagccttgtataatcatcctatgtgtggacaactgagaaagaagatacccaataaaataagattcttaataaatcttcaaaggacaataattgactaattagttatcactgatgtctgtgtatatatttaaacat

SEQ ID NO: 73828 - DNA, 1016 bp, Homo sapiens
tatatatatatattttaagagacgtggtttctctatgtcacccaggctagagtgcagcagtaggaccatacctcactgtcgccttgagctactgggctcaagggattctcctgcctcagcctcacaagtaactgggacttccggcacctgccacaagccccagctaatttttaagttttttatagagacagggtcttgctatgttgccgagactggtctcaaagtcctattctcaagcaatcctcctgacttgacctctcaaagtgctgataatacagatgtgagccaccatgccctgcaaaaatagttgtttacgttctccatctcatcttgggatgttttattcttggttattcatctgttctcttctgcggagacaaatgtagccactagctcagggaacttaagacaaacatttctcctctgttccccaaggatcagggaaccagcttgcagaacaagaagctttatttggtaggcggtaacaatttcccttgactcttggttgaaatgtcactcaattaggagtcttcccctgtactgctgagcagagagagacaattctcctgggatgcttctcttttccaaccctacttctgagataaagctggtagttggggaaacatattcttcctctgaaattggcagggacacttaatatcacagggcagaacttggtttgctgaagatagaacttattcaatttctttttggactctctttttggattttctattgatgaattaagtcactgctttaaaaacctatatatttataagcatatacgattaaatgcatgttatctgtgaggtgtaacttggtcagttccaacagaggaatgcatgatattatcttaattctgcctcttagcagttgagaggaaagttgttcaatatcgggtgtgtgacgatttttataatgtcttaaggtgggctttgccattgcctcaagaactttccttggcatggcctgtctctcaattcaaattaccgctattgataatgatcagaagacag

SEQ ID NO: 73829 - DNA, 1072 bp, Homo sapiens
agttagtaagttttgcttcttggtaatggggctcagcaaattttactttctgacacattttataacccttcagagtaggtacagtaattacaaatgactatatcaccacaccctgctggtgccaggctctgctctaagtctctctgagaatgtttttgattgcaactgcataatttttaatgattaaaagaatgatttgatcggtgcatcaacaatacagtgttattttgtgggactctgatacctgttggtttccaataaggaaagggaatattaatgctttcatcaaagaaaaggatgttaagaatgggtcttattagagaaacataagtgaggcttctgtttttaaatatagaattcatcttgcattttaaaacaccaaagaaattttatttgcagtgacttttgtaattccagtttctgaagtcagacacgtctctcatgcgctaagtttttctttgtctacaagagacaagaaaatagagcatttctacactaaattcttttcacattaaaaaaagaaaaaagaaaaaatgaactggccatgggcctgtacattaaatttcatgacttaaaaccatagcaatcaaatattttataattagaatcattattttcttcatgttttgagctgttttacaaacaaagagaaggcaaaaactccacacttacacattcctacattaaatgtagaaacattacaaaaattagattaggaaatagatgaatataatgaccttactctcaatcatatgctgctagctaagtgtttgagactgaaaaattgcactaatgaagctatttgaaggcttttgtggacaactgcttcctctttgaagattaaatgaatgatgttgatgtgattaatcttagtacagggagtgatgcagcagctagaaaataccttggtgattttcataattaaactgaatcaacatttcaaagaaatgccagtgttatcacttgtatattagaattacattcattagacagaagaaacaaataatttgagcaaacaagattttccttttggtgtactgagacttctatcatgtctcagagtatcttacta

SEQ ID NO: 73830 - DNA, 1010 bp, Homo sapiens
agatttacaaagggttttttttaaagtctgcctcaagcagaaatgttgcaggcaaacacatgtgtattatataataatgatcaatgtaggtattaagaatttaagaatttgctttaaataaaacctttaccacataaaaataagagtattatgttaataaaacatcatgaaaatgaatttcctattttatgtagtaggaaactgtgcaaaacaaaaaaaaatgctttgctttctggtaagcgaatctatatatggcttgaaggagtagtaagactattctaagacgcctttaactgtcaatccatgaaaaaaaaacaaaaagggacctcctgaagaggccaaactatcattgaagtgggtgtcaatgagtgatagtttggcctttcaaagttttctagttctgaagagaagttcactctaagcggattcctccaccagttttggggtgaatatgataaaatgtgtgtctcggattcttttaaagaataatctcaaaataagtttgagagagtgggaaaattgggctccgtttgcatttcagcttctcaggaaatccaggcggcggcgggggtggaataggaaaagcaaaagacaaataagcattaaagcatctgccacatttatgccatccatttgtcttaaatttcctcttttccccagttctagctccaggtcgtgttccttctgtaggtctaaaaaaattatgtcctcaagacccatcaactaacttctgaataatttttgtttaatgcgtgttctgaaattgctctcaacttcgattacagtttcataaataaactgtaggcacccactgccgtgattgtatcgatttttgttttcttgtgatactgagactacttcggtccagttcctcctacacgtggcagcgcacgtgagagaacagggcgccccaagcccgcaggactcactcagcgatccctgccctctgcctctgccccgccgccccggcctctcctgatagcacctggcacctgcgtgaagtatcccta

SEQ ID NO: 73831 - DNA, 3225 bp, Homo sapiens
atcataaatctttgccattgttttaggggataactcttcatgcatatatgagctgaattgatacagccagctcttcgaggggaaatcatcagcacatttctgcctctctgctaccatagatctgatttaaccacaaaaatatcctattaggttttgctattattatcatatgtttattattatgtaagtggggaaaccattttttgaaaatatacatctggcatttgccctactcattgagtggtctgaaatgtcactgttaggtgaaattagaatagcctgggacagtttgcactctcaaaccttgaaaagaaaaaagcttgagttataagattaactatctttccattctttgtaggtttggaaggtttgcagttgctgctcttcagtccaaagtagaacagtatgagcgtgaaaccaatcgcctcaagaaagccctggaacgaagtgataagtatatagaggaactagaatctcaagttgcacagctaaaaaattcaagtgaagagaaagaagctatgaattccatttgccagacagcactttctgcagatggcaaagggagcaaaggcagtgaggaggatgtggtgtcaaagaatcaaggcgatagtgccagaaagcagcctggctcatccacctccagttcttctcacctagcgaagccttccagcagcagactgtgtgacaccagttctgcaaggcaggaaagtaccagcaaagcagaccttaactgttctaagaacaaagacctatatcaagaacaggtagaagtaatgttagatgtgacagatacaagtatggatacttatttggaaagagaatgggggaataaaccaagtgactgtgtaccctacaaagatgaagaactttatgatcttccagctccttgtactcctttgtcccttagttgccttcagctcagtactccagaaaatagagagagctctgtggtccaagcaggaggttccaaaaagcactcaaaccatctcagaaaattggtgtttgatgatttttgtgattcttcaaatgtttctaataaagattcttcagaagatgatataagtagaagtgaaaatgaaaagaaatcagaatgtttttcttccccaaagacaggattttgggactgttgttccacaagctatgcccaaaacttagattttgaaagttcagaggggaacacgatagcaaattctgttggagaaatatcttcaaaattgagtgagaaatcaggcttatgtttatccaaaaggttgaattctattcgctcttttgaaatgaaccggacaagaacatccagtgaagcatcgatggatgctgcttaccttgacaaaatctctgagttggattcaatgatgtcagagtcagacaacagcaagagcccttgtaataacggttttaagtcactggatttggatgggttatcaaagtcatctcaaggcagtgaatttcttgaggaacctgataagttggaagaaaaaactgagctaaacctttccaaaggttctctaactaatgatcagttagaaaatggaagtgaatggaaacccacttctttttttctcctctctccatctgaccaagaaatgaatgaagatttttcactccattccagttcttgtccagtaactaatgaaatcaaacccccaagctgcttgtttcagacagagttttcccagggcattttgttaagcagttcacatcgactatttgaagatcaaagatttgggtcatctttgtttaagatgtcctcagagatgcacagtcttcataaccaccttcagtctccttggtctacttcctttgtgcctgaaaagaggaataaaaatgtgaatcaatcaacaaaaagaaaaatccagagcagcctttccagtgccagcccatcaaaagcaactaaaagttgactcattagaaaggtgtcatttgtggttttgtcctgagagaaatagaaaagttgttaaagttaccttttttcctcataaaagttctatacaaattggaattgataatctttagtcaagtatcaagtcaggatggtggattaacctgtacccagaatacttattgttcattttgaaaagactttgttcttttcatttttatttgggagtctttgtgaccagagaagttagggaggaggttatttttgtgttttggggttggttggttggttggttttgtttttggttttgtttttttactgaatttgatatgtatctcggttggatatacattgtttttttaaaaaatgttatttaactgttagatacagtggcctgttgataagccccacttgtcttcagaacttggatttcttaaataaaacttttagtgttgtctatacactgctcaataagacacttgagtttaagcttttcccagggtggaaattattttacctgtccctttttatttatgtttagtgatggcctagtttttctgcagggccatgatggagaaatagcactctagccttagtccaatattgatttactttctttttttaggttttatgtatatgtttgcattttttagcattgtgttttgtccagttttgtgaaaatgttctgctagtatgaaagaaaacattttctatatgaagacatttgttttatgttaggtagcttacattttctcctctgcgtgtgtgtgtatgtgtgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgttgagggggtgaagataggtaagaggtaagcacaatttttaatttaggctctgaaaaagtgtattgttctaaacgtatttggtatgcctatataggtctttaaaaatgggtatgtatgctgtttaatgtgcactgaacattttacattaatattgtactgttttacattaatactgcatgcttttctatgtgaattgaataaagaatgtcataagcactgtgttccttgatgtcgatgatgattctttgtctcgt

SEQ ID NO: 73832 - DNA, 1048 bp, Homo sapiens
taagcttctgttagattctggcagaatacagttccgatatcaattgtagctcccaaactgctctgcagtgttttttctggcacaatgaagcctttggccatcactgctactttgaaaatcaaagccttttggtctctaatggaatgtttataaaaatactccattttgaaatttactcaagaaaaggaggaagtatggtaaatgatattagaaatccctccggcttgccttggcatagcttcatttagtgttgtatactccaaatatctagaattagtgtgaatacaaaagtattaaaacccaaagataaataagctcatgtccttcttctatggaagtatagcatcagatacttatccctaattgttatttctctataataaggtaaattgccctttgccaaatttaatatagttatcttggataagctgaaaatttcctgacacatgtcaaaagtctcatctatttgcagtcttactaaggtgaagttttttggggtggagcagtatagaatgtcaagcctgtagcaaaaaaggctgtactgtacatatgtcagtctctgttgctttcctgggtgtcagtgaaataaagtaaacagtcaaatgtagtaaacaaaacatgtttactttagtaatacagtgactgtcataatacttaacatgtaaaaagaaggccaaggacctttagcttatcctgtggtgtcaaccctgtctcaatgtaaggcactagtgtatcttaaagtaagagaatgacttttattcaagaaatacacaacaggcaagtgccgtataccaggaattgttctaggaatctggcagtgaatataagacaaactacctgctctccttgagcttctattctaacgtgggagaaagaaagcaaataaattacatgaattgattaattgatcagttgcatggcttttagtatacatttctgtcagtctgccaaccagcacaggtcccttattagcatgggagaagggcctgatcactgaaagtattatagatttatagagtattgaaaggaaacttaaggaaattggggg

SEQ ID NO: 73833 - DNA, 1038 bp, Homo sapiens
aaaaagaacttaagcccagctttgaaggatggagatttcagggaggagaaaggcattctgagtgagagaaaacagcatgtgctgttaggagtactaagcggtcccttcagccccagtcctttttctccagtagtagtagccacatatcgtggtactactcagtaagcacactagctttcttctcaaatttaccagagcaaaagtccatgtaatttttacatctctctactgtgaccatcatccctctatttttatagtttggtagcatgactccactacatccaccactttctactctaagcagaagggcctgttctcagtctgaatatttagtggggaatgtgaagcgtgtcacatccccacatggtaagaaacatcaagaaagggaagaagctgaagggaacacttaagtactggatttctcatattcctaaattcccttgactttaattactactcctaaactgtgccaagctatgtggatatacttatccttggtagagttagaagttccttagtgacttttttaacttgaagagatgtgaagaattgacttgtaaagcatttgaaagttctgtgccctctctccatgtctctgttcagttgtgccactttttttttctctagccacttgaggcagggatcatgctatgtcaccaactattatgaggatttagtagagcaggtatttttgtcctcagctactaactcaccttaatagtatgggatatactattaggtcatttatatcaaacttggttataattgaattaatggcttttctttctataaatatgtatgcaggaatgttatgtgttctgtcattgtgtctttagtgagatctatgggtttgataatgtctccctgagtgcagttcattttactgtacagcaaccccaaggcttgtcattatggacaagtcttcagcaatgcctcagctccttttgggggaggataaaggctctagatactctgggcagtaagtaatattttctgttattaagatatgaaaagaagtgttctgaagaggaaggaata

SEQ ID NO: 73834 - DNA, 1023 bp, Homo sapiens
tgtggtttttaaaaatctattatggttgtttttaaaataagtaccttcaaaagcataaatagccatattatcttgactcatcatcagatgatttgtgaggaaaggacagaatctctggatgagcatttatatgcaataagaagactttttcttatttaaatatcattaactgccaagaaatatcaggtggttccatgtgtgactataattagagactgttgtgcttctgtataagattgcatcttcttctagaagaataataccaatttaaaggatgtgtttctgtttcgtcctctttgtggtttgccataggttttttaagcttatatcagcgacttcccctgtgtacctaaaaacaaacacataaccattttcgcaccaatgaaaggaaaagttttgaccttatcttttcttttgctaccactctcttatttttaagattgtagatagataaagacttggtgactaattccaggacagcaataagcagctgcttcagagtacctcatgcaaaagaatgttgtgatttatgaaactggttcatttttttcagtttttctttgaacgagatacagcatggtgaaaaaggcaaacctctaggatttttcggcctagaaagggagataagatccatgccatcagcactagatgttacaggcaactcctacaacaccatcttgacccaagtgatcagcctttagcttgagttcaagtttatccacagtggagtcctcttgtgctgaaaggagatggctttgtagtactcagttctacaatcacatattcaactatttgcatttccttaaaatactattcctgtgtgaaattactaaatcttatctctcaaaattattaatgagctccatatggtattttaaaggagttcccctgtatattggctctcaggtcctcaggttaagtagcagagaaatacttgcaacttagatgtaagccatcttccacatataaaataaatgttgtttgggctcagaaaaggccagggtgaggagaagagagagccta

SEQ ID NO: 73835 - DNA, 1039 bp, Homo sapiens
ttggcggatgtgtggggtttaataattaggcgaaaaactctccatccttcaccccatccaatccccgaaaacaatttggggatttaaaaaatcgcctttccgtatcttcctcttctgtctccactattccgctttcctttagattttccaagatcctcgatacttgtagtaaactaccttcctacacattcgcaggaatcttgcagctccctaatcagtgaattttctttctttctttctttctttcttttttttttttttttttttaatgaaaggaaaacgccttggagatcgcgcgtttcgaaagcgcgttttcgttttctctcctgggcgggttatggccctaccggggcgccgtagccggcccgcgcgtgcccagtcttggcgaagagtagcggtaggtcggcgggacttccgtgttggcgggattctgaacgctgccatggctcagaccgtgcagaatgttacattgtcgctcactctgcccatcacgtgccacatttgcttggggaaggtaatgggtgattgtgggcacagctacaaaacggggttggataagtcgctcgccggggccgagggccgtctcgtgcgggggcggggaaggggcgtgaggcgcggagatgggagaaaacgctaacccgcgttcttgatgggaggccgcgtcctgggagatgggggtagcgcaccgtgattaatggattcatctgggcgcctttcggaggagggtgacagcggcccgtggtctgccgggagggcggcgagacggccctgccaccgcccgcggcctcacactggcaagacaccggcctcgaaggaggccccatcagaaacgcatcgcagggatatttaacttccctctgcagcctcgcgtggcgtgtagtgaagcccattaaaacacatttcctgggagcctcacctcgggcttcttagtcctctgtaactagtgttcatcctctggggcctacggtgctgtgtattgagtcttttccatttccaagaccttttgcctttatcctggccttgaggatgacctttgctc

SEQ ID NO: 73836 - DNA, 1034 bp, Homo sapiens
aaggaaggaaggaaggaaggaaggaaggaagagagagagagagaaagaaagaaagaaagaataaaagaaagaaagaaaggaaaagaaggaaaggaaagaaaaagaaagaaaaaggaggaaaaagaaaacggaaaactgttgggcagagcaaggtgaacccgactgcaaatttccctgacatagacttcaccattgtctggagggtttcattgctgatactcggagctgtcgccatgtgttagcatgcccagcagataaagttagcaattggatttgcatcttaaactgcgtgttcccatcgtggcagcagagcagcctgcttaggcttctcgagtaatctgggccctctcttgggtaagcatagataagaggctgaacagtgagcactctgcccatttaacctactggaaaagcacatttacagattaagactgcaacaaaccttttgttgtcccaaaaagataaaaccagacgtgttagaggaataaaaatgtgatccatgttctgaatgctatagattgggtgctatgtctgccatataagattagactttgcaggcagatatatctagttttagcctcatagcactttttgagaggcccctcaacaagatcatcattttacagtacaattaatgaactccttaagcagattgcatcagagttgacagcaaaactgcccctcctatcctttcacagtgagacatacacagttggggcagggctaggagaaaataacatttaggttttgatttaggcacattattttctaaatttgagttgtgcatgtcatgtgtgtatttagttttggccaattttctttttcttgctggttttttctttttgtaaccttaaagaaaatttcacagggtacagtgtgtttctttactatatagagtgcttggttccattttagaaaattgctatggagaatccactaatgctataaattcatattaaaatatatttgtacatccacagacccagcaatcccactcctagctctatactctgtagaaatgaaaatacatgagc

SEQ ID NO: 73837 - DNA, 1499 bp, Homo sapiens
cgtgcttgctaggcattatgaaggtggtgggggtgggaaggaagtaggtgggattgtagaagggcgacaagagggatccttatggtgatggaaacattctgtatcttgactgtatcactgtcagtattttggatgtgatatcgtactacagttttgcatgacaacaccattgggggatatttggaaaaggacacatgggatctctctgtgttatttcttacatctttgtgaatttaaaatgtctcaaaaagtttaatttggaaaagagaaaaaagtaatcaaaggcagaataacagctaactagcaacatattggacatgcagaaatgccttggagggatgtgtgctccctgttaagaatgaacttgggaaagcaaggattggaggtatagaaaaggaataaattgagtttgctcacctgagagtttctggaggcactgcaaactcatttctcccaatggtttcactgcaacctgtgccagtaagtaccacatgcatgttgcttcttttattctttcaccagtattgctaactgaaagagactctagactgagaaatgacagatctcatctacctcaaaaaggtggatgacaatgaaaacaactaatgtttgctttgctctctctgcctttaacatagatcaggagggttgaaatcatccgaaatgggaggagacagaacaaactcataactgtaaattaaattctctgaaggaaagagacagtgttatgggagtgcaaggcaaatgaacctgacctaggatgatgtgagaaaagccttctcataagttcagttgagatctgaaaactgaacaagagtttactaggggggagcatattcttgatacaatgaacagtttgtgcaaaaatatagggggaccaaatatggtgcatttgaagagctgaaaggccagtgtggctgcaatgcaaagacataaaatttgagaattattgatatggaaatctaaatataactgataggtaaggattggactctctagagatcaaatatagaatgagcagctctccatttaatctaggtaatataggctaattctgcaaagaagaagtagaaggggcagccaaagaggtaggaaaaaaacaggaaagggagttaaagaggccaaagtaaaaaaataaaatggctttaggaatgagggaatgataaacaatgtcaaggattgcaaagtaagataaatgaaatgcaaaatataccttggatttttggataaggaagccgtcggtaaccctggaaggtggttgttttgttttgttttgcctgcttgctttatgatgatgatgatgatgattattattatactttaagttctagggtacatgtgcacaatgtgcaggtttgttacatatgtatacacgttccatgttggtgtgctgcacccgttaacttgtcatttacattaggtatatctcctaatgctatccctccccctttcccccaccccacgacaggccccagtgtgtgatgttcccccccgcctgt

SEQ ID NO: 73838 - DNA, 1020 bp, Homo sapiens
gcaaactttttttccccttgagtatgcattgcatttgtcatgaagagtaaaaagaatgtaataaacacatcagtcataatgtaaattaactgttttgatccacattggttggatacagcatggttaattctaggcttggttaaaaatacataatttggaaagtcttctaatattttaaagacctagtagtttacaaggcctttttttgttgttgttgttagacttttggttcacatttacaaactagccacagggtgttcataaatatttccccaaattagttgagtatttttaattgtaaacaaagaattttctgcccctactacactggtttactgctagggtaaagaccattgtctgaagacactaaacttggtgttaacagtgttgattgtttaatggatatggactacatgccactacctgcaactttgtcatcctggagtttttgtttggtttggtttgatttttcactttttgcttttaaaattaaaaacaaagcaaaacaaaattgaagataccattgagaatcagaattcaagatgacttgattctcactaagatcactgcgcttttttaaaattgctttgagatctagtcagttacatatttaaaatccccgtgttgattagagataaggttttcattattttattttcctaaataggattctcatggagctattgtagataactgtacagaatcacttttgtgtaattgaatgaagcagtttcctctgcatgattgcataatgaaagccttttatatatctatatttttcaatacttagattttacactattaagctgctctagtcatgctatatttgtttttttaatagagtttataaatatttatgctcaaaatacagatcaactgaatatttttggtcttgtttacaagataaatcatactttaaaatgatacaggcccctcaagtgtcttaggaaaaagtcattggtgctataaaacctttcagtatcatttttgaacccattgttcagactttgctaggtttta

SEQ ID NO: 73839 - DNA, 10067 bp, Homo sapiens
aatattggtttcttgaacttttctaatataaaacaatagttttatcaaaatgaaagtaattatggaatatgtttcttataacatcagaagttcttagttttcctgagtaaatttacatctttacaaagcaaaaactcagttctttcaaaaatttacacagcctaattctcaagtttgtaatggagcaatgttaataaaaagtttgtaaatcattttgtaattaaagttgaaactttagaaagttgtagcctcatcttatagatttgaggagctgtgtgctgaatatagagatgtgtaaagttagatcatcagaaatttttgtcagtaacttatttttgaaaatgtcagtaactcttttgctttttaggtgaattttttttagctgaatgtaaggatgagttttatgagtaggtattttgcattaaacagttggaattccttatagaatatgatacatttttatgtaacagtgatagcttcaaaaaattgcaaattgtcctggaactaaaatacatataagtactttttaaaaaaattctagttgtatgacattgtgacaaaaattctctgagcagcatttgaacaggcatgaaatcttttaaatttatcataaatttatatgtgcaggtttaaaatttatacctggggattttaataccacacaacttatgtcaaatatcattgaatatgtaattgtttctacatttcacattatgctgtactttgagattgtattataaatcttgtgtgagtataagttatttggcaatatgttgctaacactgatttaccttagttcatgttactctaatttgaatgcagtttccaaaccagccacttaatatagcaagtacttagacatgactattttttaagttcacgttttatattcagttataaaagtttggtaggaaaaactgtttttcaatagaagagttcagaggggttttttttcctttcattgagacacttatattttgttttagttttataataaacattttatggtagttggtcatttgatgtaatttgaaaataatatactttacacatgcaaaattattattaaagattaataattatataccatttgtaaatgaacagtaattgaaataaaatatatttagcatattgatcctaatttagacattgattcagacattaaaactaggatcttgaagtaccttgggattgtcatcttaaacagcagttgtcattgtgttataaacatgtagacatatttcttttagtcaaatattggccagtagtgaaatagctatattttattatgagaaattattcttgttttctttttaaaggaatttgcaattactagtctgattgtaggagtaaataaccataaaaagtaaagtgtaaattataataatagtaaattgaatagtaaataatcaaaaagcaaatgggcagatagccatcttcagttgtctttagctattttaattttaatgttaggcactatgacatttatttttttcttcagaaatttttaatgtcttatattccaatatttttaatcattttaggctgcagttcatggagctcgtttcaaagggcaagatctaaaactggcatggaataaaccagtaactaatatttcagctgttgaaacagaagaagttgagcctgatgaagaagaagtatgttattttttttccacttatttttacccttaatcgttcatagcttttatataaaatgtgatttttatggccgtgattttaacataaaacttttattcctgacccatagtccaggcaggggatatcagataaatgcaaacaactttaaattttctggataatgagaagaaatgtggattgctaattcaaaaagaatatatgaaaatcatatatatatactcaatttttatttacccttagagacaatgattattcattagatttttatccacaggaaatcttgtaatattttaagttttaggataatctattctcagttgctttattaacatttcagctttcctttattttaattcatttatcattttagtcattagaatgaatgcctgttatatggtagatactgtcataggcacaaaaatgaataagacacggtccctatctatcatcaaggagcttataatctgaaaaggggggtggtggcagacacataagaaactagttacaataaaaggcagactgataacgctgaataaagatttgaacaacatgctctggaaactcagaggaaggagtgattgtttccatcccaaaaattttaaaggaggtattgatagtggaactgggccctaagcagtaaaacagcttcataagctagaactggagctggtaatataattgagaggtattttagatggagggataagcatcaggaaaaatgaaagtgtgcatttttctttgagtaacagcagttagtctgatggctaagaggtacgggccagtgaagtgttagaggcctttgaaaccaaaaacttaaaagtaagcaactcttacttaatcacaaaataaactttaggaaaaagtttaagttaataaataaaggtaaggtgggaaaactaaataattccatgttttaccttcataatggcacttcattttgtttgaagagcatttcaaggctgttatacatatccatagtcaaatgcaagaataaaaatgtatattttgaaactcatatacatgatttgtcattttatattttagattatacctttgtccttccatgagtttgaattgaatggggagaaaagcaggagagctcctggtattaggtattttgaaaagtttgaaatagcagtctgagaagtgtttatgaagggaatggggaaaagaaaggaatgcaataatagaaaatgtttgttgcatacagcagaaaataaatataaatataaatcttggtagaattttatacaagtcattggttgattttagtattcaaggttaggagggtaaattagagaaaacttactgttttcttttttaaaaagtttgaccaatattttaaaggtacagaagatggcgtaatttgctaaagagaggcaggaaaaaatggcatgtacaaaggctttatttgatatttgtttagtgtgtttcatgcaagcaatagaatagatcatatagagaaaccattgagtggttaaatgttgcttttctttgttttgtgaatgttctagctataaaaataccttttgtattcaactctgttgagagagatgagtatttaaaagtgtcaccttttttttcttttcttttttttttttttgggtaaattcctaaatacattttaacctaaagtttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttggtaagtgttccagtctgatattttaagtgtgtacttcctatacttgtataaaaatctttgatgtttgcaacaatactgtgatttttttaagtggatttcttttgcaagtgaacatgatcattgaaagttgatatggcagtttccaggaaataaatgcattctttgtagaatgggggtgggagattacatatttatattttcaaattcatcattttgattgcaagtgtttctgcctctcttgagattatagtgataatattaaaaaatcacatttaaaaaattactttcttccatattggggtcctcacaatcaaaagctgttgttccaccaccaccatagtcttctgccagtggagtaacttaaggatgctgttctttttcttcttccccatacacccctaattggggttgaagttgtgtgtattttcttgatggtaacactatttcatagaaatgctttgccttgcaattcgtgtctacgtttatatttaaaatttcaaaatcagatttcagttgtcaaaatagtgactttgctcaaaaagtcactatttttacttatatatttaaatcaaagatctatttttatgtagtctcttgtatgttgactatgtgctattctgattcattaggtaagtttgttttcttttctttttagtagtcgtgaaaggtgccaaattggcagaggctcacgtttcttctctttacaccaaacaggtattacaaagaaagtaaatctttcaaaggccagttaaatctccatgctgatttttggctttataatttgattagtatgttttagcctgatatttcaaaaattataaaattcccttacaatgtaactgaaaatacatattctgtttatttcagtccatgaatagctaatcagttttcctagaacttaaaatgttttaagccatgttgctttgaatgaatcagaagacaaatatatttcagcgtgatcccaaagaatggagattaaatcttaccaacattaattaggtttacaattatattattcatagtattaatattattttaattataaatattacttagtattaagttgctactgaattttttacttgtttataaatactagcactctacatgtactttcatatgttttcatttaaaacttaggaaggagttgttcatttccattttatagataaggaaacttaggctaatagagatggaatgatttgcccagtcatagctagtgggtgaaaatagatttgaatgcaagcattctgatttcagtgccaattttttttttttttaactctacgttgatgctgctgctttcctaattattgatggagtggaacatgagattgtgtttatagtaaatatggtagttcttgcctcaaagatactgcacaaaattagcagactacttggtcattcgccagttcatacttataccctcccttttaatacagcactttgttcatatctctgttacagtacttacattgtaatataatttatctggtttatgtctgtcttccccactagattacaagctcctctaggaaggtggaccatgtcttattcatcattttatctttagtgcttatcacaaagccaggcttatagtgggcactcaaatgtttgttggatgaattaatgaatgaatgaatgcatatttaaatatccaatcatagagtgacaaatacctcccttgttaattcttatcaattttccaaaaatctcttgaagatctcctcagtcactgggagcattttgctaagcaattgatacagtttgagtttgtcacttgtggggttacaagtactgatggaggtatacacatatgtaggcttagtggaatttccacaacatttagtaaggcattaatattttggactaataaatgttgtctgtttcagaggtaaaatacacttttggtttctgtcagtgtatatgattagaaatgctaagagccaccagtctagtccatcccactaatttttatatccaaaggtgatctagtttagaatactagacaaggtttatatgatatttagtttttggtcccaattctgcaactaactctgtggccttagacaagtctcttgccttatccagggctgtttccttgtctgtaaaataaagagttggactagatgatctctaaggtcccttttacatctatagtttccttggtactatattagtgtttgagacaaaacaatttaatatatctaagccagttctccctgttatcgttgttgttttctatcattttatcattggaaacaacttggatttggttatggtaatttatatgatgcctcttggtacagttttgtgtatagtgttcctacatgcttgcatttgccagtacaaattacattcagcctataaaatagagatgaacttctgtattcaccagcacttcctttttccaattgtaacttttcattttccttctaaattcagagttttaaagtagaagtacttgctagtaatgcagatagagtcagttctctcaccaatatggatttaaattgtcctttccatctcagtttactcttttttaaaaaaaaaacaaaccaatatgctacctgaaactagaaacacatttttaattctgcagctctcctaacagattattttgctttagtacagagctgggctgcaggctgagttgggagttggtaaaggattgaggacagcaatgtaggtcgcctcttcctacaggaaaaaattgaggaacgttgtgtattactggttaaaagattgattaggattatttcaagggatggttgagttgtcgttttacttatttcacccaatattttgtgtctctacttaagcagtgttgttttaaatgttactggataattgtaacataatcaaattaaattttatatttaactgatacccaagcatttgatgaaaacatgttgcaggaatgggagagtattccatagcttttgttttattgtgatttgattaaatgtgacaactaatagtttaaagacaggacttcactgttttagctgatttcctgtagaaagtgtggctaagtttaattgaaagaaatgtcttcttactagaactgattttgggggactttatccactcttacttggaacactaactgttggcttataagggttcaaaaaggaagcaacagttgcttatttggcatgttgaaatatcactggctattttagagtatgaagcaaactttatcaatatgttttcttttccctccttacacacaatgtagactgatagaaaattagttttagttcttctagaatttatataaattttgtaagctccacccaacacacacacacacacacacacacacacacacacacacacctgccccacttacaaaagtctatattagccttttaaaacaaaaatttcctgcgtgaaattctggcttagttaactttttggtctttctctcggggcttttcttgttcttataaaatactgtaaattacaaatggaaatttaatgcagaattaaatttctagtgtacaatatttgtaagacaagaagaaaatttccttttcccagatctcaggaactaccttgttcctgttaacttcttgaactggctagttgctcaaaggtatgtatacaggcctttagggaagagcagtttttaaaattttcctttctgatcattatatacctgtcagatgacaatagataatcttccaaagttgctacttaaaaatcctaggaaagaaactttggtgaacatgactgccattcccattaattgctaatgaaaaacatcaaacttgcttagtagaaaaacacctaatttggtataactttcttgcagtttatccatattatgtgcttgttacttaatgtaattaaaagcattttaaaattctacttttttcgtatccactttttatacttgctacttcctaaatcctccctcactgtttatttcatccatctactcatttcccatcatccaaagttagcctctccttgtataccaggcactgtctgatttccatgtattccttttatttttactgtgggcctttgtgcttagtatacttttacttcatataatgtgattaacaaatgaagtgattatcatatggagtttaaggaaattagatgtatcttgcaattactttgaaatctttgggaaaccttaagaagattgtatctgttttcatttttatttacaacatcttggaatttgttcatgatttcctaaaatttctttgcctacccacatctctgtgaaaattttccatatcagttaagtagttttcgcaatgaaaattttagaccatagatatgttgtatgctgtgatcttttgcagcctaatgtttgaagggagtatgatgcagagaggttttggtaaaatcattttagcccaaagctttgtgtaattttcctgcaactttgattttgatttctttctcaaatagacttttttaatgtttagaaaagttggaggtcaatttatgatgtgattcaagttttagatttatttgctattttcaaagttttttttaatagtcttctctttttccagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaaaccaacaaagaaaataattttcttccaagtgacaaatgatgatctgtggattataaatattttaaaaattatatgtcttaacataattttttcacatttttttgactttcaatcaagacatcgaagacgacctttaaagcaagaggaaatagtgttgtgtgcctaacattggtaaagactagtttttaaccattttaagaagtgtatgtccaaattatttataagcagtatgacttaatatggcttagaattacttataaagaatctgattaaatctcatcctaaatatgtagccacaatatcttttttataatgggactataagaaatgtttgcacttagtttctgagtattccttcatagattctcaggaggcatttaaaaagttggaagctatacttggtagtaactatattagaaaagtccaattgacactga

SEQ ID NO: 73840 - DNA, 1622 bp, Homo sapiens
caaagttcacatttaaattattagtcttaagtatgagcacaggtttagttgaagtttagcttcttttctctcaacctatgatttgaacacatgatggatgtcagaggaaaaaaaatttacattatttaatatatgtgatgttaaaggaccattaactattacaaattgtgattaacaaaaatgctgtatcttccagtaccagtagtaatagtaataaaaattataactaaaaacctatagagcacttactttgtggcaggtatgccctctgagtgccttacaataattcattatgaattatttggataaccctgtgaggtagatacctttatttacgcccattttagaggtgaagaaaatgatgcatgatgaggttaagtaacttgtttacacagctaataactggcagagctagaatcttagtggctctaggacattctctttactgtgctctacagaacatttctatgatatgtgtggagctaatgagattacagttataatttttgggggggataattaggaaggtattgataatgatatataaaggactagaattttgtgggataaaggttgctgtttgtagaaaaatcctcccacacatgagggaaaaaaatccaacaaaccaaaaacaggaataatataatgtgtttagcttttaaatgttctaaacaactataaagtacagtagagtgtgtagtaagcaaaaccatggtcagttagggtgttaaacttttgaatcaagagacctggaatctcttcccattaattaacaattaactttggggaagttacttaaattttctttttctttctttccccatttattgagaatgataccaaaaactcacaaattctgaggattcagtatgttgcttaagaaagagtttatcttgggattggtttagtgagtataagaggaaagttagttagcaagaacgctcaggctttgaccattatttccttcatttaaagcatagttcaattgagtataagttttactaattctgggaagtgtgaattgtatgtaagattggaagacaggaccaccttttatcttatcaagtactaaaataaattactcaccatacttttctgttaaccattatgaattgttatgtattctgggttatatttattagtattttaatgttttttaataccattaggatttttggatatttcaaaatatttatttggaggaaatactttttttttaatttaaagcaatatggtgaaattgaagattgtcagattgatgattcctcacttcatgcagtaattacattcaagacaagagcagaagctgaagcagtaagttttaaaaataatttatcaattcagatttaaatgatttataagtattacttttaagttttaatataaatgaattttttaacttactaaataatatgctttgacaataggtagaacacctgaagtggaattcatgccctcaaagaatgtcctaatgcagttataagcaattctgtgtgtaacataatacaattaaaatacatatttagtcaccaagtggaatgtcaaattgtgctgtcgtgagataccagggattctcctttctttctttttcatagtagatagggccactccactacccatta

SEQ ID NO: 73841 - DNA, 1026 bp, Homo sapiens
tattgtgaatgtaggtattatctgtttattatcctgacttctgaagtaacatttaacactgcatacttggaaatcaggagttgctgatctttttgtgatatatcctgatgtcttagagagcaagaacttagaaaaaggcacatttagtaattccaagacctcagtgttatttttttgtttcagtttactagccacctacatttactttcactaaactaaaaccccaatttaaattatgtgatccttttatagggcatttgaatacattgtcaaattgcattaaagttttattcatctgccagagtgtaatgcttggcttgtgttagtaatcacagcattgtttaacctgtgtgtctaatctcttctaggctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcggtactttcttactgctcaacaaaacaaatgctgataatcatcattggggatagtagacataattaaagaggaagttatgaaaaggacataagtaatttcaactcgttaatctgaacaaagagtttaatctttaatttttttgttaatttaaaaacaaactgtaggatttgtataattatctagaagagacattactattcttacacttagtaggccatgaaatactgtgaaatgaacaatataaactttgctgtttcagagagggaagtcttgtagtttagtttgatttgatatttacttttaaagaaaaagttaacatattgcatgggccatccagatttttaaaataaggtttgtgtttgttaaaaatgtattcttgatctagctgacccagtattgaaacaagataaaattttgacctatgatcttgaagttgcctccgtcagtgtcaggatgt

SEQ ID NO: 73842 - DNA, 1999 bp, Homo sapiens
cagtgaaagtagcaacaagttaggaagctgttgcagttattgtggaggtgtggagtattttggcttggattagagtgattatactggagatagaaatatatggattaaatgggactgcgtaaaagttactttaaaaaggtttgtatcaatacaggatagtaattactgtcacctaaaatattaattactattttttagatgcagaaggaattacttgacacagaactggatttatataagaagatgcaggctggagaagaagtcactgaacttaggagaaagtatacagaattacagctggaagtatgtttaatcacaactacacagtaggcttaaaagaagcaaatgtagttgtagtggtcaatttaaaaatatattcccttcccttcattctcattagtaattgttggtaatccctggcatacatattgagatgttaatataggaaagagggaagaggtcaacaaatttttcagaggtactagataaaatcttatttaatgaggagtggcagtaattctgcctatatccccaagttcctccatttctaatgaattttatttctttctatttttggtctgtcctccctggaatagaaaacttataataaagtcttttcaggtattcttatggagatattctttgcatataaattgagttgctgtatgcgagttttagttggagaactatattgagaactattttgaagaatatgtttacttgagttttgcctatagatggtgctgtggatgtttagaaaagagaaataaacttctttcttgtaatttaattagatggttatttatataagaaacaactcctagtgaaattgattcctgttatatgatatgagagagaatttttgaatagcaaaaagaggttcaaagattggaactgtattttgaaatagacattaacgtcattaatatagttggcacatgtctgtattgtggtttgatacaggaatttaagatttttatactttagattatttagctttagctgagattaatgcttttttcttaacttgttggcaacttgatcattttttggacacggtagaaatctgttttgaatactgccatccaggtattaaagacttaacatttagtagctaccatacttgccttaaagctctgtcttctctgaaagtcataggaagccataggatgttgtcctaaatgttcatacctttgcattctctggaaacttgatgtggttgcatgtgtgtcctgcccagtattttttttggggaaaaaaaaaagtttgaaaaatatttcttttatgttaatagagaaattgtgtttttcccattgtagcgattttatgccagtgttggtggaatctttgaaacaaaatatcattttcaaaattctggcccataatttaaataaataatagcattaacaaaattccttattattctgtgttttgcttttttattataacatagctaaacactgaatgacattttctgtttttcctttatcacggcttacgtttagttttcagtgaatattagttttatgcagtaatgcagtacttcccagagtgtgttcattcagcacagtcattccattagttgttaatagaaaactggtgaaaaaaggttcttaggctaaataatacaaccttagaacaggttatattggatatgcgtttttactgtggggtttcttagaggcttttaatttctgaatctctaaaaatacatattaagtattcagtgttactcaagtttatttgtccaaggaccctccttttcaaggagcattttgaggcattaatattcctcagagcatacttccgtatatactgttctattactaatattaatccttgagcttcaaaatttattattacgtgttattttgttatattgacaaatgaagaattatatatatgataatccaaaatgttttgatatatgtgtaagttgtgaattgattacgtcaagctaacatgtccatcaccccacatacttgtgatttttttgatg

SEQ ID NO: 73843 - DNA, 1050 bp, Homo sapiens
ttctgggctggagatgacattgatagtgggaatacttagaggcgtaacatcaacaaatggattagaaagtaaaattgttaatatatttttcaaattgataatttttcagtgatagaattgagtttcttctggttgtgtgcttcaaacttatgttctgagagacccaaatagtaacagttcttcacaaatttaaccaagagtaaaacttgagttgagatagttagcatcaccaaatctgctattctgcgatctttagataattcatggttgttagccttctcacgaatgcataaactaaaaaaagtagtaatatttatttttaaattactttgcagtgtttgttttgttaatgataataggagtaattagctttatttttctctttttaaaaatttggcagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcaggtatttaatttcattgttgttcatattattacttattaacaagcattagacactacatttttaagattcagtttttcttgtaggtaatatcttctgttcaaaatctgaccattgtatgtaccattctccccctgccataaataaaaaagtacaaacaagtaaactctactaatcttttaaattctgttatagttggaaagtcactaattagaaaaatagtcatgggtaaccttgaaaaggccgcttgaggacaaagtgatataggtacttgactgcttgactagttttatataatagtagttggtgatatagagggttaataatagacaagtatgaataacattctgacaacaccgtacacggtggattgactgaaaaggggaaaattcaggttgatcaggtagatcaatctacatagatggtaataagtgattaagaaaaaaacagggttatacaatgtttatacttggtgtgtctgtatg

SEQ ID NO: 73844 - DNA, 4000 bp, Homo sapiens
taaaccatataaagattggaaataaaactgtttacttgcagatgacatggttgtagatatagaaaattcaaaataattcacacagttgggattaagtaagtgtagtaagatgtatagaagtaaatatgtaaaaattatagcacatatagaaatgcatttggaatatagaaatgtggttgtttggagaagtcactgtctctgttcttaggaattggagtatcttcttttctgttgggctcgttacttccctccactaatttcagttttaatagattttcttcttttgaaaatacatgtgtctcttactatccaaactgtctaatctccagaaccagatagattcaaatagtgaacaatatagttcattgtttataagtcacatttttacattttaacacctctgacgttgggctgtgtcttataattgttagacacaggttatgattggcagcctttttttctttagtaggggtacataaatgatagtttgtcttacagtcactgagttgtagccttagtgagtcacattcgtggatgttctagttttacagaaggatgttcctggataaaaaaggaaatgggaatacttctaggaataaaggagtcttatcattgtcagatacttttattcactttgaaccagcactccttagtctgatactacatgtcaaaaatgatttgaaaaggagtattctcactgaaactggagaaatacttggttaaataaattatatgggtttgttcttggcttctcactgcttttattatgaagataatataaattaaaaactggaaaattgggttacgatattcattgtttcacacttaaataattaggagttttttcttttggccacaacttttcaacttatggaatcctcatgaagaaaacagtttgtgaaacttaattaggctctgttttcagtttatcctgtgtttctctactaatatattgtcttgtctttgtatagtcatgtggtttggcattttgtgctgtggttaggtagcatggaagaaatttttctctagaattacaaagaaaggtcactgaagtctgaccacaaacaaaatctttgtttaattggtcgagtatggtggctcacacctataatcccaacagtttggggcgccaaggcaggaagattgcttgagctcaggagtttgagaccagcctgggcaacatggcgagaaaccctgtctctacaaaaaatacaaaacattagccgggtgtggtggtgcgcggctgaggtcccagctacttgggaggctgaggatcacttgagcccatgaggtggaagtttcagtgagccaagatctgggccactatgctccagcctgggtgacaaagtgagaccctgtctcacaaatataataattgatcaaattttaatacacatcaaatattgttaagaacctttctttttaaatatcagctgtactgtatgaaactagtacaattataatattttaggtttttatttcgtttagaggctaacactttcttgaatacttagaatagcgatttgtgatgttccctaatcagatttcatgatgaaagattagaaagtagtcttcagattgctacttacctgttaaccagatgttaatgtttcagtggctaaaaaatagggccacttttctcatttatactcttaaacttgagtagttcttttaaccttatttaggtcatgaactcctttagaaacaatgacttgagaaaacaatgtttttccttagaaaaattgcagtgttcacacacatgctttcatgtttagttttatagcattcgtagatcaccctacagggattcctaggcttctttttaagaaccagtaaccagtcaccccgtggaacttaaactgtttttcttttgaaggataaaaaagatacccaatactttttttttttgagctgaccgttgtatagaaaaggttgtccactctgacctatagtcatttcagtctagtttagtgcagaaatgttttttgagtacttaccctgtgccctggcactgtttgtagcactgaaccaagttaaaaaacaagcaaaatctctgccctcttggaatgcatttttgggtttgtaaggactttagacaccatcatgttcatcttctttattttatagatgagcaaactgaggcccagaatggtacttaatcttacccgtggcctcataattagttggtggcaagacttaggtactggaagatgcgcagaagagaaaggcaagtctttatgttaatgcccttacattgtagacgggggaaaagacacattaattaatatattatcaggtcgtttttttttactaaatagctgacactaactaaaaatagctaatagcatttttacctaatagccaaagaaataaaatttcatataaggacctaggtagaaaagagaaatgatccaggctttgttagaggtcttgattgtgttaggctgaacctaagctgagtttaggggagtaaggtcagttcaagcagaaggagcattgctaccaaaggattggagaatgaatgcaatagggtatgtttcagtactggaagttgcaaatgattgtgttaaattgagggacagcaaccagtttcctcctgtgccatgctcttgagtgtggcttctgctttagtcactacaaatattagtaaatgtattcaacaactaatgctttctcagtgatgtagtaatagtaatgtttttctttttgacattttcatgtttttctttacttttttttctataggtatttggtgttcatttttttaaattttagagcttattatttatactctacctttcaaatcaccaaatatgatttcgttattataagtataaaatacatttagttcagtgtgttttgaagctgaagtttaacagtagtgctttaaagttgagtcttatagaaaataggatatcatgaacggctgatatatatttttaaaagttgaatttgtattggtaggtgttgtctacatctactggcctaacaaaaacagtgtataatccagctgctttgaaggctgcacagaaaaccttacttgtttccacctctgcagttgataataatgaagcacagaaaaaaaaacaggtaagtacaactggtatagtataaaaaatttttgcatataggaaagctttccttgtgtatgtgttttttcagtgcttattgcaaaataagactacaagggtgtttgttggctgccactgaacgtttattttccatagtatagcggtaaataaaaattttttctttgaaagaaaggttcctgtgattaatctttgaaacttgcatacatattttaagttttacatagaaaagccttgcatataatttttgttgacagacttctgcagttacaactatttctcttctcttgaataatattgtttatccttagtaatattctaatgatatttttgatccctgattctaggaggcattgaaacttcagcaggatgtaaggaaaaggaaacaagaaattttagaaaagcacattgaaacacagaaggtaaaatgttaaagttagatttggccaaattgcaaatgttataatttggagtgaacttaatcttatgctacctagtcataaaaagatttactataattggtaatggtaaaacaaatatttgtcagtgataatattggagatgaagagcatacatcagatggtgggtatactttatactttaactggtactatagttatcaacatgaaattaaggtgttcattcagttgtgttgctgcacagtagttttttcaacagataattaaatggaaccttttttctcagtattgatatgtacctttcttcactagcttaggatcctctagtcctgtgttttttagtatagcagttagtagccacatgtgactgtctatagccacatctgactgttgagcatttggaatgtgtctagtccaaattgagatgtgctataagtgtaaaatatacactagatctcaaaatgtagtacaaagaaaaaagtaaaacatcac

SEQ ID NO: 73845 - DNA, 1714 bp, Homo sapiens
aatacacaaatgtaacattttataccttccctatcaacaacacacagtaaaacctttagtgattattctttatcctgagaccccattttcgtgaggaggctagaagagaggaaagttaaaacgtaattgctgctggtaaatatgaagatattgcaagaggtatttagttattatgtgaatagatttgataaattatgtttgagtgcctctgcttactaaagaaattcatgaagaataaagggctacatctgtgtatactgtcctggttagttttttaaaacagacttaagaccgttcaaattatcttgctgaatcccttctaaattctaagaaggcaaactgcgtaaccagtggaatatttaatcttctttatcatatcagctttaaatatcagatttatgatacaggatgttattgttcttgtggtttttgcaatgtaaaaatatatcttggtctctgcatgatgatatattaacatctataccatggaacttttaaaaggaaaattgtgtggtataattaaaagaatattgcatgttatagagaaacttcacctgttgatttagcaggtgccattgtgtagatgctaagcaaatcttaatatgtttccttggatttttgaaatttgaatttgttgtgtaactttgctagttaaaagatttagagggatttggctgggcgcatggctcacgcttgtaatcccagcactttgggaggccgaggtaggcagatcacgaggtcaggagttcgagaccagcctggccaatacagtgaaaccctgtctcttctaaaaatacaaaaattagctgggcctcgtggcgggcgcctgtaatcccagctacttgggaggctggcaggagaatcacttgaaccagggaggtggaggttgcaatgagccgagatggcgccactgcaccccagcctgggtggcagagctagactctgtctcaaaaaaaaaaaaaagagtgggatttatcatagtttttttttcttaactgttattgactatttttaatttttattttttaattcagtggcctctcaggattattacctgcatttttttttcaggaaaatatgaaattaatttatttgagtgtattagctttgctgaactttgtagtaactaagctatttgtgtagcaaaaattcattactagctgtacatattttttactttgatgtttgttaaaatatttctctgcaagttttttaatctttgtttcttttaatccctttgtctatttcacttatatgtggaatcttaaaaagttgaactcatagaagcagagagtagaatggtggttaccagtggctgaggacaggggattgggaaatgttggtcaaaagatataaaacttcagttagatagaagaaataaattaaagatatctatagtacaacgtggtgactatagttaataacaatgtgttgcattcttgaaaattgccaagaaagcagctcaccacaaaaaaaagtgacgtaatacaaatgttaattagcttgacttagccattttacagtgtatatatttcaaacagcatgttgtacatgataaatacacagacagtcatcaacttacggtgacttgactaacagtttttcaatttgatgatgcatttattacttacaagttgaaaatgtattttcaacttaaatggtatttcagcttacaatggatatagccccatcataagttaagggacatctctat

SEQ ID NO: 73846 - DNA, 3231 bp, Homo sapiens
ctttagtccagcagcccattttgcctgttgtgaagcagtcagtcaaagagcggctgggtccagtaccttcaagtactattgaacctgcagaagcccagagtgcctcttcagaccttcctcaggtaaagcaaaggtcttacgattgtgcccgtaataggttctcagtaatttagtttcccttggtgatttgaattatagttaattgtatatattttacatagaaatatgatagtctttacatatttgaaccccacctataaggttgtttttttttttttaatttttaccattaccataacattttctcagtctctacttttcctatagtatttaaatcttaaattcctctctccagttaatatttatgagaaagatttctctctcactttgtggaggagatacatgtcagcaaaactgcccgaagagtgaagttgagtacattaaatcttattttttccatcatctttttacttaattagaattctgttccggagataattgtgtagtagactgaactaaactaaaagcttatggtaagggaaggcttaaaccatcaagttaagcatgcttgatattatactgttttaagtacttagactgctctctcataactttgcatcacttattcctgactctgggattcttttctccatatatcatttccttcccacttccttcaacacttgagtggcagtttcttgtttctacattctcagtctctgaaacttagctttcctttgtctcccgatgtttcagcatttgctgtgtaaaatagagttaggatgtagtgtcctacttagctagtggatgccaccttattaaagtagtcttcctagataattcctgaagagtaagatgctgaatttctgcaaggacatgcagaatgtctattggtaaattattagttaatttaaaaaattcccagtcctatcatcccaaattatcaccaaatacagtatatttggatataaaataaacatactttagaagaagttggcactatttttaagctcagtaagtgggcatatattttaatttttaaaatttgagattttctcctaatttattctgtgtcagtggcagggactttagcaaccacgtggctcagacctcttagtttacatcatttttcatgattgaataatattgcatactgtttatttttgttttcccacatattttctttctgtctcttttaagaaggaccaagtttttgtggttagtattggtatactcatagactctgtatatattagtagaatcagaatgttcaagatcccaacagacttttatatgtttggggaaacactgaatatgtccattttaatttttttagaatgtaactaagttatctgtgaaggacaggttgggttttgtatcaaagccatctgtttcagcaactgaaaaggtaagaagaatagcatgatgtgtttgtcttggcttcataaatgttttcaggtggcatcttaatttttaattttttttcatagttctaaactcttgcttcttaatagtatctgtatcttttcctaccttttggtttccatttgctgaaaaagaaaaatattttcctttttttacttttgcatcagcattttaatacttgcctcccactatatttccatgtactccattccttttctttgttttattctttttatttactttgttttctttagagatactgtgcattttgatttgacaactctggcagcctaatagaaagggccatgattaggaatttcacctgagtttgagccctggctcttcacttactaactgcatgacgttgggcagtgttcttaatttttctgaatctttttactcatcggtaaaatggtgatggtaatatttatcttgctcatggggttttctgaagatcaaataaaatcatttatttacaaatatttttgtaaactggaaaggatgatgtaaatgtaagtttttcacttattactaaacagtaatagaggtagcatagcaatacatatagtcatttctttttttttaaatgaaggggggtaaatatttattaaatcaagaccatttatggatatatcttatagttctgtgtagatgttattttttttttttgtttaggtatgagtaaatactttgtctttgattttatttgaggcatatgaaatcacagaatgtgagaattaaataatctttcttagttctatatgcttatcttaaagtcaaggcccaaacagtgttatgatttcatctgtatactgtgagtcactgagccagaactagaatttggggctcctatttttagtccatggctcttttcagtctgaagattgggaatcaatttcagagataatgcatcagtgagatagctgccctgctgtcttcactatattcttcagtatattattttctttatttacaatgttaaactttggcagttttaggtatttgaatctgagtttgtgtatcagactttgctcttgggcatctcagcattacttcgggcataatgtgcctaaaatgaattcattatttcctatataaattaatttatcctagcccttagctcagaaagtgataacaccattttctaagctgtgtgatccaaaagccttacaatcatttgcttgtgtttgtagaccacttctttttctgccaccttcagttccctagcctctgggtgcagtgtcttaactggcatcctggaattcccctcgtctagtttatactgtcaccatcttacactcagacttattttggcgttaattcattatagaaactttgagtttctcagctaaattactttccttgattcacagctcatcgataactcaataattctggttctattacttctgctctagtctttttacccaagggagtacttttctgctcgttttcctttggcctttcctgacttttattattttattttatttttttggtggtgatttttctggagtgcatttccccccccgccgccccaactaaattccagtcattatttaaagagtgaaagtctctctaacatctcccatgaaacctccagatttttctgttatccccacctcctccttggaatttctgtgctgcttagtctgtgctactaaatttagcagtatcaaatacttacttggattaggtttatcctcgttgaaaataagtatttcagaaaaaagaaacactggaagtgtttgaggtgatagattttgattattacataatgtatatatgtatcaaaacatcacactg

SEQ ID NO: 73847 - DNA, 1049 bp, Homo sapiens
cagatggatttttctgtaattttttattagagataaccccttgcaaagtaatttactgccttcttcagattctgtggatctttgccatgtcatttattgacaatagggattgtttctcatagttgctattaaaattgggaataaaaagagaaacactttgaatgcctatatgtaacatttatgcagtcgactttctctgctattatatagaggaactctttttatgctgtgaacaatccttggttactatttcttctggagtaaaagtagactgtggtctactaatccagataccaagaagtataaatacagaatcttacttggaaggaccagtatttcacttactggggaattttactctatgaagcaacagattcctttggaaattcactgttcttaatattttaaatcttaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaaggtaagagaggaatttgtgtaaaagtacgcgcatttcttagaaagctcttagcatagcgtttacgagtagaggcattggaatcaagtaggcctgagttcataccctggttctgcatttagcttctgttacctgtaaagacttgaaaaatttactcaacctttctaacctgttctctcataattgtgatgttaattgctagttgaaagaacagcatggtgtatgtgagacatatggaatagtccgtggcagataggagtactcagctatgtatattccagaaatttagactgtaggttcatcttagagattctctcttctttcccctctcccctttctccctcctttttgtcccaacccccatcggtgtgtaatgttagagtgtttatagaggtatattacaacagtatgggttttgattgttagaagatattgaaagttggactttaatttattccagtaaataagttat

SEQ ID NO: 73848 - DNA, 1053 bp, Homo sapiens
gttgagactgtcatcaaagaaaataaaatttaaaatcaaatttaaaacataaagttttaagataggatattttttagtaagctgacttttacagaatcagaataaaggttatatatgcaaattgactaaaagaggatattgagacttttcctgataggaatgttaagtagaggtggatcagaagtggaaagtaacaaatgatatggcagaacccttctcagttggcttccatgaaagatactaacagtgttcatttggaaacttcattgttggaagaaaatttaaatttcctttatcaaccagtaatttcagtttgggggaaaattgaacttaattggatatctattttgttaaactttattcccttgtatttggttagggtcaggatttataaatgtattgactaacttgaattttgtttgcagaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggtaagagccatgaaatggttttgttatctcttctttctgtttagggaacttaatgtaataagaaaactacctttataaataaatattttaaggctgggcatggtggttcacgcctgtaatcccagcactttgggaggccaaggcgggcggatcacctgaggtgaggaattcgagactagcctggccaacctggtgaaaccccatctctactaaaaatacaaaaattagctcggtgtggtggcaggcacctgtaatcccagctactcgggaggttgaggcaggagaattgcttgaatctgggaggctaaggttgcagcgagccgagattgcgccactgcactccagcctgggtgacaagagcaaaactctgtctcaaaaaaaaaaaaaaaaaattgttattctgaattgggaaaattggacatgaaatggaactctaccttttaggaaaaaatacaatttttagtgttt

SEQ ID NO: 73849 - DNA, 1905 bp, Homo sapiens
atgttttaaactttggagtcatttgggaataacaggttaaatgtactatgctcattacatgccatgtaagtaaatataaaatgttgaaagtaacagacttttacagctcttttacactgtattttagacttgaatcttttccttttttaaagcaagtatgctttcattacattcatattttatgagtctattccatatttaaaagcagctcacttcaatcataactctaacctttcacttctcaaagattattggattagtgtaaagttttgaatcttttagattgtgcatttgatttcaaaactatgaacttaaagcctcaaagtgattattttctcatttgtgcattgatatatatatatatatttgtggtgagggtgatggtagatgggaacaatgacttgggttttatctacaaagaagtgacctacagaatcacattttaatttggcatgtgagaattgattctttttcatagttaattgtgaaatgaatatgttgaaataagtttgaaaaaacccttagattactgtatttgaatgtacagtaattcccctttgtctgtgggtgatatgttccaagactcctcgtgtgtaaaaccacagagtaccaaaccctacatatactatgctttttcctatacagtcacacctgtgataaagtttcacttataaattagacacagtaagagctaaacaacaatgtctaataataaaatgaaataattataacaatatactataataaaagttatgtgaatggtccctgtctttctctgtcaaatatctttttgtatttacccttcttgggatgataggggatgataaaatgcctacatgatgagatcaagtgttggagcaggatggtgtgagattttatcacactactcagaactgcaggcagtttaaaacttaggaattgtttactatttctgtagttttccataattttggactgtggttgactagagataactgaaatcgtaaaaatgaaactggataagggggagctactatacatttatttctatttcttctaaaaaaaaaattatatatatatatatatatttagacaaaagccagaaattttcctgtatgaggaaggtatctatgataaatagaaaatattaacctatgcttatttttttcattttcttttgttttaaaacagaaaagcctcccaataaaagcagtatgaggatagtagtggactcagaatcaaggaaaagaaccattggttctggagagcctggagttcctacaaagaagacttggtttgataagtaaggtggccaggaaaattgaggagtataattgtgcattgattttcaggatcatttctgtattattatgacaatatggtttggtttcttccaaaaatgttactctgttctgtaagcaatccccaagtgtgagttttctaaaaattggcaagttagttgtctgatgttagaaaagcattttcttacagaaatggtgtggtagttcagggcataattttttcctcttatcatttaccctcctccaaaaaacccactctttaacttagacctgttgaatactagctatatacaggatagtcatgagcctctcatcattagaggaaggaggtatagatcagacctgtcaagagactttcatatgtaggcagttcctgctaggtaggagctagaaagggcttttgtgggggttggagaggctgtctaggcattgaatggtcaagaaagagcttcagataaaggggtaaggaatcagaatgttaagatatgtgtgaggtgattcatttataaataaatctgtgaagagagactaggatcacttttagagctttaacatctacttaataatggatagtttctagttgtttgtgattaattctgtgatttaatgcagagtaacctctcta

SEQ ID NO: 73850 - DNA, 1031 bp, Homo sapiens
ccccatccccactgagaatcactgaaaaagatgaatgaagccatggcagtagataagaaagttattttaggaaggctatgtaaagtgagatgagaaaacccaagtataactacttgacaaatgtcagcatcaaagtaaatggacagagaaaggagaactttatagaaaacttagaaatgaagcccaaaagctgcagacaaaagcaaggagtggggattcctaaaaacccagggaatataatacctaagatggaaaagaagatgatcaacagccgcaaattctcctgagaggtccagtaagaggactgggatgtattcataggcttaagcaacaggtgaggacatgagtgattttagcacgagcaagtaaagtgaagtaatgggagcaactgccagttttcagaggattagtgagtgggtgttaaggaagcaaagttagtaagtgtggacattgattaggaaagggctgtgggagtatggagagagatgttgttgctaaagggaaaactggttttacgagagtttcttttttttaaaatggagtaattagagctgtaatgtttgaatgttgatgggaggtatcagtgtcctgggaaaggttgaaaatggaggaaagcagcaggagtctagagcgttgatttgagtctctgtatgtatggcatatgtgggtagtcatatatcaaatatgacttgactgggatgattgggaaaatggtagtttcattaatagaaatgtttaagaaaaataaaagatagacttaatatgaaaataatttgaacgttctgcatagtgagttttgagatacctgtaggatttccagagagaacaaagaagttgaaaatttagaattgagtatatgctctcctcctgcaggagaccatagctgtggccatgagagatattgtgctgaaacagatcttcagttcttttggttagttaggtgtttagaaatatgtaaaaataggattttagacaaatcaattttgccatctataaaaaaggagtttttaagttacatttttctatgtgga

SEQ ID NO: 73851 - DNA, 1370 bp, Homo sapiens
cactctaacctttgcctcccctttaagtgattttcctgcctcagcctcctgagtaactgggatcacaagtgcctgccaccatgcccagctagtttttgtatttttagtagagatgggatttcaccgtattggccaggctggtcttgaacttctctgacctcaagtgatccgcccgccttggcttcccaaagtgctgggattataggcttgagcccccgtgactggctgggatggcgattttgtttgttccctgtatccttcgttcccccgttggagaaaatatactgtgtaattctgtatttgtggtagaggtgacactttattatacaattattacactgtccaagaaggaaaggaatttccttaaagaagcacattttcttgggtagcctttttttttttagtaatttgtatcatttgtaatcttgagagtaacgctttaattcctaaagataagtttattcctagtttgaaaaatcaaatagtgcttggtatttatttttgctgactcttcacctgttaaaatttgatattagtttgcgtatatttttaagcaaaggatatcatgtgttaagaaatgactcttaaaattttcttagaggagacagacttttggataaaatttctaaaaggtacaatttgggttgacatagtcacaagctagggcagcaaagtgccctacatctagagtgccctacatctagagtgctacactagagatgtaaatgtaaactaataagattcagagggagaaagttcacattaatttggaaaatacagtatttgctacagatcacatttgatatagggaaatgaaggattgtcagacataatggaaaatatttcctgggctaacaaaaaatatatctttttccctaaccacctcaattaagttttaaatcccattttctttccagtcttttcttgtcttacctagtcagaattaaaaaatcatgcttcgtcagttgtgaataaaagtcttagttagtaagtaacagtgcctaatggagtttggtaaatgtgtgattacttacatatactttgtgttttttcttttattcattggaagctagctatcagattctgagcatcttccttgaatgtttaaaggactttttgtaatgaaggtgtaaggaatgttttaattcagatttatatcctcttttagatcataggacaacatttaatgtggatacccattcctcttaaattctctttgaggaatttcaatagctattattaacaacaatagaaaaaagattttttttaacagcttgtatgtgagggatatatggattccttgtaattgaaaagtggccacttaagattttaactgttgtgtgatgtttacctatatcctgaacctgtct

SEQ ID NO: 73852 - DNA, 1849 bp, Homo sapiens
tgcaatgacacagtctctgctcagtgcaaccactgcctcccgggttctagcgattctcctgcctcagcctccctaatagctgggcttatgggcgccagccaccacgtccagctaatctttgtatttttagtagagatggggtttcaccatgttcgtcaggctggtctcgaactcctgacctcgggtgatccacctgcctcagcctcccaaagtgctgggattacaggcctgagccaccacgtccagccagattgtcacatttcaacatgagatttggagaggataaacatcctaactatatcagtatgttaaatatactatcactttacaagtatttatattactggagaagatcaggtagctcttgggaaatggttaattatacttttgtccaatattaaaaatattcatatttttaaatattttacttttgctaacttagagaaaatatatatttccagtgcttttgacatttgtttctaactattccttcctcatagaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggtaagtaaatctgtttgtttccctgtatttatctagccattcttagtctatttttaaaacttaatagattcttaaattaaaagtatctaaaggaatcccaaaaatgcctgatagaaattaatagcagtatacttccatttggaatacacctccactttgtagcctgtgccaagccagttactatggtttggagtgaccctgtgaattaagtatatcactggtaaaacccagctgcctgcaggccttcatagcttaaggcaaacctgctttggaatgtattaaaaggatattttaccctggatatctaattcagttgtaagggcttggtgtttgtagatattatagtttgataaatgagaagattatgttcggatgtgcaataacttgttttatttgtttgctttcagatgatatttcttattctttggttttgacaggaccaccacctccacttcctcctttgcagccatctggcatggatgctcctccaaactctgcaaccagttctgttcctactgtagtaacaactggcattcatcaccagcctcctcctgctccaccctctctttttactgcaggtgcagttttggccctttttatattcgtaatgtaacacagttttagatgaagaattttaaaatgtctagagagaattgctctgtgaggactacttttctcactaaaattatgtagccgtggtgaatgaacattaaataagccctcagttttgaatgttttcaaaaaaacattttctttttaataacttttttaaataaagttattttctttttgatacatatagagcatgttatatgttaatatgttatattgtttactttttctcttatcaatattaaaaaattaccaagtggagttttataattgttttttaattacagtttttgtattaccagatacatatgacacagatggctacaatcctgaagccccaagcataacaaacacttccagacctatgtatagacacagagtgcatgcacaaaggcccaacttgataggactaacatcaggggatatggatttgccacccagaggtactataattaatctttccttcctgtcattttcataatataaacagtgggaaa

SEQ ID NO: 73853 - DNA, 1071 bp, Homo sapiens
ttttaatacagtgtagttttatatgtcatttatctttcgttgcagaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatggtaagtctttcagctgtttgataaagtatttaattaatatttccagctgcctaaattctgtgtttatgttgtacatagttattcaaagacttacctctgaaaagtgggaaattagccttagtcactttttgaattcctcaatatgattgaaacatttattagttgccactaatttgattatcaatttaaaggtagtatttatttgcaagtaagtcttaataaattgtgggagtttaccaaatgagtaaatatctactgagtttttatcagggaatctgctactgaaacattattgacaaaactcatttctttagaatgagtgattattggactgtaaatagaaatgtatctagaaatgtaaatgtcacctttgtaagaattttattaaagaattaaagacttttggctgggcgcagcggctcacgcctgtaatcccagcactttaggaggttgaggtgggtggatcatgaggtcaggagatctagaccatcctggctaacatggtatgcaaccccgtctctactaaaaatacaacaaattagctgggcgtggtggctggcgcctgtagtcccagctactcgggaggctgaggcaggagaaggcgtgaaaccgggaggtggagcttgcagtaagccaagatcgcaccactgcactctagcccgggtgacagagcgagactccgtctcaaaaaaaataaaaataaaaaaataaaaagaattgaagacttttaaggatttaccgtaaaagatttataagtagtattaa

SEQ ID NO: 73854 - DNA, 2463 bp, Homo sapiens
atgtaatatataagatatattttatatagcatataaaatattataaatatatttatatttatataatatataatatatttatataaaatatttattataaatatatatcatataattataatatatatcatataattatatataatataaaatatataataaattacaatatgatacataaatatatataatatgtaaatatatatttatatatataaacatgtatatgtttgtgtgtgtgtatgtatttatgacttggtgagttctaatgtattctcctatattccttgatgtgtttggtaccacaccaagtccacgaaaccaaaacatgaatatatgttagacttttgaaagaggaataaaattggatttccattaattatgttaaatgagcatacttgcttaaaatgttttctcaccaatgtaatcatttcattatagttaaatgattatacttagtagagaaatttactttgtttggataattttagaagatgacaattttgcttctacgttatataaactaattttaatgttaattaaattttatttaatgttaattaaatgttaatgttaataaagtcattaaagcagtaatgtgtctaaggcttttttttgtttgtttgtttgttttgaggcagagcctcactctgtcgcccaggctggagtgtgcactggcgcgatctcagctcactgcaacctctgcctgccaggttcaagcgattctctttcctcagcctccagagtagctgggattacaggcccctgccactgtgcccagctaatctttgtatttttagtagagacagggtttcaccatgttggccaggctggtgtcgaacttccgacttcgtgaaccacccgcctcagcctcccaaagtgctggcattacaggcatgaaccactgtgcccagccctatctaaggctatttaacagtggaataattactaaacttgtacacttttttttttttttttaatcagatcactaaggaggaagagcgagagaagaagttttctagaaggctaaatcacagtcctccccagtcaagctcccgatacagggaaaataggtgagcagttcattgaaccatactcagtgtttcgatgtaagttatcttttatacaaatgtttagacttgggttatcttttacgcagaggcaagtaatatctactcttttattggtctaggaaaatataactaggtccgtttctaccatgaaaatctaggtcagatttgtagatcttgggagtgagtttagaacagtgcttgacatatattagctgcttatctttttattcctaacttcagattccagtagaatcttaatgtgtgggtgttttttttttgcctgctgtttccatttagtgtgattaaattgtttttctcattcaggcttcaaaagcacttagaatacaatgcatgtgatacatgtctgtaagtgagattatatgtacgggatagtatgttctatatgtactctaagtcttatatacagatgcctttatctacagatgcctaattgtatagttgccaatgtgtaataagactaagggttaaggctttaaaaagattgtttttcatttaaaagggatttaaagtactgaatattaagctcagttttttcagttgtctgatggtaggatagaaagttaagttacaagaattaaatgtaacttttgcatttaattagctttttcctgtgtcacttaaaaattatttgtattaaagtgatcacatatttctttagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcaggggtaaataatatattttggttatctttttatgaaaaactccatgtttaaatgtttttaaaaattgcttaacattttgtcagtgttgtcttcatttttttctattatgatgtattctgtggtccaagagaatgctttttaaaaattcctttaaaagttttattccttgcaaattaaaatcacagttaccactacacattcaacaggatagccacgatgatacagactgattctattccatgttggtgagaaagtagataagctgaaactctttggaaaacattttggcagtatgtaaaaatattaaaactacacttagcatatgggtccgctattctacttcttactgtttacctggaagaaatgaaagtgtatgtccacacaggtgtttgttcacaaaggttcatagcagacttatttgtaagagccagatctagaaacagcctaaatgtccatcaagaggtgaatgtataaacatgttgtggtatatccatac

SEQ ID NO: 73855 - DNA, 1055 bp, Homo sapiens
tcctagtttggtctgttaataggatttccatttgatttctcatctaaagtggcacacttttttttgtttgttttttgagacggagtcttagtctattgcccaggctggagtgtcgtggccccatagtggctcactgcaacctctgcctcctgggttcaagcaattctcctctctcagcctcccaagtatccctcctgtaatccccttttgggattacaggcgcgtgccaccatgcccagctaatttttgtatttttagtagagatgatatttcagcgtgttggccaggctggtcttaaactgctgacctcaagtgatccacccacctctgcctttaaaagtgctgggattataggtgtgagccactgtgcccagcataaagtggtacattctgacagtcagaagcccttatcaaaaggatgctggaacagctggcataaactgggacatgtgtaccctgtgcgtagactacctgcatgagaatatcttatggttctcagtaacacaaaatcttgagccctatcttatttatagaagccacttgcacgatatttcctgaatttgttcaacctctaagtccctttttctaattacctagaaaaacagtgattcctgtcgttcctgttgttgaggaccattattctcaacaatatagtctggagaaagtagcactgagaatattttccaaggttgctttctagtagctatataatgtgaatggaggcaccttgtaggaaacagaaatatatagctgtcatgctgctgtgagaaactggagaactatttcaccttatatattgttttcccagatatatatatataaaatattatatattattatatatagtaatatatatatataaaatattatatattattatatatagtaatatataatatataaatatataaatagactatataaatatatatagtaatatataatatataaatatactatataaatatatatagtaatatataaatatattatataaatatatatagtaatatataaatatattatataaatatatatagtaatatatataaata

SEQ ID NO: 73856 - DNA, 2971 bp, Homo sapiens
cgtcttgaaaatagcatgaatcagtattgcctcaggacttgtgccatggcacactggttgggaagctgttgatattaggatattttctttctttttacttttttttttttgagacggagtcttgctctgtcacccaggcgggagtgcaatggcgtgatcttgagtgcagtggcgcgatctcggctcactgcagtctctgcctcctgggttcaagtgattctcctgcctcagcctccctagtatctggaattacaggcacctgccatcatgcctggctaatttttgtggagacagggctggcgaggctggttttgaactcctgacctcaggtgatccacctgccttggcctcccaaagtgctgggattacagacgtaagccaccacgcctggccagtgctagtatattttctagtttataaaagtcaaggtatgtttcatcatattagagataagagatgtggaagcggggaattaatcttaacaaatgtgttttaatctatggtgtttggttttatttttagagacacagatatttgtggaaaaactttttgatgctgtgaatacaaagagttacctacctcctccagagcagccatcatcaggaagcctgaaggtagaattttttccacaccaagaaaaagatataaagaaggaagaggtaacgatttgtgttaataccttacaggttatttaaacacataagaggaataaccaaactgagtttttatcttctatatctttgtgttggagtcctcaggaccactcccagtttaaatgatttttctaggaggactcataggactctgcatataattgtgcttatggccctggcttatttcagcaaaaggatataaagcaaagtcagcaaatggaaaaggtgtatgaggccaagtccagtggaaaacaagcacaagcttacaaagtcctcagagttgcacaggatgtgcttaattcccctagcagtgaactgtaacaacacatgggaattaggcaagctccttagaaactctgccctgcgttcttatttggaactggtcacataggcaccgcctacctagtatgtaccaaaattccagactcctgggaggaaggcagatgttcagtgtagaccatattgtttcataactaattcaggcatagtgaaccattccttatcagggggtaatgggaaccctcgagaaatcaaagtgcccaggagccagccttacaagcatgctggctttctaaggttagtattgtcaggcctgcttttactctgcacaatatcttacagacatagagtcttaatatctgttctatgaaaataattaggttgacaattggtctgtttgcttttgtcatacatgtatttagtaggggactgtttttaaggtagtaaaacacaaggaccttcacaagacagtggatatgacttcatacttcaagaggtcccaaaatttttgtgtgtattttacaaccttctctcttcacccttagttactagtcatataataatttatatcttttcaatttgatgttaaaagattataatttggccagggtgagcgtggtggctcatgcctgtaatcccagcactctgggaggctgaggcaggaggctcacttgagcccaggagtttgagaccagtctgggttatatagtgagacctcatctcttatgaaaaaaattttaaaattagccaggtgtgatggggtggtgcatgcttgtagtcccaactacttgaggggctgaggtgggagaactgcttgagccccagagcctgagggtgcagatcaaagcattacactgcagcctaggcaactgagcaagaccctgtctggaaaaaaaaaacaaacaaactataattttagtgaaaataattgttggcagtcaagccattatgtttctgcatttagccctagctttaggtcacacatatcttggttaaaattttggttctacaaatcactggtttgtgaccttgaaaacattacttttctgagcctcattttactcagctgcgaaatggaaatattaaaggttcttgtgaggaataagtaaaataatgtatataaagcaccaatcaagtgctttatatacattattttacttttcacatgtggcacatggtaggttctcagtaaatggtagctgctgtcatttttgagattgtaagagatgttgatgttgtgacctttttttctccttttatgctttttccagattacatataaataatacattttattatgcaataaaatatatattataatatgtaatctcaaatatatttatatctctatctgaatatatttacacacatgtatatttgtatattttcatatacacatacccacatgtaacatcccaatcagttttatctgcctgggaagaccagaaatgtaatttataactgaacctatttcatacctaacagtataagggttctgttaggaagaaagggacggtgtatattgtgttggcaattgcttatgcaacatagagatatgcaatggtttattcaagttttgcctactggtggaactttggtttggtttcagatttttgctgtgaaaaattatactttggctgggcactgtggctctcgcctgtaattccagcactttgggaggctgaggcgggtggatcaccttaggtcaggagttcaagaccagcttggccaatatggtgaaaccctgtcgctactaaaaacaaaaattagccaggcatggtggcaggtgcctgtaatcccagttactcgagaagctgagacaggagaatcgcttgaacctgggaggcagaggttgtagtgagctgagaccatgccattgcactccagcctgtgtgacaagagctaaactccgtctcaaaaaaaaaatatatatatataatatatataaatatgaataatatatattatttatttttaaaatataaatatatatttatatgatatatataaatatatatttatatatatcatataaatat

SEQ ID NO: 73857 - DNA, 1050 bp, Homo sapiens
tttttggtagagactgggtttcgccattttgcccagactggtcttgaactcctgggctcaagcgatctgcccgcctaggtctcccaaggtgctgtcattacaggactgattcactgtgcctggcctcaatactgtttattgcataatttatctcttcttagttggtttggatgccacttttataaaatctgaattcctagtacatttggatccatttctagactttctttttttgctgtttaaactaatatactgatgggtatgtttttaagaaataaaatggctacacatagcattaaggagtgttagtataaagagaacttaaatttcttcaaggtcctctgtgacccgggtgctttttacatgtattaactcacttaactattattctcactaattcagtttgtaactggaatttgtagaatgtgcagttggctaaattttcttcaacattggtttttttctttagctgtgatgcagatccatccgccctagcaaaatatgttctggctttggtaaagaaagacaaaagtgaaaaagagttaaaggcattatgtattgatcagctggatgtatttcttcagaaaggtaagatctttggtttaaaaatactactatattttaaaaagttatttaaggcttggcatggtggctcacgcctgtaatcctagcactttgggaggctgaggtgggtggatcacctgaggtcaggagttcaagaccagccgggcaaacatggtgaaaccctgtctctacataaaatataaaaattagccgggcatgatggtgggtgcctgtaatcccggctactcgggaggctgaggcaggagaattgcttgaacctgggaggcagaggttgctgtgagctgagatcgcgctactgcactccagcctgggcgacaaagtgagactcatctcaaaaaaaataaataaagttatttaaaataagtttatccacagaatattaaaggaactcggtaagaagccctaattttaacaaagttaaataaacaatattattattgagtatatccatagcttatttaaaat

SEQ ID NO: 73858 - DNA, 1020 bp, Homo sapiens
accctatttgtacacccaaacaaaaattagccaggtgtagttgtgtgcacctgtagtcctagctactggggaggcagcggtgggaggatctcttggcaggagttcaaggtttcaatgaaccatgattgcaccaccgccctccagcctgggtaacagcaagactttgtctctaaaaaaatgaaatgaaaagaaaaaaaaaaaaaaaactttattagctgtatccttaacacagtatattcaggaattgacaaagttttatttttatgcctttaaaatcattgatgtgaatgacttcatagtgatttggaaatttaatttgccaaagctcactgaagcagttaatttgaaatccttggagaattaaaattggaaaccccagtgttcgtgaatgctcactttgctccatttcactggactcctgtccctcatatgtgtcaagaaggtcaagtaggccttaggctctttctgatgggttcccttggcctgggctttttaaaattttttcttttccggatagccataaagcatatttgcattccatttccattcctatctaaattcagatccctgtttaaatgtcccttcaacagagtccttccttgatgatcttaaataatacttgttttatcttttctgttttctttctccttacctttcttcctttctcctcctttacactttatcttttcaacctggatttttcctcagagcacgtgtctacatgacaatacatactataaacgtatgtttgtgtaatatgcatattggttccccccaccccccaatgtaaattccgtggcaacagtgatgtttctaaaagttgtattttcaggatctagaacagtgacagagtaggtgcttttaaaattttcttgaataatgaatgcgatatttggacgataatcactaaacccaacatacttattttcttattttattcatcaaactttatatgaagatgaaagattccctgacagaaatgagccattgatctagtgagacatatatttgtatgtatat

SEQ ID NO: 73859 - DNA, 1883 bp, Homo sapiens
gtgttttcagcgtgaaatagaagtctgcatatctgtatttactgtttcataacttctgtacatgtatcagggttctgagtttcataaattattgaaaataattttcaatgtctttttcataaattgagaattttgaactttattaaaattgtcatcttgaaatgcttaagattgatgttttgttatctcaaagatttgcttagtcatacttgccaataatatgaaactaaatgttagtcttttttctaacatttcgttttgatgatgagaagtcctgaaaaaaaaattaagctcctttgttgtagtaaacttttaaacaaacaaaaaaaacagaaaacactttctactgtatttaaaacttttaggtggacttacacatcaaagtcatgtttttttttttttcctgaagagacacctaaacatctaatgaaactttaattttttagaaaataaaattgaggggcaggtggatgtaatgacgtactgaggttttgtgagttgagtagtaaagaacaaaatgcctagtgttgtgcttctgccactgtgtagtgctgtggaggaagtgtgtggtggaaggaagatctctgtgtccagatcagtattcaaatctcacttctgccatttattagctgtctaggcaaagaaacctcctctttccttattggtataataggaagaattacagtatttccatctatagttgaaagggttgaatgggacacatgtttgtgagccttgcccttcccctcctttcttagatattggttgattaaacacagataggctacattactactgttgctactgttagaattatcaccaacactcctgctgtgactaccacctaaactgtatgcattgttgttaaacattttgtattattgtacttacaagttttatgaggtaagcattgttatctctccattttgcaggtgatgatactgaggcactgaagcatgaagttatttgcccacagtgatttaaactaaggctttttgactctagagctgtgtgcatattcttaatttactactacagaatgcagcatcctagtgttttctgttactgcatatacttttttactatgacattttgatagtattggctactattgtaaaagaacaaagttctaaagcatcgtgattatcagtgctttagagtttaagaaataaacatctttgtggtttttgtagtatttttccccttcacctgtacttgttactacacctttctcaccacattaaaatttatttttgttcgtgtctgataggaagagttattcttttgggttggctaaatgatctttttactcctgaacttttgagtatttttgattcctttgacctttccttttcagttggcttcttttggcatagtaagtccatttcccattctttaggaaaaactcagcaataatagcaaaaaacaaaacaaaagataaaacgcttctagtcactttcttgctagctttctgttcctgtcgctggtaaatcttgaagtagtagtcagacttttaattttttgttaatttgccctcagccatttacttcttaatgtcttggaatagaatttcttcgttgtaatataattacaaccaaaattacttacctcagtgttaccaatcaatttatatttattgcctgaagttttatattttttgccctatgcgtgtataacatcagtgttgatgccacctttttaacttacttgccttgaatccctaatgtgttggttccttttcttaagtcagtcttaccctcttttgttccttttcttcagattctaattgtatttttcagtgttgttacattgacatttttttcttcatccattttttacttctgacatttcattaattactgctaagatttgaatgtttgtct

SEQ ID NO: 73860 - DNA, 2200 bp, Homo sapiens
ataatgcaatggggaaaattcacgtatttaataaagttattaggtacctactgtatactacgggaggctttggggatagagcttttaaattctaaaatcgacaagacataaataaatccagatattaatagagttgtgactattgtaataatagagaatcatgtaaaagtgattatgaggggggctatttcacattggtcaaggaaggactctcagagaaggtgacattggagtaacatctaaagagaagggaccatgtgtgtcaaagtcttggaaaagaacattccttgcaaaaggaagagcaaatgaaaggccctgtagcagaagtgattgtggtgtgtttcaggaagagaaaggccactgtggctggaaagagccttgtgatgagggagaggatataaaggcaacaagttggacaagtaggtaggggccacatcatgtatgggaagacgtgagatgatttaaagcagacaaggactgatttaattttgttttaactctgcctattttgtagagactgaaagggcaagaatggaagtaagaagattattcagaagtgtgttgtaggcagagatgtggctagtttgcattagagtgatggtggagacaggcagatccaaatacatttcataagtaaaattaatggattaaatgcgggagatgagggaaagggaaatcaagggtggtgccttagataacccaagcaacagaatgggtgatattagagaaggcagagaacaggttaaggggagaaggaaagtggatggctagttttgataataataaatacagtaagtatgaagtctgtgggatacagctaagtgtgatagcagatcattgaatatatgagtctaaaactcaggacaggactggagaaatctggagtcatgcagatagtatttaagacgatgacattgtgggaaatttcatagaaaaagtgtgtaggtagggaagagaagagggcctagtactgaggcaggaggaaaactgggctttatgtcattaaaaaacaagtgtatggcaaaagagaggagtttatgaaatgctgcagaatgcatgaaaaaatggaggcaaataggtagcccttagatttagcaaagtggaagtcattggtaaccttagcaaaatagtttcactggagtagagttgtgcagatggaagtcctatttcggtgtattggagagtgggcatcatagtatagcggtgaggagaactctggagcagaatgtctggctttgaattctgcctctgccacttaccagctgtatgatattgggtaagttacttaactcagggcttccatttcctcaactgtaaaattgggaaaataatgggtgtatattaaggaaatcttagactactgtctggtgtgtaattagcattcagtagttattaggtgaatacaaaacttataaatgttttggattgaaatagctttcctttaagcgttcagtttcatattagatttactgccgtatccctccatcttacctaaatgagaagactgtagctacttagagtgtatgcttgtaatttttctttagtcttaatgaaacatattccatgtatcataaagcctactctcgatggctgtagcactgcagtcattatgttgtaataaataaggctctgctagtagagcctagacactgggaattgtaattggtccttttctaatgtgtgtagctgtggtaaaattgagcccttattcaagttcttgtccttttaattgcatttcaggtggattcttttgtatgatgacttataaaagctgatcccaattatggatcagtggtttctaacgttggttttgtgaaatgttatgatctgttatctaaaaggaatttttttttttttttgctttaacattgtaattaccaaacgacctctgtttgagagaggaacatacagaggaccaagggtaagctgtaacttgaaacttacataaaactttttagttacctgtggtggttaaatacttcatggttttggacttactccacattttgaatgtgttaattcagcaaacatttattttaagagtacttaacctactctgtgctaagcagtgtgcaagatatagtaggtaacaagacatgaaatgactcacttcattttatttaccatttagcaggaaagataggtgttgaagtctgggaacatcaggaaacacttccctggtgtaatgtttatctcagct

SEQ ID NO: 73861 - DNA, 1035 bp, Homo sapiens
actactgtatatatctttccatacctgccatatggtagactttcagtatttgataaagatgaatgaatggtgctagttcaaggccaattttatagacataaaaccttgcctatgttattttattcctttttatatttattctgtttctgctactgagacctgggctctttaaggtgggggtgatggtggtggttgtttctttgcattctcttccagcttgaaatatattgcttagtcttcctctgtctctctctctgaatggtgtcctttagagttgttcaataagtagcccatgaagccatatgcagtggccctgcttatcaccttcataaactgcggagttgtgaatactggtttgattttccttatcttttttatattgattacttggcaactattttcttcttactattttcttaatatctgaccttcattctaaaacattgctcaattgtatgtgtattcgcaatatgttattttaggattttgtatgtattctatatatgtaggcctgacttgagtttaattaactgtggaatggtatggaatcttctactgacgtttagtcaatgtaaatttactgacaagatcactgtaattaaggctatgcaattgtaaatcatcgtatgtctctgttttcgggccatgttgttatggtttctttcagatgtttgatcacttagctggaattagggtgtgggtaaaattcttgttaaagacgtgccaaatgcaagttgggaaatgctgcagtagtctaagatttactgtcagattatttcagggttttgacttgcttgcttttaagatttgtttgaacatgtacagtttaatattttaaaagttcaggaatgtgctgtggtttagttcatctatgatgtttctccagaattactcataacattatgtaaagaaattgtgctatttggacagaggttttgagaataagggagtgaactggatttcattttgtaaaagaatcttctaatgtgatggtattaacccctttactaattttgggggtcttaggacatatag

SEQ ID NO: 73862 - DNA, 1002 bp, Homo sapiens
aattcctgtgtatattttacccagtttccccaaataatattttatcacatttgttttctgatgagttctttacctgtatttgtatataagtacattttttcttgaaacattttaaagtaaatgacagaaatgatgtttctttatatctaaatgtttcagtgtgtatttcccaaaaacaaagatgttgtcttatatagagtgcagttatcaaaatctgtagcattggtgcaatattaaacatatttcaccagttttcctactaatgtcacatagcaaaagaaaaaacatttttataaaaaattgagatctgatctgtgattaaacattacactcagttatcaagtctctttacctggaacagttctctaaatttttttttttttgtctttcattacattaatgttttagaaaggttcaggtcagttattttgtagctctgttttattatactttcactcactggttttaaaattcattggtggttcttgccttaaatagttataactttagtggttgtcaaatggtgatttcctaattccatttttttctatgtttattaattagaattctgtaaggaagagttttctcttgctccccatctattcatttatatcagtatgaattcatggattcatgttttattctatgagttataatctgatactgtcataatttattttgaggctcagattatcccagatttggccagcaggagcctgttccatctgctcttgcatccttgtaacatgttcttggcatttttgtactttcttgccatagagcattcagataatgtgaatatgtctgacttctagaatttaatttgggttgaagaagcactgtttacacttacacatggggcatcagtgggagaaaactgaccaacacaacagttactgccataatggcttactgctactgtgctgggtgcctaatgaacattttctcacagaattgcttgtggaaaggttgctagagtcctttattagccggattgttgaa

SEQ ID NO: 73863 - DNA, 1070 bp, Homo sapiens
tatctaaaaatgccattttctttgtgtttggccaaaaagcgatactgtgtctgaaatgataaaatcagcttaaaatttaaaaaataattagcattacattaatgttttgtttttcttttgttctcttagcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcaggtatgaaacatctagtaatgtttttattagttcttttttttttttgacattttggttttgtgtaattatcatgtctgttaatgggcttataaacatatatacacatggatatttatatatgtatatacatactgtgtgcacatataaatatacagatgtatacacacatatatatgtgtgtatgtatatatgtgtacgtacttatataaccataaaacaagatgatggtgagtgtgaatgagaatgtggtatatgtgactgtaggtgaagggtgtacgtagtgatatcccatacatatgataattactgaatacaaggcaataattcctgtttgctactgttcatcttattcaggtcactctaaagaactaatctatttttctggctacaatttttatttcctaagcaatgattaattattcagtttgatcagttttgtataccagtgtgatttagtatactatctgatgattctttaattttatatgtgattataacttctctagtctaataatttctaaataaattctaaataacttctctaaatattttatatactcattatgaaacattttcattttaaaaatcagttactgaaaaatattttaacagaaaaaatttttcactagaacttttcatcttattctgtatttaacatcatctactgctctcaaattaatgccagctttctctggttagcatttttgcatttggaatgtgtaaactcaatatttcttctaccaaattcatttactttttttgtgtagttactgaa

SEQ ID NO: 73864 - DNA, 1014 bp, Homo sapiens
aacttaactttcctgaacctcagagatgctaagatcaatgtatacagaagtggtatatgaaatggttagtattatgtaaatgtttgttattattactttttctttttgcttttttggctgtgagatagtgggcaagtaaactaagttctttgtgcatactaataagcacatagagaatactcatatattatgagattcttacttctcttgtctggcactctttttcagaatttcattctagaggttcttgtttagtgtattagcctttaaacggtatttatccattctttctctttataataaatttggactaaagtaagatatatgattgtaatagtaatttatatattttatagcttataacataggcctataatagcaatagtagtcctgtattggtggccagttgtaaattattaagtcatggctatggctacaaaattaaatagattttattggttattctttttgaattctttcttcagatacagaagtttacggtgagttttatcccgtgccacctccctatagcgttgctacctctcttcctacatacgatgaagctgagaaggctaaagctgctgcaatggcagctgcagcagcagaaacatctcaaagagtaagaaaatttcatcatttcttttgataaaattattttcgttaattgatatatacatttagtaatactaaaaacagttctttgtgtgtaagtgtgtatgtagattttttttgagcattatgggtttaaactgcacaggtctacttgtatgcagattgttttaaataaatatattggaaaaatattttggagatctgcagcaatttgaaaaaacttgggacaaattgcatagcctagaaatatcaaaaaaattaagaaaaggcctgtaatgaatgtataaaatacatgtaaatagtagtttatgtattatcgactgtttatgttatcagtaaggcttctagttaacaataggctgtgagtcgttaagttttggggaagtcagagttatactcaaa

SEQ ID NO: 73865 - DNA, 1194 bp, Homo sapiens
ttgagaacattagatgttgctgaagttcttatgcttacatttaagatgataaagttgtaatttttagtgagctattccaatgttacatatttacagattcaggaggaagagtgtccaccaagagatgacttcagtgatgcagaccagctcagagtggggaatgatggcattttcatgctggcatttttcagtaagtaatcttcctaaactattttgggttgtttttatgaattggctgtatgtgtattaaagtaacatagtgaagagaagcaaatattgttagcatatgtctacctttcttaaaatgtaaattgttcctgatattggactaatgaatactgtgatcatatgtttaaatacaaatcctagaatttatcaaactcttgttggataaatttatgcgttgcagccattatgaagatgctgacatgtaaaagtacataagcatatttaagctatttcagatttttaaagagaaatactgctatattggtgcccattcagctctgtaggagcgtatagaatgaaactataaattgcactattggggcagaggatttccatttgagtgtccttaagctagaagaaggattggaaaaacagatattctgggcaactggaacagtgtcacttgggacagacagttatgaaagtataagtcttatttgggggaatgttaagtagttagaagatcagaaacagtaacattttaacatcttgcagaattcttagtatttgacttataaagtaaatttaatcttcttgagggaagactgtgtcaaagtcttcattatttcaattcataatacagggattgacatagtaaactcattaaataataagatgcccaatcaactgtttaaattactaaagccagtggtagaaacccaatattcatttaagtaagtttattagtctatgatatagttaatttctgccctcaatctggttaaatgatcaagctttcattcttggatagaatgctgatttaattcaatttagttaaaagctttattatgatcataaaaccgagaaataatttacttatttaaagtgccacattcagctttaaaaagtagaaaatacagccttcgtgagttgtcacttttgagtctgaaagtccatgtaaaccctgtcctccaagtttgaaatggtttcttgcttcccttctattttcatctgctgaagaaaaga

SEQ ID NO: 73866 - DNA, 1014 bp, Homo sapiens
cttttaatgatcttaggaaatttgagagttggatagtttggttgttctatctgttctcttattttttgatcatggaaacattctttatgcttttgaaatgtgccttgaattaatcattaatcagccaggcataaggaaaggctttatgcctaatgatcacagtgcttctgttgagttgtcttcctataagacgtgtctttttattaatattgatggaattttatggattttcaatttttgttcccttttgttttttaccttcaatgtgagataattaagttaatcattaaatcacattatatctttaatccacatttcagatgtatttgctgacataaggaataccttttgtttctagttaagagtaaaagcccatgtttcactcagaattttaccagaaaataacagcatttcagtaggtggcagtcttctctctgagtttttatttagtcatactgttggatctttaggatcttttgggaaacaaattattgttagtcagataaggtcacttaattctttaatagctatattgaaattattttagtgttgtgactttgttgagatgcatctggaggtgaagccagttttatattatgtgttctaactgcctgaatgccgtgttctttattgagtttcttacctaaaagtgagaaggtttataaagtctattaagtatttaagcatattaaatgagtacatttgtgtgtatatatatattatttagagattggaggaatcttaaggaggttagtgtggggcagagtagaatacagaggacaatgccagttccacttcagagccataatctagtgtttatttatttaggggaatgtgaaaatgtaatcagtgataaaaatgttgctctcacatatgctgaaaagaatgttgagcactttgtagaatgctgagaaacagtagccactgagcgattggtttttaggtatgaactgggtggcttcttttagaaaatgcctgagaagtaaaatgtgtgttagaaaacagcagctttag

SEQ ID NO: 73867 - DNA, 1034 bp, Homo sapiens
ctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttattttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcctattttttgttttgtctcattc

SEQ ID NO: 73868 - DNA, 1097 bp, Homo sapiens
ccaatattctgattgtattatagttgtttccttctatctctgcttacagataaatatttcttaaatgcattcttggttacctgatgatatttctgtcctgtcatttttatacctgggcaaccatgtactatttaaaattgggttattctaggctgggcacgaaggatgcttgtaatcccagcactttgggaggccaaggcagacagatcacctgaggtcaggagttagagaccatcctggccaacatggtgaaccccgtttctattaataatacaaaaattagccaggcatggtggtgcacacctgtaatcccagctacttaggaggcttaggagcaagaatcgcttgaatccaggaggcagaggttgcagtgagccaaggtcacaacactgcaactccagtctgggtgacagagtgaaactgtaaaacaaacaaacaaacaaacaaacaaaaaaataataataaaatttaggctattctaagctaagctatcttcttgtatgagttctactatgattttggttgttggaattgtcagcagcattgttactattctttcaagtcagtgattagtagtaggtcatatccaattacttctcagcaattctaatcctataaattaatgaaagaatacataaaccttctcatttttgatacataaattgcttgatttggaaacatatctaaaaggagatctatgaaaatatatttcctatcccttctgtgtgttgcattttaatgaatcacaagtgacaaagtagttgaacaatctatgggagttttctcaagttctttaaatttaagaacaatttatttaatgttttacacaaagtttgccatttaattccctggtcaactatcatttaggaatgtatcattttattttcattgatatgcctattcctaataactatggaatgtaattattttatggctgttctaattagattaatctaaaaatagaaaaagagatgggaatttaaaaaccaaactattaatactaaattttacattctatttgaattccatagaactggctaatgtaagatttccccaggaatgtactggaattatcattatgaacctcccaaattcta

SEQ ID NO: 73869 - DNA, 1018 bp, Homo sapiens
ctctgaaacatcaccattttacctaattccttatgttagaaaagacatgaaaaaaagaacttgctttgattctggtatttggtatcataaaatttgatctgatattggtcttactcaagacaaagaaggccaatttaaggccctgacttattcaatcagattattcagaaaattgttgctctgggaaaaagatgcagcatgagagtcagtgtgcttggagctgtcttttagaagcaaaggtacagcaagctgctgcaagcccatcttgacaaatactaggttttaagtcacttgattagtcactttgtggctgatgtttgttttttttttttccaaaagtttgtacttttgctgccaagagtcactggaagtctagaaaataatttatctgtcattattgtttaatctcttgtttcctgttctgaggctccttcttagcacaggttgtcttctgttatgttttttaaaattggctttcaaggaactatatagcctcctacattaagacattgctctaaggaccttcaatttcctctgacttcctccaagaaacatagttaacttagaaatgatttaagcttcaactttgagttactgaatgtttcaattctaacactcttaaaacgtcaccctggtggtctaaggaagaattccgttgctggagaatagggtagggtttcttattcattatgtagttttcaagatgtgtaaagcacaaaaattttgactgattaggtttgttcatcaaaaactgccatgtgcattgacagagctctttttggtataaaaattgtgagttaaatatttttttttcaccgcataagtggctttcaaagtattcttagacatattgcatcagatgtcattgagtgtttattgaaaaagtaagaacctcttcccatagttactgagtcagaatctgatggtgtggcctagaaattagcatttttaatcattctacaagtgattatgtgcagtgtggcaactactgacctaggaattgctttctaacttggtt

SEQ ID NO: 73870 - DNA, 1036 bp, Homo sapiens
aaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaactgagctgttttgtcttcttttatcttgtttctttcaagtgtaagaaactacattttatgttaagggtaacattttaatgaaatagttaatcacttgtctatagaattattttatgattgccgctttaaagtaagctggatttgatgatttttcagagacaattctagcaatcaagagaacatttaacttactatctgtacttatatgggagctgattttagctatatcattgttcttgttc

SEQ ID NO: 73871 - DNA, 1097 bp, Homo sapiens
atcgtaagcaggggggcagcctggcccatggacagcgtcagtccgcctggagaaactcccctggggatcggctgtgtcccacctgctggggacggtgttggggcacagagaggcgataaactaagtgaaagcaaagagcagcgttgtcttctgccattcttttggaggtgaggagatccggtttccagcactgccttgctccgaattgggagacgtttgtcacctgccttgttcgctgtggcctctattctaaagagcggagatcggataaaggtccacttttgcctgttttatactttttattgtcatataggcttgggaaagggggtgatcgttttgaaattgaagaaggactgcagtttaaggaattccttgacagaatgctagatacgaaatgtgacatttgaatttttaaaacgcttttctggttattatcacttcgtttgtgttctcaattagcagggagaacaaccttttagctgcagaatctaaggtggtgttctaggctatcagactgtaaaatagttaattcttaagttgttgagaagttgaaaataaattcatgtcttcttcttgttaagtttgctttaatgtgtttctggcacctaataggatttgatttgcttttagttctataactttgtgctactatacaattaataaaaaatggcatgattgttgtagaatttgggtatttacttttttgcatgccatattcattctacctggtttgaaaaagttacagaatgccgtatacgtcacagttaaagtgtttgatgtaaaagtaaaaattaagaaccaagaaagaatcttctaggttgcattattaacgcttaaggcaaaaatgactatgacaaatggaaacctatttcaaattttgaaaggattttcaacttttgaaaacattggtagcagtgttatattccagcaatacttccttgcgatttttacgttgaacctgaaccttacaaattgtatgtttctttgaataaggaattcttacttaagtgactcaaagatcagttttgtattgttgtacatcacaggattacagaattgtcagtagcccgccgtaatttttacttttgggtacatgc

SEQ ID NO: 73872 - DNA, 1059 bp, Homo sapiens
gcaggccaacggcgagccccccccgggcgggccccagaccctcctcctcctcctcctcctcctcttcctcctcctccgcacccaccgcccccgcctcggcctcgctgcctcgcctccacaacgcccagtctgcaccgccgagagctgcgcgccgcagcgctagcggaggagaggggccggcggagcgcgcagcgcccaggcccccgcgcccgcccggcccggcccggcccgcgcccccgcgccgcctccgctacgacgcggccccggccgcaccacttggcgatctggctttaggttctccgtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggtgaggcacgtttggctcttcccctcctggcgccgcggccggcgcgttgtgggcaacatggagtaggtgcagccggaccaggagttgggtccgtctctccccgagcctccctttctcaaatcccgcagggtcttcgcgaggatccggggcgctccccgcggacctgcctcgcccggggcttgggctcggcctgcctctgcggggacttctgtatgcaccccgtgcagtgtccccgacaggcgaccccgcgcgcccgcgctctagggggttgggacggaggacagctagcctgaagtctgctcccagccgtgcactggccgcgaattcggcgctgagagcgggagagggagagaaaaacactttgtattttccaggttgcctttgcaggcgcccgcatttctaacctgttcttcctcttggtggaaggc

SEQ ID NO: 73873 - DNA, 1002 bp, Homo sapiens
aaataatttactttaatacaaggagggatttttttgggggaaaagtggtttatttctctaaaataaataaggctttttaaaattcaaattctggaaatgtgttactaataccaattgatctccacatattcgtgtatctgctttcctcattcctggaatggggtattatttaaattcagtttctctggaatgttgcctttggcaaatagcctgaagaagtacatagatttaggaaagtctttgcagatggaaattctgctttccctattttattaccattaatgttcttcccttttcttgaccacaaaaaggaagaattcaattagaagacgtctttaggtttaagctttgcttataataactggatttatttagttatcacaggactaacagatgtgcctaaaagccaccttatgttttccaacataatattgttgatctttttttttttcctttttggaccagggaccagacaaatggtgaccagacggtccagtctagaaaagcataattgccaactctgacttcagcaagggtggaaaaactcagaggaaaatgggaatttagcctcaagatagtagtttccatgtgtgagtgggttttaaattctccaaaggaaaaaaaaaaaaaaggaataatagaaaaaactgcaagaaaaaattatttgaaggatttagggtgataagtttatttttgggaaatctatttaaaatatctatttcctgcatacctatatttgtactaatagaaataattaaacttgttttgttttgcagactttagagtttatcatcattactttaaaaggagttaactgagctgacagatttgattactcaaagtggtctgtctcattttttatttcactttgacataagacttggcacaagtctgttacaagctatgcacttttattgctgcacttctaagttataaatctggtttacatctatggaaaatgtagtgtagaattgaagacatgtccaattatctgggcaattt

SEQ ID NO: 73874 - DNA, 1178 bp, Homo sapiens
cttggggctctacatcttctgaaaattctcctcatagttacagattcttctccccctcttctctcattccaaatatttttcttcacatgtttcttgtcactcttggacgatctgcacaacattcctacttgttcctcagaccacagcactatttggtctccctgcagtctatcccaatcacactttgagtgcgtgttcttctaggagcccatgtacgtagaatcactgttagacctagttgcctaaccctcaccttgttaacggtttttgcagtctttgtatctatttcctgtccaaagtttcatttttcatatttttattaccttctttgaaaacaggatgacaatttctatcataaatcagagttgagaaatgaacttccatggctgcatttaccttctttctccctctccgaactctcattccccctctctaccttaaaaaatcatattgataaaagtcatcactcccaagacacaaacttgaattttgactagcatcttcattgtttgctaggagagtaacactaaatctgattggttatctcacttcagaaggaaatgaacaaatcatatttaaggtattgcaatagttagagctagtaaaatttaggtactgagaaagaaaacaaaaatatgtaatgagaagaacttgtgatccagaaggctcccatagtgcagcacaaggaatattgatataaatgcaagaggcctgggtgtgagtcttggctctgccccttacttgtgtgatattgctggacacttttaagtctcagttgtctcacataaataggaaaatgttatccctctcaaagaggtgtcatgttaaaatcaaatgggattattgatttgaaagtatttatttttattatcttttattatcttctgtccttttagtatcttctgtcctctattcttatactagttagtcagtgctcattttcatttttggctctttgtttttaaacctgcgcttatcacagaacaggatgcagggatgaacttcaactgatgcaattctcctttgatgaaggtcacacagggtagctgtcaaaagtgtggaatctgtagtcaggcagatctgtgtttgtatctcagctcttctgctccctgtggtaagatgctaaatttctttaggtctcagcttcctcatctgtaaattgggaataataatggtat

SEQ ID NO: 73875 - DNA, 1028 bp, Homo sapiens
cagcttcagtgcctgtatcagataacatcttaggaagtctcatccaggctacccttcctccagacacactggatatgatcttaattgctagaatattaagagaagataataagataagaagggaagcagcaaccatatgatgtgataattgtgagtctgggacctggaagctttacaaaagatattgggtaataaagacttggagacttacatgtttaacttccttatccagagtgatctgatgggcatatttattatgatgatggtaaagatattaagttcaaattcaacccccatctgagaggactggaagactgtttaagttgtcagggtagcctgacaatgaaccagggctgcatacaaaccattagtgaaaactgcaaagatacatgtaacacacaggcaaatatacaaagagaaccttgtatggagtgtaaaagaagcatacgcctacaaactgctggaggctttgaaagcaatttaccgagaaagctttttacagtggcccactttggagccatcgataattaactaaacaaatatttcagagtgtatccaactggtttcagccaatttccttagggagttgtgatactttaaattccatataatgatactgttggatcagtgtcttcagctgcagtatgtaagcacacaggacttgattcatgatcatatgggtaataatttgagatcaatattttaaataatgtaatagaaaaccagcaaggaatctctcacaagtaataaatagcgcttgagccttagttgtgggtatatggagtcattatgaattctgccaagtatatagatttatgcttatacaaattactgagtgataaaagacaacatttctcataatagcaatatggtttcataacctatccaagagcataggtttcttcatgtaggacaccaagaaaccaaagcattattctaaccacttattcataataggtctgactttagcagctgatatttctgccttgcagagactctgtttttcccagtcttgagatgagatgtga

SEQ ID NO: 73876 - DNA, 1027 bp, Homo sapiens
cggagccttcaattgtgggtcacatgtcaatcagccatttccagaattgatttgaaaaactatatttagatatgaggttgccttttcagtagatacaaccatcttttccactccttctcttccacttagctcttccataagctatccagtcccccattctctggtttatcagtggacttctaccaataatactttttctatctgcctgaatcattgtgttagttgattttccaacattcttttccagctgatatcgaaccttgagttattccatctatctgatttcattgttcttgctccagggctgttagctattctctagctaatctccagagattgctagagagaatcatccatcctatatccatgcatgcccttgtgaatgtcctgtctggacctagctggaactcacctaaccacaggcaaaatgaatgtagcagctaaatagctgggtttgcaaaatttgttctgaaccaagctacattgcccacagacattactttttcctgcactgctcaggctctgactttttacctcctcattgcatttgtgtttgccccacttccaattttggcatctcggtttattattacatgcttcatcttctggctttaagctcatctccaagggctgtcatgttcaaactcattagccaatattttgaatactctggctttggcccaagactaagttttatgactgtgttagtccattctcatgctgctaataaacacatactcgagactgggtaatttataaaggaaagaagtttaattggcttacagtttcacagggctagtgaggcctcaagaaacttaaaatcatggaaaaaggggaagcaaacacatccttcttcacatggcagcagcaaagagaagtgcagagcaaaggaggggaatcgtcccttataaaaccaccggatctcgtgagaactcactcactatttacttattgttttatctttagaacatgacaaaagccctttgtcttaggcactcaataaaaggtgccaaatcaatgactaaat

SEQ ID NO: 73877 - DNA, 1107 bp, Homo sapiens
gtaattacatatttacatggtcagtaaatggcagagccaagattcaaacccaaacgtaggactggttcatttcagagagttggttcttaggtaactatacttaaacattatttttaccctacagcctaacgatttctaattatattttaattatagaaagtttagatacttcatcctattaaaaaataataattacagctagcatggattagacccttactacagagccaggtgattttcttagttctttatgttattttccagttaaaatcacacaacttttaaatttttaataaacttaaaaaaaatctaactttcagggtaggtcctttaaatttaaaaaaaaaatttataattaaggaaactgaacttcaaagatgtaaaaccactgtgcaaaagcactcagctaaattatggatctgtaattcaaactcaggcctgcctaatatcagcaggttaatattttcataattctgcacatttcaggactcctaagcaaagaaaactagtacctgagttaaaggacaagcctgggaaaaggaaataaaagatgactgaataaataatgagcaatctatggagagaattgaagatttatttctaaatatgttcacttttcaaagcaagataaagcctggagtcatgaagccatctgttcacattctgaaggactgtaaaacattagggaggaaaagtttcttttctctttaggagggaagagggaatagcatgtagcctgtatgagcttccataattatatttcaggcatcctcacatgtggtgtaagaaatcccctttgtgcacaggcagagtctatctggttctctcccaacactctgaatggcattggaaaccaaatgagcatcggaaaccaaggccgttattgctgtaagtactaatagtcagtcccttaccctgacacctcgggtttgctttcaggataatataaataacatagatattaaaagcttatttcccaacttcacataacattccaacactgtgatgttttctttcaaaactctccataattctactctatcctatgaacattctactattttctactgtttctgaaatgaactctaggttctcctccttactatc

SEQ ID NO: 73878 - DNA, 1031 bp, Homo sapiens
tattcatgttttatatatatatatatatcaatctaatctatctagttattcagcctccttctatttatccatctaccatctacctcgttacaaaaggcattcaacgtggacaaaaccattccaccaaaagaaagcatgtaagtctttttggaagttattagggtgttcagcaatttttagcagctacctgaatttgatgctatatgtcctggactttgctctaaaaatgatatatacatgacttcatgtgaaggccatgcatagataaaaacacaaacttgaaaatgggaataaattaaaatttcttctccctgtgtaatgtcttcttagtggagtggagcatgtttttttgagcaacagcacccagatttgtaagacatcaaactaactgcttcattaggcctgtttttctcatggtaattttggcaggattaagatgccatgagctactcaggaaggaaagtaaaatgagaaaatacaaaaatagctacattaaagtgtggcttaagaaagaggtaaagcccagtaaacgtggaggttagtgagaagtgggcagatgattctacttggtgaaaatcatcattgactgcaattccaaacaggcatcatgaaattgtgcctagatacatgagtttagatattgaatgaagacttaaaatattgaaagaagcagcaaaattccaaaagaaatgttgtggatgtaatgtactgtgatattttgtgggggttttacatgttttgcatgttattagctaccccagatgaatggatttgcctcagagccacacaataaatcatcgtcagagttcgttgtgatagttactatttattaatgcctgtgtttcatactgaaatgtctttctgtgcttacttgctcgtctttctttgcattccactgatcatcaatcacaaaagcagcttggccatttctctctgtcttgcctcagtgaactcctactttccttgattgttaaccccttgctggaatgcacatggcctgtatgcctctctgggcttctattcaactctcc

SEQ ID NO: 73879 - DNA, 1071 bp, Homo sapiens
ggtttgttgcatttatacaataaacttgatatcaactaaaatgcacacgtacgaaatctacttatgagcatattttgctttttggtgcatgtgcaagattttaatgtgggtattactaacctctacttaggaagttgtgagtttcaaagtggtgtaataggggatttgaaatttgtaagcatgtaaaaatgattaagttcagtaaagacggcacacttaattaggtatattttcctcaaataaaatagtttctacagaggtaccaaattatatctgaacccagaaggtcaattcaatttgatttgtctgcttctggttcagactgggggtgagagaaagctgccattcatattttcagaccttaaataattccagttcatttgatggagttgactactttctcctcgtgaaaattcttttttcactgcttgtatgacactgttttgttttgttgctgttgttgttcttatttttcttttagtacaattttactttcatcttctctctctctctaaatatacatataataggtatactgtgtgtatatgtgtgtgtgtgtgtgtgtgtgtgtatgtgcatttttaaagcaataacctattgtctttgtttttttccttcaagcccatccacttttagaaatgcaacacttaaggcaaatatctccaaaatctttatcactagctctgaacttattctagatttccccagactggtggaaaattttacttttctaatttgcagtctcgttgactacaatataggtaattctgaatttatttttttatttaaaaattattccactttctatgtttattctgttttttttgttttgttttgttgttgttgttgttactgttagtgacaccagtgtcatctcagctgtccagacttgaaacctcggaaaactttactctttaccacatacctcacaagtcactggttacaaaccctttcaataatccccagtactgttccatatgattcagtaatgcactcactcaacaaaattcaaaatttgatactaacaaaatatcaaaattagatatctatatactatttatttactatttt

SEQ ID NO: 73880 - DNA, 2096 bp, Homo sapiens
taaatgcattcgattttgtgttaatttttaaaaatttgaaaataaaaagaatgtaaagtggtcctgtcatgaatgatggagggaccctcttactaacagtaccttacaattttctgtaatgttgtcagggcaaaataaatgccctcatttttgtaatagtcaatgaagaatggcatgttgatcttgtccactcaatgtccactcaaaacaacttttagttataattgtattttcacctagaaaatacagttttggattctaatgcagaaaaattatactccaagtttatgcaagtacacaaactaaaagtaaagttgttccttttcatgtagatttttccttcagtcctatttaaattgaagtttgccaacttcattagtaacaaagaatacataaaatttaaataccaataaatatataactttaaaaagaaaaccgcttcgtaagtaatttttacactgtgtatatgcagacttttcagtactctaaatgtcatgatcctgtattgacggtaaatttttttttctgagccattttccccaagctttgctacagcacttttctactcagactctagttgtctagttccagccaacaaattccacactgctaattttctgtcaccaagagaaagcaaattatttttatttttataacatcaatttaaaataattgattaatccacagagtaaatttacattagtaactatcatgatactaaatcagctaagttttactataaataataaaataccatgtacctaatacggtggtcttttatttactgtattacacttaagggtaaaaacaaacttttaagcgaagtacaaaagcaaagtccaaaaaatattttcacccatttagaggtgcagaggttaagagatttgcccaaattcacagagggagaaggtagagggagaattaaatacccatatctgcagatataatcattatctcctaattgtggttatcattttggtagagcttttgcttacatagttgcatgttttttcttaactttaatagtattttgagacttttaaagtgtgaactgcattgaataaaactgaattcatcatttgctttggcatgctctgttgctttaacatctttagacaccattttagcaacccttgaggcagaatttaatgaactgtatttcctgcctgaagtgcctgcaatatttagggttccgcaagtgaacctaggaggattctccacccaagcatgatttatctctttgggagttccaggttggtcagggttatatttaagtacatttgaaaaacatgccattttctgacatgatgtcaagaaaccatcaagagctttcagaatgaaattcaaatttcctatcctagcacaaaaagaccttcactgctgattcccagtccaattttttagcctcacaacacacctctgccatttatattctatcctaaccaggtaggtgtctacttgctatttctaaacataaacttttcattttcacatttctctgttgtccccagtgtgaaatattttacaactcttttgtatcctccttatttactttcaaaaccagtatgtaaagacacttgttctatacaatgtttcctgacctagttgtgagaatttatgttactttcttcttggtgtccattatacattatacagagtagtagagtcagcatttttacattgcaatttatttatttgcttgcctgtttttttcatatatatttctccctcgctaggctgtgggcttctttgagttcaagaggtccagatctttgaagtcattaaggtttaattaattgaactatgtgaaagttgggaacttcttcatgctctccggcataccaaattatcttattatcaacatgcaaaaaagtttttcctagtctttgtaaatgccacttgcaaacatcttcatcttgagtttgaacttttaagtggtactcaactatatttgtaatgtttttattaaatagtcataatttaatgactaaaagagaggcaattactttgagtttgtcacatactgcctgtctcgggtttttaattgtaaaatagggatagtaattattaataattttttcatatattttcctgaa

SEQ ID NO: 73881 - DNA, 1073 bp, Homo sapiens
tggtattttaaattgagaaaattgataaattaaaattacttgctttctgctgtccaggttaatccagaatgtagttttaactttaacagggaaaggaagaggcaaaaatgtaggataacaattttaacaaaaatgtcaaacatggaagcagaatataataccttaataaatcatgacactgatcaaaaaaacctttcagaggagctacttaaaatgtaataattataatggatttgcatattttattttaattgcctgatggtcttctgcctggaataccttttctatcattatttagatctctgttgaaatgctgtatttttagagagaaagttctatttaagttacactctagccgtgattcaacatataatatggtgctactactatttgagtatattaactgcctctgtaaaggacatgggcttctaaatcaagaagtcaggggtttagtcaattttatttattattccattctaaatgcctggcagataataagttttctgtaaatatttggggctatgtttattttttttgaatatttgtctcttctgctaaactggactgttcacttgatttggcagagagtgataacttcatcgtgttctcactgcctgggtgtgcacctcgcacctaacaggaacttaataaaagtacgtcaactgaatgagcaaatggctatgcaaatggatacatttaattattcattctaactcctatagacatgaatttgaatttttgggagagataacagtgaatgaaaacctgaaagatatgttgcactaaaaatctctgtgaatcattagaatcctggggtcgctgctggagaataattaaactactgtggatggtcgcacaccataaagaaacagaggcacaggggagcagcttctgcacatttctgcattggcactgtctgcagttctgtaggcattaacataacaacgtaatgcagcagctgccagcagtaaagatgtatgctccacagtaaatataaccacagggatgggagccagaatcgaaaggaaaaataaaaatagaaaaatagtggatccagaatgttggtgctgacc

SEQ ID NO: 73882 - DNA, 1061 bp, Homo sapiens
atccttaacagtaagtacacgagacagcagcattctgaatggcaggaggaaggcaggcgatcagcacagggctggaatcatctgttcctgaccaccagcaagcctggcactgccggggttatttccactcctccctttcccaatccgagaattgcacagtcccacgctcgaattacacacatggtccaagacttctctctcttcctacgaatgtgacatccaagggggccccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcggagttttttttagagccaccgggctgccaggacaagccacaggcatagaacgacgcggttgctgcccgccccccccttcccccagaaaccccaaaggatgtcggtgatagagagttccaactaatgacgattgtgcgccgcatctggggaagggatacagaaaaaaaccctgcaaacaccgtgaggatgaaactgccaaagggatgcaagagcctctcaaatactaattaggggccgcggcggcggcgggctcggcgcggagacagcgtcggcgggatcccagcgcggtggtcgccgctgcgctggggggcggaggacagcgcaggagctgcagccgccgccttcgctggagcagccgaggggccggtgccacctttgctcgccccctcactaccatgtacagtgtgcgctgcaagaagaaggcgggagatgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagag

SEQ ID NO: 73883 - DNA, 1045 bp, Homo sapiens
ttctaacatggcaatcaagaactatgtaagcaggacttagtgtgaataaggggatggggattttaaattgttactatgaatttgtgattcattagtaattttaaatacacaacatctaaaacataaaggtggcaatttcttttttagtatattttaaattacacacttttgttgacagggtaggtaatatagtttacaaaatgccactattgcctgcttacaaacattaagaaacttggttgccgactgatgactcatgtggtaactcctgaacaatctgttttatttgatcagatcagctttatttcctttaaaaaaaattttgaattcaaatgattttaggctagatgaatagcttccatatttccatattgtcttaacctagaaacttcaaataattttacattaccagctagaccataagtgtattttaactttcaatcatgattaaataaaatttgttcctctaatattaaaatgtatctatcataatcatggatttttagatattgttcttggggagctcagagtttatcaaagctttatatgtgatatacgaggtagtaaatactatgtaggtttatattaaggaaataaaacaaatataataaacacgagaatgaataattttacatgaaaagggggagctggtatgctgtatattaatattgtatttgaaatataaatatatgtgttaaagttaaccatttacagtgacttggagtctcccagagatgaaattactcctgtttaggtgattttgtaaaatgcactatctctcacagcccctggacatcataagggaagtggcagcagtaatttaagaggtatgtgaatacagaagggaaattataattgcagcatacacagaagcttttcctaaactgttcaactgctcatatacttgacaagagtgtaaatggccaattcattggaaatatgtgaaacatcaaatatgagaatcacttttaggatgacaggtataatttggaaaatctgatccgatagaattaagaccaaaacttttttaaatgggagaagacag

SEQ ID NO: 73884 - DNA, 1056 bp, Homo sapiens
caactaattttgaaaggtcatcaatgaggaataagcaataaaaaatataatgcataggtttagtaaatatataatgcaatatgaagtagcttacttgttgattatgtattagtgtaatatatttcttcctgtgtagtgaaacaagaggaagataatggagaaaaattaaatgaaaacaaaattttctatttataagtacctagaatagattccaaattttatgcatatttgcgcttcaaagtctcaggttttatttaaatacccagcattttgtagtcatgacgttcattgaaaataagcattgtcctccagtacaatatgttacaaatatgtattacatttctaatattgcccaggcactgtgactgtaaccataaagaagcctagcatttgtctctattctagaatatacagccatacttctcaaatggtagtttacatgcagatgccttgtggatttctacatacatgatttctaataattctgtaaataatctgtttctactttgctgtgggaaaaatggatcagaagtgaagtacgtcaaggtcacttagtaagtaatgaagccaggactcagaagcaatgccttctgtctccaaaaaactaagaatgtgtcgaaaagtttatataagaaaaggcaactgtgaggcctctcatgcaaatgaaaagggaggttgtgagaattaaaatgagggaagatgcactagcctggggattataaaaatattatagaagaggaggtatactcaagtgtttgaaaaataagttaaaaattttaacagggaaatgtggggattgtctgatgtgtagcagcaaccaaggcatggaagccagaaatccaagtgacattcctgagagtaggaagcagtcctttttaacattaggattagttaagtggcataatttgcagagcattctggaaaatcaaatcattgttcataaataaactgccttaaagaaatgttgacgaatttctaggcaataagaaagcaattaaacgtttgagcagagttctgtcataatgaaaattttttaaagaaaaataaatcatagag

SEQ ID NO: 73885 - DNA, 7079 bp, Homo sapiens
tctggcgggcggggcggagcggcccggggcggactggcccggggcagcgtggcggcggcggcgtggccggggcgggtctcggccgttggccgccccggcgtgtggcagccgcatctggctgccccctcgctcgcccgcgggccggcggaggggggcagggccggggcgggagggtgggagggggcggcgtgcgcgtggcggccgcgcccgggacccgcgcagaccctgcctgggccgacccgaaggcgggtgggcggacggcgaacacaatggcccctcggggagaggacgtgcgaggcccgtgccttctccggggcccggggcgcgcgcggggcgtggggtctctgggtaggaaagtttctcccgagggcgagagttaaagcgcctccagaacaaagcggcggcggcggcggcacatggggcaggccgcgggccgggagggggcgcgcccacgaggtacctgcgcgccagcgggcggcgtggcgtgggcgggagcccgcggttccccaaactttgtacgcgcgagggtgggcggaggggcgccgagatcggcgcggcctgggcgccacccccgctccgcgtgggctttgttagcccgcgtgggcagcctcggggcggggcccgcaacttccccgccgtggccctcggaggaggccgcagtcggcctcagccgcggcgtggagccgcctgcgcccggccgcttgctgggagtgtggcgcgggagggccagcccggctcggcgggagcggcgtccccgccgccatgttcctgcggggcgggctgcacgggggtgagggcgggggacatggcggcgactgcgcgccgccgccgattgttcccggcttaggcctcgggccgcgtgcgacgggcaccgcggccgcggagcccccgcccctctgggccgggctcgggggggctgggggacacaaaggaggggcggcgcgcccgcgtccccgccgcactcgggcctcggcgccgccggtcgccgcgcggctgccgccgggaaacgggttgggggggttgccgcgtccggcggggcctgactctgacccgccgccccctggcggctacgcggagaatcgcagggccgcgctcccccttgtgcgacatgtgctgccggcccgggctccatgagcgtggcgggcactttgcagtctcgggtgttcctgcccggtcttctgttcctaaactgcagcaaagggaaaaggaactgaaaaaggcaggctcgtcgttgcaatatcaccaaaagagaaaattaacggcatgccatcaggaccacagcagttggagaaacaactctttatcccggcttgcagccacgaggtcttgattgggggaggggtggtgaagaatagtctgtgggctgctttttttttttccttttactggagctgtacagtggagtcggtgattgctgctgatcataatcaagtattttaggagcttatttagacatgtatctgatagctaaggatttttcaactttattctcttacgtatttttcaactgtaaattattgggcttttaaatcctgctagtattgctcgactcttactctcacaaatggatggaattaattgctgttaggaggttggaaaatagcaaatatagatttggacggtggtagtaattttgagcaaataatgttttatcttttttttccttatttttccctattccagtcatacacgtggacctaactgcaccagtagcttttctgagaatacttgctgaaaaggaagttttctggaatgggtaagtgtattctgattttcttgaacttttcttaaaaacaaatttttcttgctattaaagttgaataaataggattggtttcttagagagtaaaagtaggtgtttctttctttagacaatgtaccttttctgaaaaactaactcattaagtacggatttgctaattttaaggtagtaaaattacagtgtaaatattcctgtacatttttggaaactggcttatgcagtttacgaaatataattttagaccctcttttaagttgggtgataaagtagatataacctgagatgatagatttaaacaggatatttacgttctgctacaattgactgataacacttgaagtgtagtctgaacagtaattttgttaatcatttcaacaagtatttgctaagtggaagccagaagaggaggaaaatgttttgccacgtggatgtgaagatttcctctaaaaggtacacatggactaaattgcctttaaatgttccaaaattagttctcatttatttgcagtctcattttgttttgttttttttctctatgtgtcaatccatttgggagaggccagccattggaagagccaccacttccagtgctagttggatggttggttatgattgccttctgtaaagaattcttaaggcataaatacgtgtctaaatggacctcatatctttgagataattaaactaattttttcttccccattagggattatgctgaatttgtatggtttatagttgttagagtttgaggtgttaattctaattatctatttcaaatttagcaggaaaaaagagaacatcaccttgtaaaactgaagattgtgaccagtcagaataatgtcaaagtgcttacagtgcaggtagtgatatgtgcatctactgcagtgaaggcacttgtagcattatggtgacagctgcctcgggaagccaagttgggctttaaagtgcagggcctgctgatgttgagtgctttttgttctaaggtgcatctagtgcagatagtgaagtagattagcatctactgccctaagtgctccttctggcataagaagttatgtattcatccaataattcaagccaagcaagtatataggtgttttaatagtttttgtttgcagtcctctgttagttttgcatagttgcactacaagaagaatgtagttgtgcaaatctatgcaaaactgatggtggcctgctatttccttcaaatgaatgatttttactaattttgtgtacttttattgtgtcgatgtagaatctgcctggtctatctgatgtgacagcttctgtagcactaaagtgcttatagtgcaggtagtgtttagttatctactgcattatgagcacttaaagtactgctagctgtagaactccagcttcggcctgtcgcccaatcaaactgtcctgttactgaacactgttctatggttagttttgcaggtttgcatccagctgtgtgatattctgctgtgcaaatccatgcaaaactgactgtggtagtgaaaagtctgtagaaaagtaagggaaactcaaacccctttctacacaggttgggatcggttgcaatgctgtgtttctgtatggtattgcacttgtcccggcctgttgagtttggtggggattgtgaccagaagattttgaaaattaaatattactgaagatttcgacttccactgttaaatgtacaagatacatgaaatattaaagaaaatgtgtaactttttgtgtaaatacatcttgtcttgttttcattcaaaaacatttcacttttggggttgcgtgtcagatttggcagtataaattctggctatattttttgttgttagatttatttggctgttaagtattgcgatatgactaaacatactgtatacctgatgatcatctgtaaagttagagtatatctttttgctttctttggagttagtgttattccaggatattttacttaatctaaaagttaatttatgttgctcatatattactcaagtatttaaatttagagagaatgccgctctgtttaaagcaatgtgtaaagatgagtttttttaagcatggaatttagggttggggtacaatttgtttctattaagcaagtaccagtttaccaatacatgagtaactgaagtgtaactgttaaatgcttgtatactagtttttctttctgattgtcagtgatttataagctataaatgaccaaggtcctcagactgcttttagcatctgcaacttaaaaaaatgggagttagaaaaagaacaaatgctaaatagagtaacagttaaatgtatgtgtacactcttcccaaatgccaagagtgcagcggtggggtgagattcagatattcatttatttctaagtctgtagttaacatttatgttccctactccctacgtaagccagactttggcaacagtgatagttgattccaggcttatttgacttaaagtcactgaagtggaaactaagaagtggcagttagtgttttacccagcatttctgccttctctcttttcttcatgtgtttttgtctctagcctatgtgtatttgtgtagaataatgtgggatacctgaataatagatttaaaaggaccaagtggtaaaattgggcccaagctgaagtacaggcaaacttgatgtttgaaagataagttttgagaaatgtcattgtattttggagtaaaagaggctatcttagtaataagaaataaacttccataacactaggttagaccacccaataaatctagaaatcagcttttaaaaatattgtctgaagtctaacaaaagttttcacctctaatgtgttctttaagaaatttaaggaacttagccttggattcctgaatagaaaggtaagaattctatcattctggagttgatgaaaacataaattttcaggatgtgaaatgaacagtgatttataaaatggaaatcaaattgtacattagcagagttcttaagctttttgaattgaaggagacctaataattgtgtctttttggttatttagtgacaaacgtggctttcaaactatgcttaaaaagttccggctggacacggtggctcacacctataatcctagcacttggggaggctgaggcagacggattacctgaggtcaggagttcgagaccaacctggccgacatggtgaaacgctgtctctactaaaaatataaaaaattagccgggtgcagtggcgtgcacctgtaatcccagctactctggaggctgaggcaggagaatcacctgaacctgggaggtggaggtttcagtgagctgagatcctgccactgcactccagcctgggcgcaagaccaagacttaaacgcaaaaaaaaaaaaaaaaaaaaaaaaaaagtttcataatacagcatggtctggtagtttgcaaaatggtgtgcttttggggagatacactagcaatttttttaaaaactggaacagtgtgataggaagcctgctggatgatttcttaaatattctaaaatgtaagtcaaatatgttttaataacaaagacttaaatggcttttctccctagagactgaaactagtattcattgtgttcagaacttaattgggcttgaactgagatttaaatctaataaacaagttaataaatgtgtatgttttgttgtgggtttggtagtgatctgtggttctatagggtttaataggaattgcttttgatttgtttctggctttagaatgtgaggcaaattttacattcttggttctattaagattttcttaggcatgctaacatgccaacaaaaagccatgtaagtattgtataaaaagattcacattgttaatttagccattttgaaattcagatgagtgagcaagttgataatggcctcatctctgacctgagaaaaaacaactttgacccttgttcttaaaatgctttaaccttgaagttgcttgagacttaagaggtcatgttgctttaggtttaataaatagccttaactatttggaggggaaaaaatgggtcaacttttttttttttttttggcgtttgcatgtacaactttctatttttagcctatatttggaaagaaagcacttaacattttaggaattctttttaaagctgcttgcaaagtgttggtgattttactgaaaacttttgagatcttcattttacaggcagacctgtctaactacaagccagacttgggttttctcctgtagtttgaagacacactgactcctgacaaaatgcagcctgcaacttcctggagaacaactcagtgtcacattaaagtttattatgtatttaatgatacactgtttaattgacagttttgcatagtttgtctaactttagagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttctgtatttacagtttggtctggctgtttgagttctagcgcatttaatgttaataaataaaatactgcattttaaagctgttaagaaattgtccagaacgagaatattgaaataaaaacttcaaggttattatcgcagtttttatggcgtttttgttttgtcactacagatggtctaaaggttacttattaattaattggggaagtggagacaaggaccaaagtttatctggattttcttatttaatcttcattacctgtgaaatatgtatttgtattcttactttacatatgagatcagaagttcattttcaagcagaatggaaaggtggtaaatggactctgaattaaaatatgtcagtattttaaaaggttatcttctgcctagtatttttatggaatctgacaagttctcagatcacacttgtttccttaaatcttggtaagtctgaagcattcttcattttgtttatattatacacgttagtaaggtgggagttcttttgttttttgtgttttttggccagttgataacatgaaagtttaagagaggaggccaaagtatataaaaagtcttaaactcctgcttctaataaatgtccaatatgtgttggctcctgggttgagtgtttattaatgggtctgt

SEQ ID NO: 73886 - DNA, 1103 bp, Homo sapiens
tttgttattttgaattcattacattactgcttttaacaaattgccacaaactttttttgttgtttgagacagtcttgctctgtcacccaggctggagttcagtgacccaatcagctcactgcaacctctgcctcctgggttcaagcgattctcctgcctcagcctccccagtagctgggattacagatatgcttgcaccagcacgcctggctaatttttgtatttttagtagagatggggtttcaccatgttggccaggctggtctcaaactcctgaccttgtgatctgcccacctcgggctcccaaaggccgcaaacttttaatggcttgaaatcttacagttctgtaggtcaggagtcttgacacaggtcccactaggttacaattaaggtgtcagcagggctgtattagtccctagagtctttaggggaggcaaggttttttttttttatcttttcaagcttctgaagactctgcctttggctcacggtctcttactccatcttcatatctagcagcagcaggtggcgtctgcatcacactggacccctcttacctccctctttcacttttaaggacccttgtgattaatattgagcccatccaaatatttagaaataatttattttaaggtcagctcattggcagtcttaattccccttgtaacatttcacatttgcaggttctaggattaggacttggatattgttggaggtcattctgcctgtcttagggaattgtgttggttttggacatggttatagttccaggcatacataactgcttagagttgttttcagacagcgtaagtgaaatgaatgagctaaggaaaatacttaatccaataaaaaatagaacatactcgggctgtctcaatgttttcctacggtatttaagtgccagtttatggaggttttaaagaaaagattttctcagacgagaagagcttataatatacttcctgcaaacattctagaaaatgtaggtccttatcagtcaaccttcagaatggggaaaccacaaaataagtgaaattttgttaacctatctaagtaaacattaaagagttgcttttagaaatgacacaatgtaaagagaccat

SEQ ID NO: 73887 - DNA, 1010 bp, Homo sapiens
tattttctgatttctgctaattaaaattttcaaatagcataactatatgttactcaatatttgctagaaattttttgatttttatatggtttttaatgtacttatcagtattcttttatcatgaaatatttccatctattttccaaacagaacttactgaaatgcaagccaatatattttttcctcaatggataaatcacattgctttaaaatataaataatacatattgtctacatgttattcaacattttttccttcacagaattgtgtttcttacagatatttatttcttgttctgtgagtcaattagctgggtattgccacttttgaacagttggtggctccaatgctttgcaactgtcttgcaagtgtgataccaaaaataagtagctctcttctaactcttcattgcagaagttgataatgacaaaatacatttgagtaaatatagtgtattttatcagaaattaaaagttttatcagatataaattgagaaggaaagttttaatactaatgtatgcttcagactaggtaatatgaatacatattacaaccctcactgtgtgcgcttaaaagatctaaagcgttccaatagaaatataatgtaagccacatacataattttaaattttctagtagccacagtaaaaaataaacaggaatgggtgattaatattaataatttatttaatacgatatgcctcaaatattatttcaatgacataatataaaaattactgatgagatgttttatatgcttttcttttgttggtcttaagtcttcaacacccaatgtgaatttaatacttatagcatgtgtccattggactagaagtgctcaatagctgctgcagctagtggctacaatactggcgagctcagatctaaagtagcaagtggcaacccttctattcacattagatggatcctattaatatttgatggagagtaatttttataagtgaaattctgtaaagaaactctttttgcaccaattttggttctaaa

SEQ ID NO: 73888 - DNA, 1133 bp, Homo sapiens
ttatttattttcccttatgaataaatcataccaacatgtgtacacacttagaggatgtataccatgttgtattttgtatgtatttaaaatttctgtcctaggtacagatatcacattggatttctacatcttaaagttttaactaaagtaattggaatttctttttatgtgctatagaaatccaagctccccacgaagtttctgcacatcccaaggcttgcagtcacatagtcactcctacctctgctcccttgcttttaaaaaatttgctgttgtctgcctctttcctgtcatattagctgtatatgatttttttctcaatttccagttcccaaaacacacacacattatatacatgcaacccactcatgatgtatgtgtaaaataacttttatgaaatgatgattatagaggaagacaaagtctaaagaccacatactttcaataatttcaaattgaatgttgatttctatttttgcaagtctttttcagccctccaacatcaatccatgaagccgccattctcagctcattctctctggcccagagatctcccattcttgtgtgatactctcctctcctccccagatagtgagataatgtatcttccagtctcttacatttattatataagcagagaaatattaaatacccaccgcagggctctgaggatgaatgtaaactgaatgctttttgatcagcctgttgtctgttagatattttgggagtaacaatttttccaaaccaaacatacaaagtatggtgatcctgtataaggtatagacaaagtgtataatctttttttttagtattagttaaattgagttcattttatatttccaaatgttaacttttttttttctttttgcaaaatgttaacttttgcaatccatggaaagaaataaacaattattagcttcttttaaaagagaaccaatttatcttaggaatgtttgcttttaaaagcaataataatctgcaaagttaataatttttttaagatccaaaatatattgtatttaaatgattttttatttcttatactaaatattttaggaaaaagtaaaatcagcttaattaaaatagcatttttctaattaatgtgtgaaaatatatatcaagggaaaattgta

SEQ ID NO: 73889 - DNA, 1021 bp, Homo sapiens
gaggggagtagtgttactttgctacctctttcttctgcttcctttagcttggcttatgacagttgaattttccaacctggcagggcagggttagaaaatcagaatggaatcccagaactgcagtttcaagatatttaggaagtggctcagtgagaatgctatatatcaagtgaataaaataaagctacagctctaaatgctaggaccaccctgaaccacccagcaccactcacgacagctaaaatgcatggagcctttatagcatggcaggtaatgtgctggttacttttagtatcatctcatttagccttaccttcattagggaaatgctattttttgttttcattttatgagcaagaaaaatcaaagctcagagtatgtataacaaaatggtgaagccaagatttgaaccttggtactgtgactccaaggctcatatacttatgctctcagatctggtgtatttaggagaatggatatggtcttaaacacttttattattcagcaagaatgatttaaagtaaatcaattacacttcaagccaagaacttagaaaaatagtaatgaagtctagaaaagagagataaagataaaagtggagataacttagaaaaacatcaatatatttactatgcatgcttcattaaaaaataaagcaataaaatcagtacagcacagagagaaagagagagaaattccaggcatgagaaagtaatatacaagacagtgaatacactcagaggaatggtagagcttttcagaatgatgagagattatgtctttactttttgactaaaatttctagaaacaatttgaaccaacaaaaatgactcaaggaaaggaagaatcatcaataactctgcaatttattaataataataaagttgaccaagaataccatttattttccagctccaccccttctgtaaaacaagcaaataaaaagacttttaaaaacccagatgaaattgtgagcaatttaattcagatggttaggaggctaatatttacaattaataat

SEQ ID NO: 73890 - DNA, 1026 bp, Homo sapiens
ggaccatgccaggaagcaaaacaatctcagcctttggccttgtggaacagacagtggcggggaagatagataatgaacagcactgaaatgctacacaagatagataatgaatagcagtgaaaatgctacacaacagaacttacagaggagtctgggagcattaaaaaagggtgctccaaatgattagcacaggccaccgaaaggaagcaaaacttaaacaggtctgtgaatgcaattgagtaacttccataaatctttttccaacaccttctcagtctactagatattctttagaggtaattaggtacttgaatcatgtatgtgattccaaaatcaatgatttagagccatctacaacatactccttccaagtctgaatcagagacttgacatctggaattgtgcagttaatgaaaattggggttggggatatttcagatgaaatattcttggtgctttattatttttaatgaaatgagaagcagcatttctttttagctgctcccctctgagaagttgcactgaagcataataatacaatttttcttttttgtgagaaaggacagtctgccctgctgagaagacatagtggctttgtcttggaaggccattatagattatatattgctcacctaaggttcggatatttcatgattatatattatgatttaagtataaattaactttagaagaacagaaaataattttcttattaaagttgaaaaacatattctcccctttattctctctatccctcattattcatagaaaccctatgtgttacccatatgtacatatatatatagtaacaataagtttacaaatacaattgcactctttttcccttttaaatatattatcttagatatacattgcctatgcaaatctagccaagttaattctttatacctcagttttcacttctgtaaaagagaaatgaaatgattttataatgtaaagtgtttgagcaatactatgcatgcatttagagtttgtcagatattggctgttgttagggcagtccat

SEQ ID NO: 73891 - DNA, 1057 bp, Homo sapiens
ttaacagccagttcacaaaattccttaaaatttaacagtcttctaggctataatgtggggcactgaaaattatctatacttgagcaccgttattcagttttggatactctgatttaattgatttgggaaagggcacagtccttccttcttctattcttctctccttccttccttcattctttccctcctttcataatttcctaatttagatgtgctcccaggattgagaatgagtgatgtagagcagtgagcttcctaaactttactatgcaccagaatcaccgaaaggcttgcaaaacacaaatggctgggctccacctcccagactttctgattcagtagtagttctggcctggagtctgtaatttgcgtttctaacaagttctcaggtgatgctgatgttgttgggtcaggtatcatactttgagtctctggggctcatactctggttgccattcattgtggttttaaatatggatttctttcagagtgggcagtcaccttttggataatggtttttgtattgttttttacattggttgtgggtgagaatctccacccacaaagtgtgttactgctacaagttgtactacttagatctccccgcatactttaaaaagtttacatgagcccctagggggactaaggaaaagagcagaatgggaccagagcagtctatcccatgtctgcctggaacaaaagaggccaacgattcttcttcctaagtagaatgggctctccacattgctttaaatgggaaatgggcaatggcatttcaggtttctttcaccacaggatcctatttttcttactaatatggtatgccttctgttggtacctatgactcttaattaatttttggtcctgttgagatttctggtcaagagaaattccatccccccaacctcctccttgagctgtttttcctatcctagcctctcaggcacagatctagccatttcccctgacttttagactgttatgcaaggcgactacatttagagctggtcactctgcattttgtacacattgaattaaagatatagcataatacatt

SEQ ID NO: 73892 - DNA, 1063 bp, Homo sapiens
tccagtggtaactagcagaggtaagagaaaaacagccatgcgggtgagtcatcattcctcactccaggaaatggctcattttacaagcttttggaaggacctttgggaagttgtgagctgccaccatttttgaattgaaaatatacatatgttgcaactctgatgtaaaaggcatatagttcctttttcctccacctcttggtttctccttctccttctcttcttgctcatataacctgtgtagttttccgcaggagctcccacttgatgggtaacaggagaaaacattttagtctgatctagttgaaaatgtagtctgatcagttttgcctttctagctgacagtcaatcaagtgggatacttgctgtggtgcagtggctttgactcctggctcctctacttagccttttctgaacctctctgtgccttgatttttccatctgtaaacaggggtaatagcaattcctatctctcatcactgggattgtgctacacgaatgaacacttctaaagctcttagaatagtatctgacaagtacgaaaggctgtacacatgcttgtcaattaacacagagtagaggaggaaataaatctcttagattgcggagtgataaaggagtgactctttctcacgaaagaaaactgagggtcctagggctctgcccatttccagggccctgctggcctgcatatctgggggtggtatactttgtgatctgctcttattcaagttgggaaggaccgggtaactagtccccttcctttggtattcaccctcacattggcctttctgggcatgaagacctcctgagtcactggtttgtcactcaactggcctctggcccacctccagccttgatcacttggcatggggggaccatgacaagcctctggtttgcaactccgctgctttctgagttcttcccaggagggctctagggattgctgagccagaccagtgctacccaggtgaggggtgtagctctccctctgagtactctgtgccccaaagttgaccctaaagttggtccaggtagcccaccaggcaatctcttcacagaa

SEQ ID NO: 73893 - DNA, 1039 bp, Homo sapiens
ccattactttcactataagtggaatggtctacacttacctttcttaaaggataaaatagtctcttctcttttctctcgttatagcaaaagtatcagatgattggcctttccatatagttgaaggtcacccattaatgaaatgaaacagaatcaaggtaaactatggaaattacagtaagattgttaaaaagaggcttcatgttgcaacactgcatatatgttctgataaaacagaacatttattgagctctctctaggtcccacatattgttttaaactcttgtagtatctcgcataatccttacatcatcttttcatcataggcatcatcaccacattttacagatgaggaaactgaggcagagaggaaactggggcagagacaattcacttgtccaaggacacaggtgggaaagcagataagccaggcagattctaaagcccacatacaaaactactatctaggtgaattatatgatttcattttcaaaggagaaaattaactttttctagtattaaatttctcaaatcattgagctacataccctgtaatgcaattctttccaaatattaggaagcatttagctctcagttgttagagaaggtaagaagtagtaaaaaattattccggtattgagacacttctagaaacttccagtaagatcaagtgatagcttattagtttgatagacattttagtcattatgggtaaaactttgtagtattacattgtcattactcgggctgtttgcatctgaatgctcctcttcagtttgagaaattcccatcctcttgagtcttcatgggaggcagagcttccctaaagttacagaaactgaaaattccagatgcttgctttccccagctcctttgcatccaaggtgtgggtacatgacctacaatagaccaatgatatatgccagtctcagtctttgctttggctacttgtaacacaaagaagcagcaacagtgaagaactcattctgcaggtagcagtggccaaatggcactcatggaggtttcagcattgtcctcaagt

SEQ ID NO: 73894 - DNA, 1051 bp, Homo sapiens
ttaccagccttctgagcacttagggagtggcggtgaaagtgaagtcattctgaattttttgtccctccttttctcccttccttctttcctgatgctgttagtgtttagtgatacaagttgaacattggcattcccaaatctgatacctgaaatgctctaaaattccaagctttttgagttcccacatgacaccacaagtggaaaattgttagatatagacacctttgctttccggtggttcaatatacacaaacgttgtttcatgcacaaattattaaaaaatagtgtataaaattaccttcagactatgtgtatgaggcatatttgaaacataagtgaatttcatgtttaaacttgggtctgacccccaccaagatatctcattatgtatatgcaaatattacaaaatctgaacatgtctgaaaccttgggtccacattctggtcccaagcatttcagataaggggtgttcaatctgcataagataaaagagcctactgagaaatttaattatagcttcataagaatgtctagatcatttaaaaagtcgccaatgagaacagaggattccataagagtgttttggccaaaagtgagccaatgacatagaggcagggacattggccaccaaggagtgtgaaaagctggttctggggtgaggccgattctcgcaggaggcctccccgcctggtgtctgttctcacccaggaattggccagcaactcatccagatctttctttactcttggaaatgccagtgtggttcttatgttactgggcatgcctttgtttcatcttgaagaacttatcatcacttcaacccattcaaaagatatgagagaggagatgtgcaattgagtaatgattaggaatgtagcacatattgcatttataaaacacatcaaactatttttcaaatattagaaggtgtaattgagtctgcaacacattttactaaagatatttcctttaatttttaaaaccatgtgtattacggggggaaatgagatccatatgtttgattcttgcacagttaaatgatatattaaag

SEQ ID NO: 73895 - DNA, 1109 bp, Homo sapiens
gtgtcgatctctttttaagaaaaataatgcaatgcagaacaatttatatgtagtatataaatatttatatgccgaaattactaacataaatatatgtatatcttcatatccacttatagacaaagatatatgtatagggaaaaatttaccctatgttgataaaacttgtatgcacagttcagcctttcagtttagaggatcaaatcctaccaagagggtcaggcacattttattttattttgagccgtttgagatgtatgtgaattccaatttatataaaaggatttgtttattgtatacagctgtcattgctttcaggagtaaaaggtgagcagcacagtctgaaaataaatattgaaacttcttttacattttctgaattgttgtactggtcatgagaggctgatattgcatggaaaaatagctcctcttttgaaaaatactattttatggcacatggactcacagagtaaagagacattttctgttagtatcatcacttgaacatgcacttagcaagaaactgaatatggtagaatttctttactcagttcaaaggattactcatttttgtttcatagtgtttggtctgggctctaaatgaagcaaggaggttaatgtaacgagactcttggtaatcatgcagaaccatttgctgacttgataaggttcaggtgcaaatttgtcaggtcatctagatgcttgccccaataaagaatgtttgcctgtgacttttttaaaccatgaaaaggacaaatgcaggcagtggctgctgggttaaaatcaaataaaaataacacaaatgaacaagagaatagagggatgatattgtacgctggggcatatcaattaagaactatttccacaatctgtccagaaattcagtgataatatgcactatacaactatccacccttacgttcttatttttctttttagcaatgagggaaaaaatggagacaataaaacgagtaaattggttcattttattgtaatcaaacaatttggttgaagtctcaatgatactcactctgcagttactcaggaaattttatacaaataatgatctttgatgtatctgattttcaaagcaacatagattagaggaa

SEQ ID NO: 73896 - DNA, 1055 bp, Homo sapiens
tgtctttaacagaacaaaaagtaaaaagtaaaaaacaaaatgattttccccaccctccccccttcacctcagctaaaatgtcacctcctccagaaattccttatcatttggttgtaccactgtttgctgcttaccactgtcttaagttgtaattacgtatggtcttctctctaggtagggaacaacttgagactaaagacgttgtgactcacatgagtttgtataaatgaagaaaatgcgatgggacataagtagggtgtggggagagccttcatggggagatcatacttgacctgagtcttcccaaaagcaatccctctgtcttacaatacagctgtcaccacaattggcttgataaaatatggagtaacaaatgttaggttcacctagactaatcttcccttcctatacatgaagtacttggaggaaagagaaagcagtaaagtgattttccagagtcacacattctgacataggcagtgccagaccaaaaatcagtcacttcccataaggtggatatgcacactcacagaaagaacgagcctatgcatagaatgatctcattttcaagtaaaataatttttgagatacaaacatcagcaatgacaaccacaccccattccccagatcttgcatgtacccagatttattataaatattttgtgataaactctaatcagagcccagtccctcagtttaatagtcatagatttcaggattttgcttctgcttatcttcccaggctttcttcctcttctgtcttcttatggactggagaagtccttgtccttctagcaggcaggcacaccactttgggtttctgtttgtttttgtgtttttcagacagggtcccactctgtcacccaggttggagtgcagtggtgccatcacagctcactgtagccttgacttcctgggcttaagcgatcctcccatctcagcctcaccagtaactgggagtactagcacatgccactaggcccacctaatattttcttttttcttttttttttttatagggatgggggtctccctatctttcctaggctagtctc

SEQ ID NO: 73897 - DNA, 1314 bp, Homo sapiens
gggaaaataagtaagttaatacacatgaaatctttaggacagtagctgacaaaatgagtgctagttaaatcattactattactattattagtggtaatatctttaaaaataaattctcacaggtttttgagattatcaaatgcgaataacccaacccatgccaaagctttcagcataaaccccaggtgatagaagacttgggttgaagaagagtgtgggtcaagttttcaatgaatcagaggaagcttgaggttagtagatgatacaacaggtaggagcagagggttcttaaataaaatggatgaattacatacaatttttttaaatacttagataatttaataatggattcacaatacaaagtggggaaaattccggcctcattttctcatcctagggttcaattagggtgagaaaagaacatttgagtaggcagcaaggcagcgtccatagagtttcaataaaggcaaaagatggattttgcttatagagacagtttgggcaatgtagatactattttttttttttttttttgagatggagtctctattgcccaggctggagtgtaatggcacaatctcggctcactgcaacctccgcctcctgggttcaaacaattctcctgcctcagcctcccgagcagctgggattacaggtgctcaccaccatgcttggctaatttttgtattttagtagagacgggatttcaccatgttggccaggctggtcttgaactcctgaccttgtgatccgcctgcctcggcctcccacagtgctgggattacagatgtgagctactgcgcctggccgtagagactatttaatatcattgaaagacattctaaaacgtgtagtgcaaggggaggtgtttgttgggattttgcaggaaagaagaaacactgccatcagtgaaactctatcctagggcttacatttccatgtgaccaaggctgtgaggcatagtcagtgcagccagcgcgaggttttcaaagaattgctgctggcttgtctgctggtagatggcagttgctagccttgtctttaggcactctcctggctttccaaaggccctgctcacagttctggaaaatctctagaatcttccacatttacctctgtcttaacttcctcttggttttccccactttgattcaaagagtctgtggctccatatgtagacttctacctggatttgagttctccatagttttcactatgttttggagaacataggaactgttattgagaaattattctgacacatgttaatgacacaaagacagatttcattcgaggtactgcagaacggaagag

SEQ ID NO: 73898 - DNA, 1074 bp, Homo sapiens
tgataaattatctcttttgttgaaattgatttgtgttactgcttttcatttttgagcagattttctcattattcgtttatatcaaagtgtcaatagatcctgagaacagggtacacttatgtcctgtgtatatagtgtgcattaaagggccttattcccaagtcaactttcttccacgttgtgagtggcatatgtacacctattgcttgctattttgagttttaaattatctaagcaagaaagcctgaaactaattaaactccagtggtttatttattaatattaatttacaacctgatggcttaatcagtatcctgctttcttttttttctttaaagacttggcataattttacatagccttgtgattgctttgaaaaggctgtagtgttcttccatcattagatgacaattttcttttctagtttgaaaacttagcttaagttctcaagtcaatatgcctatagtgaaccatttattgaaggggtgttcattgcgaatagcatggccaattaaatgaagaataattggtttagttgagcaccttgcaatacttctctggtttagaatactgcagaaactcaatggttctttctcatgctgtgtgtgattttgctttgtttaaaacctgatgtgcctaagtagatttaccttaccagtagatggtttaatttgattttaatgatattctatttggctctataaactgtactgaagccagcgctgccatgctgttaaaaatgtaatctattctataatggcattaggtgataatgaaagcagatattagagacataaccattttcatatttaatagagaagcaatgtgttctaggtaatgaagttaagacttcacatgacattgtcagcacatgttaactctatgttttggaaggctgctttttagacctaagtaaatataattcaaaatgcccctatacttgtttatctattagatgctcttgttttgttttacacatcataactgccaggatcatttatttggcagagcctcagaataaaaacaactcaaaccaaccaaacaaacaacaactaagaactaataaaatctttg

SEQ ID NO: 73899 - DNA, 1022 bp, Homo sapiens
ttacaagtaaatcattcatttttggaaatttaagtcaaccactaaatattaatattctttatataattttacattatttcactaagactaaaagtgtacctaagattggttgttgtgaagttttaaaaatgtgtatgcttttattttaagagattaatattatatattattaggatattatatgagcaaacatgttttcttcaatttttttttaaccatgtatgtagtcagtcattactaagagagagtgagtggggagtcactgccccatccctttatctctgcgtaccactgttctgaagatattttgttgatgacatatatgagcaagatatttggacaaagagtctgttttctgatcctctagctaatatgcatatatatgaaaaaaattaataacgttcatatatgtgctgtcttttgttcatgctcaaagcagtctcaatgattttttcacaggggtgttctcctgtatatacttgaggccaccatcagatttttaaatccaggcttagaatagtgactataaccaggtttatcttcttttatgcatccatggtatattgccttctaaactgtacccaaattctttatcagaatcatttttaacaaagtgctccaagctgtaaccttcatttgatgaaccttgctctttgagtggagaactattttttattcatgccctagactattaccaagcagagagcttgaaggcagtccattgtccagatatactaataaaatcgacattcatggctagttttcctaatgtgtgggtatatgtcattatccattcatggtttgtctttcatgcttttcatacacatcaagccaaatgtctgggacacaaagatgtccaatatttccttaatttcaaggagctcataattaagtgttacaggagaacacatgaacaaattattgtgcaggttgaataaagctattaggtataatgtgaaagtatgctctagggcataaagggaaaaaatgatgagagtgtttatactctaaactgctatcat

SEQ ID NO: 73900 - DNA, 1012 bp, Homo sapiens
ttttaaacccatcaagttcaaataaaaaatgatttttcttaaagcaggagcatttatatttctctctagaaaatatcagtaaatacactcatctaataaataaaagaagttgcatcactaaggcactgccccaaatgctccatatctgtgagcagactagacaacaaaatacaagttgcccctgatcttttaccaagaattctcagcccatttcaacatctagtgtgagaccagcattagctacctgctggatgggctttctggtggggttacatctagaagtacagaacttctcaaactctctgtcgtgatgaatcagtcttcctcttcctcccttcttccccctcctccacctcctgctctcttttttcttccaatccattgcagattggttctctcataaaatacagctaaattaatttatacaattgtataaaaagacacataaaatacatgccccaaattgttattattagatctaatggacaagaaaacgttgacttgctaccaaaatttctaagtttattcttttttaaaacttttaagttcaagggtacatgtgcaggtttgttacgtaagtaaacttgtgtcatggagtttgttgtacaaattatttcacccaggtattaagcctagtacccattagttatttttcctgatcctctctctctttgttcaccctccaataggccacagtgtgtgtatatgtgtcaatgtgttctcatcatttaaatcccacttataagtgagaacgtgtggtattcagaaccagaaaatctaagttaattcttttttttttctttcttcttttttttttttttttttttttgagatggagtttcgctcttgttgcccaggctggagtgcaatggtgcattctcggctcactgcaacctctgccacttgggttcaagcgattctcctgcctcagccttcccagtagctgggattacaggtgcccgccaccatgcccagctaattttttttgtatttttagtagagatggggtttc

SEQ ID NO: 73901 - DNA, 1052 bp, Homo sapiens
tgatatcagtattgctgttgctattgtagtattatattttgagtatagcagggggcttgagcctatctgcatcccgagtaaacagcatctcataccaaacacatggaaaaaaactctaaatgaatgaaaaaaaattaaaaattaaaaaactgcatgcacatactctttcccacatcaaaattaagaatagtaatatattttgtaatgtatttgcataacttttgaaagaaaaggaacagagtcattcattggagtttcatacacccacacaaaaataaaaccccaatgaatgcataatgcatgcaatagggccattttgttggtaaaattagctgatgatggattttctttggtattttcaccacaaaacttttaaagatgatgtttatgataaacctattttttattaaattttaccacgtcttgtttggctttaaagtgatgttctggtacaagatatcttaaagaataaaaagcttactgtgcatttctccagcatgtttgctgagatctgaagtgtgtaacagaattcttcagtgaggtaaagaaaagttcaccatagtttgcaagactggttcatgtggaatttataagaatggactgaccagcatgcccttttaaaattccgtagttaatctctttattgaaagctgctggactacttgattaagaaagctttatggaatgactgcttttagtgtcacacaaatgaagctgaactgttgctaagtaaatcactgtagatcaaagtactttgtagtcagagaactgcagttcatttttttttcattaagttttaaagagaaggtgaagggttgaagaatgaaacacaccaaatttgacatctatgatgtccatttacattcatgcacttctttaagcatctaatctgagtgattaggcaagtagtgcagtaaagcataaatgggcaagtgtaaagctgaatgaattaatacttgtttcctgtatataattgcccagatccttcctagccattaagaaatcagtaggcaagtagagaacacttcgggtgctcccaggaaaactgaagt

SEQ ID NO: 73902 - DNA, 1031 bp, Homo sapiens
caaggcaatattttctatacaattatggagtctattagaaagacttcattttggttgaagctttataatatcagacatactgttgttggtaaagaagatttaaactgagtctattagcctgtatctgagaggtagctgatagaatgcatataatgagaaaattgttcttgaaggacacactaaacaactgtggtttgtatttgtttgtaattctgttgtgaccagacagatgggtgactataaacaaaatatcttcctattcccttctgagacatatgcagggtcgtctttccttcagcactgtcatggagcagcacgcaattagctacagaatgttagccaccctgctggatgcaactccacatctccctctgtggtgtataatagtacaaaagtgacattaaacctatcaaacaatcgtattcaggcagcatggcatcacacaaccccagctgtttgtgttagtgattttgtttttcaccagaggagatttttggggtgaatgtaatgaatggacaggctatgcttacttttaatgaaccccaagttaatgcttcggtctttttctgtccatttaaatgcaaaggagcacatttcagatcataatgaaataagcacactaatacacaacctcctttcttcattctgagcctctgcttccagaattaatagcttcctggtagggcatgtttgacattgttgctaaactctaaacagggatctaattcagagacaaatttacatcagcttatattttgacttttaattcctctggcaaccaaagaacaaacaagcaaaccaagaaagtataaagagtgactttatgaagataaatcagaatgacctgtatgttgaatccttgagaatacatctcttgtggtttcattatacttagattagtgtgtcgtctgtggtgatactctgtaaagcaaaaaatataggtcagattaacaaaatgaatgcaaaaatcaatgcctgcaagaattagtgattcaaaagatagtattaactaaacaaatttatgttaatca

SEQ ID NO: 73903 - DNA, 1030 bp, Homo sapiens
tatataaactctgtggaaagtcaccagtatatcacaattctcttggtctcctccttgagatctttttgtggctacttaaataaatactatgtgtcttttattatggggaagaatctgctttatcatgggtagtgtgcctggtaatcaaggaacaacttttaccaactttgctatgtgctgtatcaccaagtttgttataatgatatagaaaaaagggagttcatcatggagcagtgctaaaataccagaaattataataataatatactgccatttaaattaggagcagtgtaatttagagccatagggaatatgaaatgttatttagaaaacgattatcctctcctacaagtctaataactatcttctaagccataactttagtataaatttaacttgtcctttttcagggacgtagtagagagattttaaatgatataattacaaccaatgtcactccccataactgatgtctacctggatcagattgattgtgagtcttgatgacaaatgccagctacttttggtcactggagaaaggccatatttctcaagtatgatttgactttcagtaaaataaatccacgacttggttgtacactaatggaaagacctttcaggagtaagtgttgctttgtacagtacaggtttttaatttgatccttttcagatactaagataaatacataagcatatgcattcgttttgttaaagagaaaacatttaagcataattcaacatgcacttcttgccatggctctttttgagtttcaacttgtctaatgattctgccaccccctcagggtgggttttcatttcttggggttctttttcttagcttttaagatttagtggcctatactaaggggcacttatcttgctacaagatagcatgtttcattggctacattcactctggcagatgagttacggcagattctttaatatatatattttgcttttttcctatagatggaccctcatagtgttttgacagttaaaaaggatggggggttattgaacgtctagt

SEQ ID NO: 73904 - DNA, 1031 bp, Homo sapiens
tcccataactgttaatcaattgtagaacatgttctctaagcaggacagaaagttgagaaagagctaaaaatatcttaggattccatgtttataaaagaaaaagtcaaatgtccctgaatattgagtaatacatttctcattgcttaatattaggagaatgtctagaaacactgtttcagaattttttcctttttatttacatccagaaattacataaagcaaaaatgtttttgttattccacaaaggataatatgaatttcaagtaatttattgctttcagttgttttcagatctgtttaaatgtgcttattttttccgcggttgctaagttattgtagttggacttgatcgtctctctgggaatgatttcttcttgagcattattttctctgctcagatgattccaccttctccaccactccgccaccaacagacttctgatattttcttgactaatggaggtgtgatcattttctcttttgaccttataaaataatgagagctgctggagtgccctttgagttaaatcaatagaaagtgcttcatgtataatatctcattaatagagatggctaatggcaaatgtgggacagtttatgcagctgacaagcaaagcacctgccagtatttaaggaatggatgacctgtgaccaccgagacacttgagaaaaagtacaacttccgtatctggtggaaatctgctcctaccctcctttgcaagagaggatattgtgtctggcttttctttggttcatagctgtgccgcttcttttttccagatacattttaagggtttcagtgtgccccatggtgggttccctgggaaaaacactctgagacagatatttgagtgcaggaagtttatctcaagagagagaaagaaacaggattgggcagaaggaaaagttgagctttgctatagttgccacgaggccctcagctggtgtcacctctgaggccatctgcctctgtgatggtccttcagagctctcaagattgaggcagggaagctcagccctcgtgccccagc

SEQ ID NO: 73905 - DNA, 1049 bp, Homo sapiens
attgaagaaaagaaagaaataacatctaaagatctgtgtttcatggacgtttgcgaaaatggccgtcacaactcatctggtagaccagaagaccaggtggacgtgacttatattaaatcttgccagagctggacatctggctcttcagttgttctggtttcaatttggatgtgaagcaccgttcttagtgtgattcaagtactagatccacttaaagagttcttgtgtagcccaggtctctgccatgtttgagagctgtggtttgttttttgacaggaaacctccatcagagtttattgtaggtatctcattagtaatttttagcatgccactgtgtaccaatgttgaactttatcagttgaattagagaccatgttaggacctgaatgacaacttccctaattaacctgaaccacattctggaacgccttttgacatattgttgccttgtaagtaaatggctccacttttttttttttcttttttcatacaaagacagttttctatctatcctcaagcacaccaaccatgttgttgttgttctgacttacggcatttgcttgatttattttccaccctgctcttctttgcttacgtaagtcctcaaatttctgcttaattgtaatgatccctgactaccttataaaggcatatctctgaggtatggtggattcagtaccagaccacagcaataaagcaattatcaaaataattaagtcacacaaatgttttagtttcccagtgcataaaacttaagtttacactatactgtacactgagtattcaatagtgttgtgtctacaaccggtacatatcttaatttagaaatactttattgctaaaaaaatgataatgatcgtctgatccttcagtaaatcctaatctttttgttagtgccacaacttgactccatgtttttggctgctgattgatcaggagggtagttgctgaaagttggggtgaatgtgacaattgccttaaataagacaacagtgaagtttgttgcattgattggctctttctttggtgaagtatttccctgtagcatg

SEQ ID NO: 73906 - DNA, 1022 bp, Homo sapiens
tgattagtgggaattaaggtaattattataaattaatggctgtgtgagttataaaaggttagatattatggagttccattgtcatggagggaggcaattaaagaaatatacacttatagactgtaccatagatcttgtgacatttctagccactttgcctttcatcgttttactctatgtgatatgatcagtgttgtagtcatgcttttacagatgcctactgaaattgcactattttatagggaagaaaaataatttttcatgaagtcttacaggcagttcaatttgattatgttcttaatcactctcacctagacttggcccttttactgaattggtctgaactagtttacagctcttgggctttgaacagtaaatcttaaaattctaatgtcagctgttatatagtttagtaagaatgctgatctgctgctatcaggagcaaaaacgagcactttgaaaattagtttattgtatatcaccccagactcaccaaattcaatagtaaagtggctaactttgagtaagcaaagagggctgtgggactgcaactgcaataaacttgaaattgattgtttgtgggtgaatttatagatggtagttggtttgatttatgcattaagagtcagagagagtgaaagatggaaatcagcatctctggtcagctgagttgtagaaggtcactgggaggtggtgaattactgtttgccatggtttggcaagcagtgttgaagctgcttaatgagatctaaccaaacttgtccataaagatgacacatgcaaaaaggaaaaatattattcagataagataccattcaggctctaggactaaaaacatctttggatatttgaatatgaagtttttggcatcttctaaggtaaatatggcaaatgagttgtgagcaggtctgaaatttgcaacatatttataaatactatttacatttccctgtcttgagttagcgattagcctttcttttggatatgaagacaatatatttatgaaacacaaatggaaaatg

SEQ ID NO: 73907 - DNA, 1022 bp, Homo sapiens
cttcacaaaatatttcttgccatttaaacaaacatctgcatgtggagtaaagcatattgatagatagccaacatttcacattcagtgaagaactctttcctttatcctaagtgataatagtaaatttaaagactaattaatttctttcactggaataataagttctgggaaaatatcagatattttaaacattggaagtgaagagaaagttgcatctatgaaaaaataatttttagtaagattgatacacatttatatcaataattgcatactatatccctatcgatatatatatatatatatatatttgttgcagttcttatattctaatactgttttcttttccattttccccaggaaacaaaaatgaacatgatcctaaattacactttatatttcacatccgctaatagggctggtattgggaaacagtgccaaatatacaagagccgagcagttttctatttgagtatttgtttgcaaaacaagcccaggctaatggaggatcatttgtaggaagctaagtcatgctgggtgctcattgataacttagaaagactctctagtttgcattcccccaacccccagttggagatagtcatatgtgtttcaattaaaatatccatttacttccagctggcaacgttagtatccattctaccgacagagagcaaaggtcacaggctcctgcctgagcagacattttaaaaaatatgccatttgccttccttgtgaagatacctttgagccacccattgcaggcttggggagaagattttgaagggtcaaattgcatggggactttcaccttatttactgatatagctttagtagctgttggtccagatgctgcaactgctgttgctttgtggattgggattcagcagcagctgttgttctttgctacagcgtgtttctgaaattcaaaatttaatagtctgagaccctagtcattgaaaactatgctgaaagttaatttgctgaatccaagtttattttcctgctaagccatagtttgtgat

SEQ ID NO: 73908 - DNA, 1072 bp, Homo sapiens
tagctcagaaatataatataggaaaagaagaagaaggaggagaaaaaggaggaggagaaggtggaagaggaggaagaggtgcagtagtacaagatttttttcagatgggagaaattatgtgtgtgaactatgagaggagggttaattcttcttcattttataaagttgtcctgactagacttgaaattacaatcagagatacagggctttctgtgatttgtattttgctgggattttaaagtataatttgggagggatagatgagaaaggagacttgattaagatgcttgaagtctacaattaaatttcatatgattttcagaagcaattttaaattgtttaggactcataagacgagatatgtcatgattagcatggtgactcacaaagacgattctcatctttgttggtaatagattggaagtaaatgatggagcccctcactgtgtgtggctccctccttacatgctttccagttttccattatccatagacccctaaaaagctttgcccaaaaatacacttttcaaaaagtgcccattttcttaggctatcaaaatattgtagaaaattcagaagtaaaatgtactctgcttatttctcattccttgtatgtcccagtcacttcaggctgctataacaaagtaccatagactgggtggtctgtaaacaacagtcatttatctctcacaattcaggaggctggtgcaagtccaagatcaaggcgcatgcagattcaaagtctgatgagggcctgcttcatggttcatgggccatcttctcactgtgacctcacctggtggaaagagcaaaataactctcttggggtctcttttatgagggtactaatctcattcatgagggctcatgacctattcatcttccaaaagccctaccaatgaataccatgacattgaaggttaggattttacatatgagttatagggggaaacaaacatttagtttataacatgtattatataacctacagatttgtatttaaaaaccttttatcactctgaaggagcacatgcagtcaccccgaagactacattatacacatagcaggtgt

SEQ ID NO: 73909 - DNA, 1743 bp, Homo sapiens
gtatcatgatttctttttctttgaagcaaataggcatatcaattctagaagagaggcatggtatcatgaaattgttgctgaaaaccaccctgatgggtgtttttacataagatatcaggggttgttaagagcttaatgctatactgagattaaagaagttcctctgggtatgcagagagagacggttcacatgagaagcttttggattatctggtggtccagaatcaacaaaacttaaaaactaaattttttgaaggggaataaataattagcaatatcccttagaagaactctccttgttatttttagttttaaataacaatataagtgaaaatcttttgccaacaataaaattctatgcagatattaatgatcactattcctcttgatgccatgtttggttaggtttttagttagagattgaagttgtagaagaggacagagagcctatgtcatggagtaaaaattggaagaaagaaaaagctgtatgctctggaacagtgtttcccaaatgtttagatgtaaatgaccaagataagtcaatttcaaaatctggaaactggcatagtgccacctattcttcaaaattttgttaagcaaattaaaaggctacaatgtagattattaaccccatttcataggaagaacataatctatgatctagattattaaaaggctacaatgtagattattaaccccatttcataggagggacataatctcagatgaaagaacagacctttagattgaacatatttagcttgataaggtactctttatctttatttttctattttgctaaggcaacttggtacttggggatggattgagaatgctggtatttgggaatctccactgtaactcccagcctctgttagattggagtagcttcttaccaggttgtgtttaccttagtacagaattgcatttctatgactgtcaggcaggtggactgtcaaacgtgctaggaaaagcgaagtgaaacctgtcgttaagccttaagggtagccaatgcactttccagagaaggccccaagcttatacctagagacagttgtgcagttttccttggaaagtatttcagaatccgtgtagatgttcaaaaaataatgcagagttcttccccataaaacatgagatatcagagtgttcttaaaacacagaggtaaaaggctctaacacagtctcaccttaacaggtgatttactttattgatcagtgaagagcaccccagatagctaaatgagatggctgaatcttaagaaactgataggagtgtcccactgaatgacagagtattcttgaccccaaataaaggttgtgttgctgttattcagttgagttttagaacacaggtattcattacctaagtgacaaatgcatgctaccatctctcagcatttagtcgtctccttttctccctcctaagagtcaaccttctgtatctcttcccttcttattggttctgaatttgttttaaaagtaatgcacattgtgtgtgtgtgtgtgcgcgcgcgcgtgcgtatgtgtgtgtatgacaaacctgccttactaattgaagatacctcttttattttattttttttctttgagacagagtttcatttttgtttcccatgctggagtgcagtggcgcgatatcggctcaccgcaacctccgcctcccaggttcaagggattctcctgactcagcctcctgagtagttgggtacaggcgcctgccaccacacccagctgattttt

SEQ ID NO: 73910 - DNA, 1073 bp, Homo sapiens
ttggattttcacaaatcgtttagtaagatgttctctgccaaaatatattgcattcataatcttaaatccatgaggtacactttattcaacagaataaaaaccaactattttgtcaccattgagtcagtgtaactgattaacacattgttctcattgaaacatatggctagctcataattaactgaaaataattcagtggccttgtctggctttaaatcaagtaatgttctacttgaggcagccatggctgacataatttactatgttagttatattgtagtttaaatcatatcagttcatttcctctctggtattattctttcccatcaagttctatttctttagctatagaatgcctctaagccacatctgtgttggtctaagtcatgagtaaactttttaaataaagtgtgcaaaatgtgttcttatttataccgaagatgttttcaattaccattaagttcattgttggtctgatgttagcagcttaaatatttgaagccgctctctggaaatcagacacacatccaaattctaaaaatatggtagattcttcattttattgtggttttctgagcaactgttgattgattgcacaaagcagaattccctttgatgaacacaggtttagtcagaatgctctgtgtgggttagtatctgtttcccttgaaattaaccagtctccccattcccaacctttctgccaccttagaccttttcttcatgtaccaccaacgaggccacatccttcacctatttagatgagttagtattgtttttcatctcattgggctgcacttttttgtgatatcttttccccccagtataatcaatgagtgtttattgaatagctagtttctctgtgcttatttctttaggttctatttgatgaacagaaaatttgtccactgtaacagttatggtggtgacgaattgcaataaagatttatttcttgcttatgctacatgaacactatgggtgcaggggaaagagggtgaggttggtgctctactctctataattactcaagagccaggttgccagagccctcaaggctcatctcagaaaggga

SEQ ID NO: 73911 - DNA, 1065 bp, Homo sapiens
ttctggggaggaacataagactgaaccgggggagatttttgtagggaactcatgagaactaagggatagcctcgatgctgaggcctgcagagaccagacatgacttaggacgtggatgaggctcacatacttctgaggcctgggtcatccctttgtgctcatgggatcctgcccatcatggtcactaaattcctttcaatccgtgattcttccataactgtcacgtcaaatcacttacttcaaatgacaaatctttcacttattgcaactgcagcttattcaccatttcagttcgctcactgctttctctattcttgctcacatttctgtttctactcccaggacccatagcctggctctctctgtctttttctgttcaaagtcctgagagaccatgtcatgagtgaactggctaccaccagtcttcttgaatccgacacccttccctggtgtagtcacctctaaccaggggtatgaaagcaaatatcttgctgcctaaacacgggagtgtttgccttggaatgggctgtaaggactcctttccaaagtgtggcgagtggcaccatccttgaaaatggttcagggatggcattagaggagaaagatacatgaactgcccttgtcaacactcttgctgtccaaagccagcccctccacctgggtactgatgtcatccctgcctttctacaagagctcctgctaattggatgatttccctctcttgagactatgatggggattgagcataatttttaacaatctacagccccatctgctaagaggtcatggagaacacatggaaatcacatataatacaggtgtaaggcttctcgtgtatcttgatgaaagaaaattactgaagagaaaataaaattgatttttgagtgttgaatttgccaacccaaaagaataaagtgatgatattattaaatatattcatataggaaataaggaataattttactgaaattgtagcatgaacttagacatacatcctggaatgggagatttgtgatcatatttggccttacttatctaacatcttattatctttatccttgagcc

SEQ ID NO: 73912 - DNA, 1087 bp, Homo sapiens
aagtctcctaatctggaaaaaaaactatgccatttaacattttcaaaagcacgcagttaaaaattctcatttccaagacaatttaggaagtaaaatagagcttttgaattacttatgaaccaattttcctggctatcaatgttatttttcaattcctgatttttcttccatgtacatgttttaagggcctgttgaggtaggtatggaaaaaaattttagcttctcgcagaaggtcagtaaattatggattaacatgtttatggtacttcttgttgagttgcagtgattaaagtgttaaattctttattgtcccttctgaatgtagtaaaacctgacataaaaacacttgcagaaaattaagatttagttaagcttagttttttaaaaaaatcatggacctatgattctggaaggatatataaattcaagctttgtccttgagagtcaatctgtttgtccaatctgttcacattttgtagtctttgcatacaatttacattttagaattcacctctgggaaactcttctgttcttctttagagttgtctctagatttgggctgagggtgagagatgctaaggaataatatatatctaaccattattgcacagctcctttgaactcattaaagaggatcttccaggagattgccttaatttacactggatctttagaagggacttgacaggtgctgcttctatttatttttccttcaaaatgatgcaatagcagcaggctgttaggctctttgacatagctcatgacccatctgagatgagtggaaatgaaaagcaccttctctcctatgggagcaagggttgggttcaatggaggaaatatagagcacagtctctgcagtgagcagactatcattggatcctgatttgcagcaaggtagctgaaaagatttactgcacttcttggagacttagtaaactcatctgtagtacatgcaaggagacaagaatgtacacatgagagaatggtggtcaaagatgatacaagcttaatagtgacaagtgttctgctatggtaatgtgctgtattacctttcttttttccttttcttttttatttattaggagta

SEQ ID NO: 73913 - DNA, 1075 bp, Homo sapiens
gactggggaagctaaaatgaaagaatagcgataataatcagtatgaaagcaattcaactttaatattttaaatatattgtaatttttagggaggcatccccagatgtaataaatgcttcagaagactgctctcactcagtaacggttttacaattcagtagcagaatagctcatcgtacaggtcacctttaaaaggactaaatgcacttaagaaacaaaaatgtttattgcccatttgcagcaattgtttctggatgattgtgagatcaatttttaaatggctttatttttagtatcacgggatgctaacactggaaggtgcttagaaaccattccctttcattctctaattttaaagagcaaagcgtcctgccttggcttcttccttttggtcttgctccctttccattcattttcacactgttggcaaagcaagggatctttttaaagccatctgcttaatgtctctcaatggtttctcattacctacagcagcatttgccaaagtctgtgccatgaacaactagctcagcctgttgtaattggcattattttaaagaacagggagttccacaatcatgtgtttgacatactgggttcaacacaaatggtgccttttctgcaggacttctcaaacccttttatagacaatgttgaccaaacttgtttaggcactgaaacttttttttttttttcccttcctcgaagatctcccgggactgacttgtgattcactggcctgattaataaggtccacaattctaagcgtggaataccattccttcaaaactgacccctgccttctggttcaacttcatataccaatgctccatgtttagattctagatcacacttagaaccaactaaagtaagcttttctgaaaagctgttctgttgtatcttccctctggggtgttttggctttgcttggttaccaactacatgggctttccagattcagttccagtgtcaccaccaggaagcctctgtttgttttctctgggtttttaagggttttttaggggttttttttgggttctctggtttttttagggttatctgacctaaggatggc

SEQ ID NO: 73914 - DNA, 1031 bp, Homo sapiens
tatttttttttgcttttaaagtagaattaggcagcattattcttagaaaatgacatttttatattgaagttcctttagctccatgacttttgaatatacacttctgctatggctattagacatttctctcttgagaggtttccataattctgaaaacatcctttcttcctactgaaattctgttgtcaattactttgtttgtgcagctgagcataatttgtcttaaaatgaaagcaggaaattcagaaagagatttggattctttggtgtttcatcattattggaaaaaatacattgtgtatctccaaactgggactttgggtttactcaacagtgttaaagataaatagtgtcactaagtgtcttttagtgtcaggcctattttggatgtggttctcttagttaattgacagagaaaagatttgagtagtttacacttggctggttaaaaaccagattcccgtcaggaagtactagcatatttttcaaattattaacagaaaatattataaataacagttcaggactaggaacaaacataattaaaagcacattcagaaaggctatataaataaggtccatcaattacaagggtttacatagcttacttccccttgcttgtaaattaccattggaatgaatggtttcaatttcattttcagtggaaatacttacattcatggatagagtattctaggaaacaaaaataggaagatccttttggttgaagggcttcttttcttgaatgcatattttgaattacatgaacataattgaagtaattaaaaattggtctggtaaagaagaaattattgtaatactcttgaacaaaagtaaatgcatctctaatattgttagtgaactccacagaggattactattaaagatagtatgcatatctgtcatttaaaaggtagcacctcaggtggactttaaatgacccaagggtatcttggtacagagcactaggagttgggaaatttagttcatgtattttgcatgttcatcctgccaaatctgtccaagatatc

SEQ ID NO: 73915 - DNA, 1024 bp, Homo sapiens
tatcagatgcaaatccttatgatttatataatttgctcaccaagttgacactaaaaaatatatggagtaatgcgcaaaaatgccaagacactattgacaaagaatgagagagaagatatgtcctttcagattaaaaactatcataatagggcaatcatatgaaatataaaacattgaaccccaaatagaccaagttaatgaaatgcagggaggtagcacgcatcagtagggtgggaaaatcaatataaagtatgtcctcacctgtcccctgtgtatcaatattttgttttggctttgggtacctagtttattaagtgataataatctgatcaaatgatggttttgcctatcaagtctgcctgtcttttcctgtgtgaacaccttgaataaaatagaagactgtgccccttatatgtatgatcaaatttacctattaaaataatttttggggagtcctaaatggagtgtagtttttctatccaatatttctgatatattttgtcctgttttttttctcttctgtgtatgcctacccaatttatattaggtggtgtaaaattaataccagtttttgccatttttttaagtatgacaataaccacaattacttttgcaccaatcaaatattttcctggggaacaaaatcaattccatttatatttcctgaaatattaggacaagactgctaataatatatatttcagaagataatagcgtattttaaaaattgctaatgtattaagccgcattttaaaaaaatttctaaaagtaggcaacatacagaatgtattttcaatcaaaatataataaaattatatattcacttcaaaagaattggcaataaatatatatttatgtatgtatttattaaaaacctcttagcaatttaagagatgtatctggatggctctttgattaaacagaaattaaaaacataaattttaacattttagaaatggaggtgcaaaaacacattttatccaaaatataggattcaatattaagattaaaaatttagcaataa

SEQ ID NO: 73916 - DNA, 1171 bp, Homo sapiens
aaaagaagtaagcatggagaggctggagagggagtaaaaccatttcttgttttggcagccttcaaaccttgtcctcagaacttgagagtttttaactgcggcctttcttgaagcaaaaagttgatgacctaggagtgacttactaaatgcaggtggctggtagaagaaataaaacaggacctcaccccttgctggaatgtgcaatttgtggtaaaacttgagggcgcattatgatatgttgacagcattcctcttgaaagatcaggacaaaaatgaaagctagagaagcaaactgcatttagattgtgcagttgctctgtggtccacagggctttgtcatgagggagtgtgggatacagtgggatacaatgaaggaaaaggttaccgaagattgtaggggtgctcattccctgcattacagtactagggagaaaatgaagagggccatcgtctgtagtcagtgatagtgctaggaccagttgacaagtgagttagcttttatggctctttctggatctgaattctttttccaacaggaatatggtagccacactacatcacaaaactctcatgtgtttttgaggtcttgccagattgctcctcaccgtggcaatgatgtctatggggagaatctgtaggaagcttactgagtcttttagccctgaacagagcacctagcttctgaatggaaggacggttgtcatggaacattccagactgctggaaattagcttggtggttctatctccttcacaaacccaccattgtgttagctttctaattacaggactttgcaaaccaagcgtctattctaaggaatattaattatatcaaatgtattgtatatactaaggatagttactaaagtattcactttttcagtcatgtgtatgtgctgtatattttaagtatggagtatagatatacatgcagatatgggcatccattgtacatctagatatgagtggattatagatatggatgtgagcgtgaattgtatacaaatatggaatattcacataaaggaagcctagttataaagggaagaaagggccatattaaggcatttttattttttgaagcagatctgtccctccttattagccttgaagatcaattctgaaaatctaactaatttgagaaaaaaaatgacagtatatatatgtaataa

SEQ ID NO: 73917 - DNA, 1062 bp, Homo sapiens
gaacgagattgaccttctccattttccaatatgccattgcaggcattctgtgtccaccttacttttgcttttctctgcaactctagttgtacctttttattttctttctgctgtttactttgaatgtgtgcttcagagcgtcctgcatgcattgcttggccattgcactatgactggcttaagtaagttgaacaaacaactatttgtagaaactagaatcctggttgatatggatttatttcaagcaagaagaccaaaatcatctcttaatggattatagtggcctgcgaggacctttaaaataagaagccatattactcatttaattaaggctttgatgaaagtgcttaagatttttcctacaactgtgccatgttttctaatcttctgaagtacattaaagatagatagcccccgttctcaaaggtacttcaattaaaaacaacaggagcaccataatccttggtagaaaatacttggaaaacttgataaaaggagtgaaaggaagacaatcaaagttcaacattcatcgatttatttttagaaaatgcaatttaattaagtatagtctccatctctttacctgctttcactacatcttgagagactcgggaaagctttttttacaatagaagatgagtgaataacaatttctgtgaaaaaatatgtttcttcttaaaaattattggggccattcttcctagaaaaagtaggtgaacaaatataattttttataaaatgttcctatgttgtgaaaatgttgattggtaggactctatactctagaaatagctttgtcaaaacattatatttattttggatgtctttacagaacatttgaatttgctgttagtctcaaagctttttctaagatcagcttttccttaataatcaagcagaagtatgtttttaaaagtactcggaattatgcagccttagacttgaagcaacactgaaaactcacttgatgtcatgctcctcaaacttcttatattttcagactaaagatatctacaacttgtgccagattaccaaccacttttttacctggacaaacaactt

SEQ ID NO: 73918 - DNA, 1034 bp, Homo sapiens
cattaatatatactatttatattataaacttttttaaaaaaaatgagatgagtttaacttacattttcacttctgtgccttctagaaaatagaatcatatggagaagtcaaaactttgtcacagaattaatgtatgccccaggttacctgcattattcatagtaaggttaatctttgggataattattgtcccacttaacaaacattcacagtggtaaattacatagcaccctaaagctacagaaatacaggacaattaatgaaatgcaaaggtatctgatctgattctagtgctgacctcttaaaagtaaaatcattgctattattcctgttaagagaattttcacttcatggaatgggcctgtgcctccaagaataacatggagctgttctcaagttgtttcactttttttgaaagttaaccttttgatatcatggataaaagttaacatttgtaaaactcaagctgttagcccaaatgcaaccttgcctcctatgttagtacattacgtcaatgacaaatgagccataagtttcaactttacagtagtagtagataccttgacctttgagacctcactcaagtcataccatgggtgttctgatattttggtggtgtttgcagtcatgtgcaaagaaaaggctatgttttaagttgtataggtcttaatcagtacagatttctgttcctattcaaatataaactttataaaaattttcagaagttattcagcaaaagaattaagaattcaaatgatgccgtttttaatgaaattataaaattgaaggagatctgcagatgtctcctgaatccttggaaatacgaccaagtcatagtgcagtcattaatggattttgcatgggtaagtttcaagtctgaaacttttcctttgttaagaagtccagttaatcaattgcattaaattaaaagatgaatgagctctagagatctgctgaatagcattgtgcccatcgttaacaatactatattgtgcatttaaaattttgttaggagggtagataatatgttaagt

SEQ ID NO: 73919 - DNA, 1044 bp, Homo sapiens
catttcactgggaagccagtgattaaactgctaaaattacgattctaggtgacaaatctggcagcatcagaaaactagaaaaaagggaattatttcaaaggtttttgattatccagacatgagagataagggcctatattaaagcagaaggaaagaaatatactatagagaatatgataaatgaggtagaaaagaagagtatagtctttcaaaaacttctgtaagttttgaaaatggatcacattggctctcaaaattggttatgtgtaattatcatctgggaaatttttgaaaagacctatagccatggtaatgtttctgaaggcctagggtggggcttatggttgatattttaagtaaatggctcaattgtttctgacacagatggtacgtagatcacgatttgagaagcatcaatttcgtagatagctggagaaggaaagaaaagcaaggtactggggaactatcaaacagctgttctgtgcagtttgctatggccattgttttctggttttaaactttattcactagacatttgttaatttaatattttagaaaacataagtcaggcaccatgattcatgcttgtaatcccagcactttggaaggctgaggtgggaggatcatctgagcccaggagttcaagaacagcctgggcaacatagcaagaccccatctctacaaaaaaattaaaaaattagccaggcagagtggggtttgcctgtgatcccagctacttgggaggctgaagtgaaaggattgcttgagcccaggaggtcaaggctgcagtaagtcatgattgtgcctctgcactccagggtgggcaacaggccctgtctcaaaaaagaaagagaagggactcatcaatatattttgaaaaggaatggtaatgagagtaaaacttgtctgttaacatacattaaaatgatagaagaattttaggaaagtctagagttctcaggtgacttaaggcctccttggtcagtgtggacgccaaacactcagatgttattttcaaaaccataagattagataaaagaagac

SEQ ID NO: 73920 - DNA, 1217 bp, Homo sapiens
tgcattgaccttagaagtaaagagataatttgggggaaattatagtaacacttcagtgatccctctaaatacatctttcactgtaacaaaagagcctctgtggggaattagtgacttcgtgccatgatttctgaatcgtgatacaaccttattgaatttatgaaggatgaggtcagaaagccagacatcacttctaggcttaataatcagtttggatttctcattgtgtagaagtaaacaaaaatgtagttgattccagaggtagcaaaattttatatctacaactaaaaatataatggacccataaatgaacataattagatctgaccaccaaatggcatcaggacattctgactacgggttgtggcttatggccagcagtccatctggggaccagtccatctggggtccactccatagcataagtcacatgacctgtgtaaagcagctgacagaaaaacaaaaccaagaatgccttgaaacatcttatattttatgaatgaatactaggaagtcctttttgtttttctgttctttggttttaggtatttcaaaatctgttaaacaggtgaggctgactagggaagccaacaaatatagcttgtgattttggacagttgtgtttccaagttgagggcacttttttgatcaacttccaatcatttataaagcaaaagatagtatccaattagcgcaaatttatgaagtttgttttatgttacatggggatatcataaagaagcatgtttttcattactgctgaatacagcctgtaagatatgcatagcctgatggtcatcgttcattcctacagatatgatgcctcttggcatatctcttaggtgaaagagtttcccttctggtaatgtcctagggaaaaaggtcacttgtgtccaggagattaaaaccaatattaacttctacaatatgtagaggacaggttagtcttggaaaacactttttaattatctgatcatgtggctagaatatgtaggctgataattagactaccttgctatctgaacaccagaaatctcccctgagcccaggctgagatacagtactttcttctcttagatgcttttggttataagttttttcctgaagttgacaggaacatgaaaactacacaacatttaatttttccttgaagaagtgcttatattttcagaacacatagtccctaattagagtaaattactcctgatggaataagc

SEQ ID NO: 73921 - DNA, 1085 bp, Homo sapiens
attaggaatctgaagattccagaggctgtgtcccaaatatttgctgtggttcctgatggtttctatgccaacagtagattattgtattgcgctggaactaatctctttcttctccaaaccactaggatgctttacacatcttctttgtggtacttaacactgtaggtttaccttaggtaatttcttgtagccatgcacaggttccttatcttaatagtctatcacagaggaaataagacagagtagctctcttgagggacttctgcatgcctttatataccttcaattacttgtttactgtaatcaataagtatttgtcgatggatgggtgactgggtttatggattcagttttgagtcaaaaacatatgcataggttgttacatcgagtgccttttgttgttatcgaaaggggcaccatcatgggatagtttttagatgaaaatttggaatgggggttaggacattttactttgctctttaagttcatctgtgtgtatgatttctatgcatgatatacatcagtaatttgtaccagactgcttgaatagcaagcatattacaaatgtgaatgtagttttctgttataaattttacttaatttttttttttttttttgcttagaaagttatatttttctgggagaaaaacttctcattcctttcctctgctacataattccccatgccttctagatttttttccagtgctaataatggagactcaatttcttgagtgctaagatatatttgccatagtttattatataaccagaaaaaataaaataatgtagaaagcttaaattattaatggggcatttgttttctgttaatcaaatttatctcatttaaccctgtaacactagcgagacatgtcaaaagatataaagaggagaaacaactaaaatatgaacctatcagtggaaatacaaaggtataatttttaaaaagctttaaaacataaaaatgatattaacaactttttaaaaaaatgcatgcccaagtggctatttgacaagtatactacactttcagtctaccctattactttaatgttcacagtgtatactgctatgtttattttatt

SEQ ID NO: 73922 - DNA, 1646 bp, Homo sapiens
tctttgctgagaccactagctggctgattccatcttgtccttctggtatctgtttaaatgtcacctggctagaggaggcttcctgactctgctgtgtaagatagattacccactcccttctcatcactctctaacctcttctcttgctttggtgtttgtcttagcaattgtcactacctatattgtatatatatttattatctttctgtcttttacactagaataaaagttatgcaaaggcaagcacctgagtgtcttctttacctatttccgtagcctataactgtgcctggcatacaatcaatatcttccaaataaatgagtgatacttgtggttttggcaaaatatacaggtacggacaacttcaatttctctaggagccttctgcaagtaaatgcttgaatcatacaaaaacacactctattcaaagtaaaacataaattataatattgatcctgattagaaagcctattattgagtgtttagccaggatgagttatatcattttcgtgaaatattacataaactcgttaagtgaagaaaataagaaaaacataaagaagaacaaaatgaaaggcaggatatagcactgcacatattagtatcacacacacatacacaaatggtaactatcaaaaaaaaagaaaagtctcaagggaaattactctggaaaaagaaacgtgaaaactgtgagtaacaaatgggaatttccagccaagccagttatcacaataaaagttcactgttatccttctatctgatcaagccctgtttgaagttgctgacccctcttaaggagatcctagttattggcaccagcccctttaatttgacccatgattgggtactcagatatattgaatggaagcagaaggattttaggaaaaaaaaaatcataaagtcatatttcttaacctttatttgagaagcaattataaagttacttttcgcactatattctgatgctttccagttttcattttccaaaaagatatttttcgatttatatataatttatctccctcctcttccttctcccttcctgcctccctcctctgctctcaggttccatccaatcaacaacgtagattcctccacctccccgctcctacccaccccagggccagggtacagtagcttttattgaactttctatgggttagttttgagaggaattcaggggaagaatcaatgacaaaactctaagaatttacagctcgtgtgtttgtgtgtgtgtgtgtgtgtctttgtggctgtgtgatatggtttggctgtgttcccacccaaatatcatcttgaattgtagctcccacaattcctacgtgtcatgcatggaagggacctggtgggaggttattaaatcatgggggtgggtctttcccatgctgttcttatgatagtgaataagtctcacaattataaagcagagtttccctgcaccagctatctttctcttgcccaccaccatgtgagaagtccctttgcttttccttcatcttccaccatgattgtgaggcctccccagccacatggaatgtgagaccattaaacctctttcctttataaattatctagtctcagatatatctttattagcagcatgagaactaatacaatgtgtgtgtggcggggggtgggtgtgtgt

SEQ ID NO: 73923 - DNA, 1043 bp, Homo sapiens
ccaaaaaattgtatgcatttatcatatacatgatattttgaaatgtatatgtactgtgaaatggctacattaagctcattaacgtattattacatcacagtggccagtttggattactttaagaggcatgtgaaaaacatgaaaagagtttgaagtagagaaacaaagatgtaaaagccaacatatttaaaaggttatcatttattacacaaatattacacacagcacagtgctactgtgcattttacctactttgtctcattttaaccctcccaacaaacacataagttaggcatcattacccacattttataagggcaggcgctgaagatcattgagatttacaaactcacttaaggccatagttttaagcagtggagcagaaattcaaatagaggtcagaggtctccttaactccaaagtcttttctatttttttttaatcctagtgtagagaaatgtggatgatgatttgagaatgacctttaaatataaagtgtgttattttgtaaaagtctgcaactacatattctttttattcctgggaatagaagaagagaaataaaaagaatgaatctatttgtagcatgaaaaatttgagttggttataagaagtagtttcctgataaaagttgtatgtaaaactgttcttgccttgaaatggagaagtccaagcagaatagattccacattgtgccttaaattgtagcataagtccacatttaccagtatttagtgcagagatgaaagcctaatctagtaatctattgctgtgtaacaaactatcccaaaactttgtggcataagacaacaaccatattattacgctcgtggttctctgtgcctggaatttgggcatagtacagctgtgaagacttgtctttacttcctgatgtctgaggcctcagccagggtggcttgaatgtctggggatgggcagaatggctcatttgaggtaatgtttctagggcttctttctggctgttggctgagttccttggatcttctccacatactgtctttggggactgaaatgggcgagat

SEQ ID NO: 73924 - DNA, 1019 bp, Homo sapiens
tattcacctgtatgtgtgtatatgtgtgtgtgtatgtgcgtgtgacgtgtgtgtgtgagatgtgggtgtgtatatatgtgtattgagatataggtatacacacacacacatatatatacgtatatatcacacatatatatacgtatatatatgtatatatatacatatatatatgtgtgatatatacgtgtatatatgtatatatatacacgtatatatatagtccttgaaaccgtttggctcaaaacacctctattatttagtttttttctttctacagaattctcaaactttccatatatttttcttaagctgcttcttgctccccttctcatcttgcccatgcttagatgctgtcagatcattcattttgctacagtttccattcattttgttgccttcactctgtctgtgccaccttccctcgtggtttttgattctcagaacttttgctgaggtgtcttcacttttcttttcttccatggtctccctaaaacccatctaccactgtgattgtttttctacttctattgaacattctcactttaaggttttatggagcatttaaactccttctttgtatgttccccttttgactcttcatattgtcatctttatcatcctgaatggttgcctcctactttccccttcagactggggttttcagtccatctttggtggaatatttggtctccacttatttcatttttattcattattgtcctggttctttgtgtagaattgcctctccataaataagccctgtttctccttttgtagaacagtttatttttctgtatttgtttctccacatcttgttcattctagcaactttctttttactcatttgacttttcttccaacatttgaaatcaaacatcaatttattttataagtatttcttttgaattgtcatgcaacattctaaactcaaatcataaagtcagagaattttagaggtagatagaaccataagtatcaccttggccagaccgtatgtattaccaaaaaggaaagta

SEQ ID NO: 73925 - DNA, 1055 bp, Homo sapiens
agaggctcctgcagctcaaaattatgctgacctcctctggctcccaggattctgcttgatcttagctgtcctgttttgattcagtagctcccagaataatcccaaatgcacatcatcacagggctctgaaagctccataattaatgaggaggtgggtgctatttttctttctctacatgttttgacattattctgggcattgtttgatgcatgaaggaggctttacgtaaatagtaaaaaagctgttttagttttactgtcactcagtttttatccctgtaataaaacagtaatgcagaatgaatggctcaaaactgaaatgaaatgaagatggcaaagtaaaatagtatcccaaaagttagaaaattaattcatttggtatgatgtaattattaaataaattttacagaagcttctctttgcagtgaagaaatagtcaaattcaaatgtatcataggactttccttagatgacacataaagatgtatgtgccaaaagtatgatctatgtaagtgaagactctgagcagagaaattaaaacatgtagctttcatttttgttaaagaatcttcaaagagaatttcactgaagctagttggatgtagtaacataggggaaaaagtatttctaaattgcatctacatgtgcaaactaaaaggcatacttaggaatcatctgtacaaactaaagcaaaaaatataaaggtttcatctttgtgtcattatctgaacatataaatatttttaatgggaggaagctatcttagataactggctctgaattcatttgaataattatatatagtttaaataagggtttcttcatttgaataaccaaactaacaataagtgaatcaaaacaaaatgtatttttcttatgtaaactaagccctgcagtgaacagcatggggctgatgtggtagctctgtaatcagtgtaacccaggctctttcttactgctctgctatcctgtaatgtgactacctatgggcccaaggtatttgagtgagcctgaccatcacatctttccagccagaagtaaaaaaagaggccagg

SEQ ID NO: 73926 - DNA, 1050 bp, Homo sapiens
ttccaaccactactgaagttctgtagttggggtgtgtgtgcgtgtgtgcatgcatgcgtgtgtgcgtttgtgcgtttgtgcgtgtgcatgtgcgtgtgcgtgtgcgtgtgtgtgtgcgtgtgtgtgtgcgtgcatgtgtgtgtgtgtgtgtgttcttcgaaaaaatcaggagtctatttaggatgcattttcaaagtcctcctccaggaagtttaactcagttccctgcacagaggaattgctcaaaagattcttaccaagtaactgttataagaaaaagaaactccatttttacatgaagaacttttctttgaaaacttccttacaacattgaaaaaatgccgctagacctattttagagtacttaaaaatcctcatcagcctcaggcccgccccttcacttgctttgtagtaagtagtgtatggggttccccaggataaagcacaacccagattccacttgctgcatccaaatgaatggtgtcttacgtagcacccctgagctaggcaggaccagaagaaacaggagagtggcttttagcctattgtcactattagaaactatgcagtgcggtaggagaaaaccctgttttaaggcattaacagtctctgctcaggcacttatcccaggtattgccgtattttcatacaaaacttatcccagcctagcttttgcatgctgcccaaatgcaaaatggttttcttgaaaaatgtttgtgttaaattaaaatctcctagagggagaaacagtttgtgggcagaactcgcttcagtaatatcctgtggttattttgagtgtttggcattgttatcaacgctccatagataagaattgttctatttcacaagaggccatgttgcagattacaactagctcatgaacacaaaagtcaaggctgaattacatttatatagctatagtaaatcttacatctactttaaaattgaggatgtgtgggacagcttctgcaaacatctggtaccttctaagattttatagactatgagaaccagagagagatttctaaaagatgttgccaatgaggagag

SEQ ID NO: 73927 - DNA, 1481 bp, Homo sapiens
agacaatttaagtttttcctttccaattggaagccttttatttttttttcttgtttaattgcactggctaagatttctagtactgcgtttaagataagtgataagagcattcctgccttgttcctgatctcagaggaaaagctttcagcttctcatctttcagtatgatgttagctataggcttgttatatatggcctttattatgttgaagtacatttcttctatacccagtttattgagcatttttcattataaaagggcattaaattttgtcaaatgccttttctgcatttatggagatgataatatgctttctatccttcattcccttaatgtagtatttcatatttattgttttgtgtatattggaccatccttgcatcccagggataaatcccacttgatcatgctacatgatctttttaatgtgctattgaatttggttaggtagtatttcactgaggatttttatcatctatgtttattagggacccaaaagacatatatagaacattctacccaacagtggcagaatacacattctttctaagtgcatgcggaacattcttcaagatggatcacatgttaggctacaaagcaagtcttaacaaatttgagaagattgaaatcatgtcaagtatcttttctgaacacaatggtataaaagtagaaatcagtgacaggaggcagattggaaaattcacaaatatgtggaaatttaataatatatttttgagcgaccaatgggaccaagaagaaatcaaaaggcaaatccaaaaatatcttgaaactgtgaaaataatagtacaacagagcaaaacatatgggatgcaacaaaattagtactgaaagagaagtttatagcaataaacacatacattaaaaaggagaatgatctcaaaaaacctaattttctacctcaagaacctagaaaaagaacaaactaagcccaaagttagcagaaggaaggacacaataaagattagcgtagaaataaacaaaatagaggttggaagaataatctaacaacaaaactaagagttggttttttgcaaagataaaattgacaaactaagaaaaggcagactaagataaaaagagagaagcagcaaataaaattaaaaatgaaagaagagacattaaaaattgatgctgcagacatactaaggatcattgcactactgtgaacaattacacaccaacaaatgggatgtcctagaaagaaaatgaataaatttctggatacatacaacctaccgacactgaaacatgaactaaaagaaactctaaacagaacaccaacaagtaacaagactgacacagtaataaaaaacctctcaacaaagagaagttcatgaccagatggcctcattggtgaattctactaaacatttaaggaagaattaatgccagtccttctcaaacccttttaaaaaattggaagagaaaggaatctttctaaactcattttatgagccca

SEQ ID NO: 73928 - DNA, 1035 bp, Homo sapiens
catggattagggatatttttccctagaagaagagatatctaagttgaaacacaaagaataagtaggatcaaatgaagcagaaagagagagatcagcagtatatatatatatatatgtttattgaatgagtaaataaacgaatgaagacaatttgacaagaagcacctgtaaagcatatcactgagaccttggtgttctgttggtagcttctctttctgaaggcataaggtaaaactgtccaaatataaatttccctcctagtttgctcactctccagaaagctctgagcattttgaaatatattcttatgatagctcattttataacataaggaaactaaagctgcctggccttatggatggagccacatagttatagataagtcagacaccaagataaagagcatttccatgaagtgaggtagaggcaggtgtggaatccaagcttactgaatggtctaatgctgacttttttacacctagaatacctttgtgaaaatgaaatatatcaagaaatgaggacatttaaggaaggcaggcagcagaaatatgtatatcaaaaagctgaaataattggatgagctattctctatgaaaaccacatttttatcataactggaaaagatctgttataaactgaacaacagagaaatgttaagaccttttatatctgtcccccttgacactacactgagagctatgctgttgttatgttttccgaatccctctgtggcttctcttgtaagtgagcaggacactacagaagctgacatgcgaagggccctgataaaccagaatgctttttccatacagtaaattcgaatggttatttgagctcaacagtgttttctctggtgtttgaaaagcaaaaatagaaggatccaccaaacactgcaagtcatggaaactatagacgaattgggtgagttgagggccctgtgatggcagagagatgtctttatccgaggcaatggtgcacaggtagacaagcacactacagcagctctgagacatttccagagccttccttcgaaag

SEQ ID NO: 73929 - DNA, 1030 bp, Homo sapiens
atcatattttattaaatgcaaatattctcacctctaccatacattttgtaagcttccttactcttgcacgcataaggctcttatacttttctttttttcaaatcatgattcaaagagcagagagaaaaatctaacaaatgaagcagatgcatccacaaccatttcctcatctgttcactcttccttcaaagataagagtgtttaaaaatccctttaggctttcagtttatttctgatctttgtgttttcaatcactgacagaggtagattggcatatgtccttggtgttcatagacacagttaaagttttctacttttgctgtatacagttaaggtttctaatgtgctgtggccatttacatgtcttattagcatgttgacatatatttttaacaagacttggtattctcagtaattgccattcactttcctgagcacctgtataccagagctcatcagattcatcatttagttaggccatttggaattgaactgtgatgaagtcttatgcagcagacaagaagacatgtaaagagtatggccattcatcagaaaacagcagtactatctaaggagccatgcacaagactagggtgtcagctagaatattctgcacttcagtttaaaaaaaccaactcaaactggctttcataattgtattagtccattttcacactgctgataaacgcatacctgagactgggtaatttatatggaaaaagaggtttgagtgactcacagttccacatggctgggggcctcacaatcatgatgaaggcaaggaggagcaaaggcatgtcttacatggcggcaggcaagagaagaatgggagccaagcaaaaggggaaaccactcataaaaccgtcagatctcataagacttattcactactacaaggacggtatgggagaaaccacccccatgattcaattatttcccactggctccctcccacaacacatgggaattatgggagctttaattcaagatgagatttgggtggggacacagccaaaccatatcaatactg

SEQ ID NO: 73930 - DNA, 1027 bp, Homo sapiens
ctccacagccatttcttgtgaaaataatggctgcacctggacaaatatatggtatccacactaatgaagatacgatagcttctatttccttgagtataaatggaatatatttgaatttcccaagtagtaatctaacagttcattcattgacactgtaatataaattagaatctcataggtaaataaaacattacccttaaaacatcaaatctaattaaatccaggtaacattaactgttacctggatttaatataaaagattagagctctgtttgcaaatttcaatatttgcctatatgagaatagcagcacctttcccccattatggaaacctgctgagtagaaagtgggaagacagaatttttaaaaaccacaggagccgagacgggatttacctgcagccactgcttttcaggttaccagtagtgactttttaaatgtataatcaagctgcaaaagacaatgaagaagataaagaagataaagaggtaaaggtataaagctacatgtgcctccaaaagagtgggcaccttagtttattttaagagaaatacgttaagatgccctaatatttttaaaggaaaaatacttgtatttagaaacctaagacacagcacttaaacctgttatcaccacacctcctcttccttcccatccctccagaattataaaatgtttctcctttcagcccttcctatcctaatgtcagcttctttaatctcagaatgccaacagacttctgagacattatcttagtaatcctcttaagagagaggattcatgagccagatatcttcctaaaatccacaggttttgcaagtcagctaggtggaaggagaattgctttgtacatctgtagcatctgtctgcattgaagcttccaaatactttcccgaattatctaattatcactttcaacatcccttggagagaagcaggcagcggtcaggaggtggtaataccgattctgtttcttaaaggggtagagcgaatgatttgtaccacaataagttggcttatcctgcag

SEQ ID NO: 73931 - DNA, 1319 bp, Homo sapiens
cttagttgaattttcaaggcattctctattaaacagggaggtgggaggtagggggatgctatagtaaaaatggttatgaatgagagtgctgtatgaaacctaggccctttcatgtttgctttttcatatagggtgacatatgtgattctcactttgtgaaactgctttttgaaacagagaaaatagatatagtactacattttgccgcacaaacacatgtaggtaagcattgttttatgttacagttatgattggcagttctctccccgccctcgcccccctaatacttatatttgaaagaggatatatcatactgtactagaaaaacaagcccacggtgactgtgttatccataaactcagcactttttagatacttttattagcattgcaaggctatattagtgaaatacaaccttgactgctgtctgaaaacttgagtttaaccaattcaggatagtgaaggggagcaacggggagatgggccgtcaactgtattttttatgttgtttttcttaaattttgttgtgggtatgcagatggacattatttatatcattttatgaattttagatattttctaataatttgacagttttattatgaaatataacatattcaaaagcatttagaaatagttaaataatgataatggagtacccatgtatctgtcacctgaacaaaagacagaatgttgctgaatcctcttcagtagtaaatattactgctgcctattaccagatttaaagttataatttcctttgcttttgtctacacttttgttgtctgtatatttatccctaaacaatacagcttaacttagggtgtttttaaatatatgtatatttaatattatatatataaatatacttaatatatgttaaatatatattttatatatatatataatgatatgtagagttttttttgttttttcaaaatcgatgtagattaatccatggagttggatatagatacagtttgtttgttttcagtgtcataatattccagtctaaaaatacatatatacacatacactgtagtagtttacttaatatactttattcttgatggccatttgggttctttacactttggagcaattttgagcactactaccttgaacatgtatcatgatacataagtatacattacatttggctatataacagatcataagatctgcatacttcacgttgagataatgtcaaaacatgttccaaagtaattataccaacttccactcctccagaagtgtgtgacttcctgttgctccagatatcaccaaatcttagttttgtcagtctttccatttttgcc

SEQ ID NO: 73932 - DNA, 1027 bp, Homo sapiens
ttcttttgtaaaagtcgtagataccaaattttgttttaggtataatatgtctaccccagaacacatacatttaaactttcctgctattagctatgtttattttttatattaagagtataattaaatattaacacctatgtcatattaaaaaacagaaactttggtgggacatttctatagattatgaataaaatataaaatgtgaagtggttgtaaagtgaggcaaaaattttaatacagtgaattgttcaaataccccagatattgcggtttattgagtgaaatatcagttatcagctgaatttcaaggaaataccacacgttcatttgaataatctcttgcttctgaatgttgtgttcattatgatgtgatttacctagttaagcgagatttaagaagaattgtgctttttaaatttccattttggtaagtagaggtgttgagttgtcctcatgtctcagtttcatgtaagaccaaactagttgatgatttttgttttaatgtcaaggtgaccatgctcttctgtgtgtcagaatcaacaacatagcagtagctgttggaaaagaagctaaactctacctgttccaagcccaggaatggctaaagctacagcaaagcagtcatggttatagctgtagtgaaaaattatccaaagctcagttgacaagtgagtatatccttttttctttgatcattagatatagtttttttcctcctaatgttgaaatatagtaccatatgtacatatgttatgtttcctgacagcataatcccactgtgatgacactttgtctagtacattttaagctgagttttaacagtgcctttccctttttatcattcatcgtttttgaaaaaaaaatccagataatttatataggagtcctttctttcattgactctttacagtttgcataatttatgccaatatggaaactatattttgacccagtggcagcatggaatgaatggtaacatttgttgaatgctaattatctgccagcactgagctaaatgccaatgtat

SEQ ID NO: 73933 - DNA, 1040 bp, Homo sapiens
acccgggctacatgatcccgtgcaactgcagcgcgtggcccagccccgggctgcagccgccgctcgcctacatcctgctgccgggcatgggcaagccccagctggacccctaccccgcggcctacgctgccgcgctatgaccccgcggggccgcctcgcgaggaccggtgtgcacacgtgtacatatgtataggtacgagcgctgcggcctccccgtgcgccctcccgcgaccgggggcccggtttgtatgtacatagaatgtataggtgccaggtagaggcagagaggccaggcggggcaggagtggccaagcgcgcaagggcgcgggcgagcaggcctgtgaattcgcaggatcatttcagacccgcacttcggcagccaactcgaaagcaggcggttgtgtgcggcagcagttggcgtttgctttgcacttcggaacctgttgcgttttgacccacggaggtggaggagtaactttttgacatgttggcctttccagttttgttggaagtttcatggtcggttttgtttttgtttctcattcttcttcctcgcccctcagccccccaacccccaaccccctcccggtccgtgttgcatgcacgctgttcaaatgtgaggtctgaaatggctggcacacgggaaaagctgcttgtgtcattcgtttctgggagtgggatggctctgagcagcctcgcctccctgtttgtactatttgaactttgcagatctctgttctctcaagcagaactcccaaccagatccattcttgaccagtgaccggctcgaatctggccttttgtgtgagatgatcacggtttcttttgtttatcacgccatttgcaaatcagagcaagagctctttctcaagggcaagaaacgcaaacaagaaatatttgtgagatgaaagttgtcaattggattttcttcctaaacaaacaacaacaacaaactactagaagtctccctgagtccactcgcttggatttctgacacagtttacaaaaaaggaaaaaggcactgctcctattttccctta

SEQ ID NO: 73934 - DNA, 2756 bp, Homo sapiens
attaaacgccgggatgtttcatacgtatatgccagcatttcaatgcttgtcaatcagagtttataaaatatagggattacaacttgatattaacatccaaatctattgtgctcattttacgtgtgaaaatgagaaaccctcatgcagacgctagatttcccagcctctttgtcaccctgtttttaatttatctccaggttttgagtcagtaaaatgattccgcttatcaatttaatacagagataaaacatatctatgaatcagagtgatcggaactaaaatggatctacaggttgtttggcattcagcccagccctgctgagggttttagtggggctaatttctctgtacagtagattcatccctgttcttaaattgtgcctcagtgagggatatgatttgcttcacatgaagaagtagacacagaagtgcattgtttcagggaggagactttaaaattttgaaacattctttttatgcttaccttttttttttctaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccattcagagatctgtatttctgtgcttcaagggattcctgactcatgttcttgctgatgaatgccagtgagttttcctgagatcgaaaaatacagtatcaaaggataccttctatcatcaaccggttctcttggcaaattaggtgtaccaagtattctaacgggtagatttcagtgggtttcagacagtttgaagcagttgctatttaagcaagtccatttgcaccattctaggaagaaagagtattagcttatgcctcaggcttgagcagtattaaatggttgaggtttttgcttttggttttggtttttaaggtgactttgtccaaaactaacaagaaacatctaccgctgttacgctgaaatcactattaaataatgattctcaaagtgtggtccctggaccagcagc

SEQ ID NO: 73935 - DNA, 1044 bp, Homo sapiens
gacatagcttacaacatgagggctttgctaaaagtagttcagtaatctcaactcccttcatcacctgcactgtaaaaaagatgtttcatctcacctgtgctgttacccatagtgtgttataaaacctggtagcagaagagaaaaagaaaggtcaaatcaaagaatatatacacaggaagtttgtttttgactaagtatttcagaccatgaagctaagaccatttgggtttaaagttgctaataacaacactttctttatatatatttaaaaaaatacatcaagagggttacacagaaggaagcagcctatttggggaaggctatcaagcagtagaaagtgatgtgaatgtctatttgttcttttggctgtttttagtttcactacagaatagcctttttggagtacataaatctataaccacacaaaatatggctagcttaaaaaagtgggagagggagatgatatgaaattatcccctgaaaagtcttacttttgaacacttgcattataatggaaatagcctcagatttcttctggtggcattccagcattattggacaatttattttctccttaagtgacattttagtacattgtgtgttatatgtaatgatatttctggagtaacaagtgtgcaagaagtgagagaaaaagaaagtacacttaatatgtaggcaggtgtctcagcactttcttttttgtacgtgaatcccattatctccagtgataactttgttgacagcacccaccaatatattcagagcaaggttttataaaatagatccagaatcgtatgactaagagacccaggtgacacgtgtcagcctcagatagttgctacattttctgttttaaagattcaaacaaaacttttcacattcttctttggggaaaaaaaattacatttgaagtcctttttcacccaaacacgttttgagataagagctcacaagtcttgacattatttcattttgttatgcgcatctgtcaaggaaccaagatacgatacagctactaaaaactgatgattgtggaacagagaa

SEQ ID NO: 73936 - DNA, 1095 bp, Homo sapiens
ttgttgaggcttgctcttcatagacatcttctcagccttgccacagccccattggttccagttgcatatggcagcccttcatgatattttaccattcaggctctcctgatttcacaaagatttagcttattttttattaatgaatatctttgatgttcagagtggtttctgaaaggaaaaggagaggaaattcattactccattatattaaaagcagaagtcctttctaagtctccattactctttgacaatatgcatgccaattatgtacaccaaaattagactggctttaaaaatgatgaacttgaggccttgagagttactgtgattgaattagggccatacacatcagtaaaaatgaactgacagggtcttgagcctgaattcaacacatcagatggtatcttaggaatgcaatgtcaatcaaagcccagttgctctcctttgtccacgtgcgggagcttgtattgctctgttgattttagtaaaatctagctctgttacggtggctttactgatgagttagagtttaaatatgaacttagtttcaacctacattagaggaactataatggagcaaactcaagagaagaaggaaaagagggacaaggtttcccatactcactgacctgatactcttcttgccgcaaacgtgaacgcttatggcattgtctcccttaagcttcacagtccttctgaactgctgttattatccccttttgacacatgaaaatgctaaagtacaagaagctgagtaacttttttttttttttttttttttgagacagtctctcactctgtcacccaggctggagtgtagtgttgcagtctcggctcactgcaatctctgcctcctgggttcaagtgattctcctgcctcagcctcccgagtagctgggactacaagcgtgcaccaccatgcctggctaatttttgtatttttcgtagagatggggtttcaccatgttggccaggctggtctcaaactcctgacctcaagtgatccacctgccttggcctcccaaactgctgagattacaggtgtgagccaccacgcccagcctgagtaagttttcaaagccaccagttcaaaag

SEQ ID NO: 73937 - DNA, 1012 bp, Homo sapiens
tttagcaagtaatttggttcacttatttacttagtctttagcattagagagacctgtatttttaaattgcagattttttccttcctcgtcaggaggagtggttatgttctgtaatgctatgcttaagtaaaattacacatttggggtatctaaattggcatgccaaattataggacattttaattgttatgtggatgtgacagattcaattattcttgaactcttttgagaaagctgcccttagcagtgattcacagtagtaaacaaaagattaacaggaaaatgccctttatgaggcttaataaatgtgtccgattaaataccatgggacggaattaactgcaatatctacatgtagaaaaacaacctgtgtcctgcttggaggttcagcatattctcttaagataaatttactctaaatatggcctaactgaagaactaagtgccacttaacctcagaactgttttcctaggtacgtcatttgggccaattgttcagactctttcttccctctgaaaccattaaccaaagccactaataagtagaaatgcagagttaagagccccttcctccctctttcaatttccagtggacatattaatgagcaataaagcagctaaaaggcaagcagctcaagaaagagaaagaagcaaagaaaggtgattgggaaaacagatattcagccctcagcaatgcagactgggctgccccgtgtgccatgtgggctgtgatcacaggaatttggagctcaatttcttaattggttctttagtcttatccaaagagaaaattggatttctagagatttcttctgtgcagagagcaattatgctaaagctgcttaggtaacagctttttcggctagcctttctctctcggaataataaagtacacccagagccgatttcagaatgcaccttaacctcaccatccagagtttagcccctcttggcagctgacatgttctagaaccttaaagaaattccagaagcatttacttcttttccattg

SEQ ID NO: 73938 - DNA, 2351 bp, Homo sapiens
tgggatttgctgttaccgcattggtgatagctactccttttattatctaatgcttggaagtgctgtcaacttagaaggtctgattagttagagagacagcaagcaaggacagaacttggcagacaagtcagttggtcactcctaaatctgatcaatcagcttctgaccacataaatgtctagttcacaagcatcttcttgatccatcagcgctgttaccattattgaagtgtgcccattagtttattgctttatataccagtccctctaggtagattttgagaaccttaatttttttctctcttgagtaatgtctttatctaaactctgaacatggttctacaaagcaatttacagttggcccctccctacctttctagcctttcctccctctgttctctctctttcctttgcagtaaaagccacagtcctttagttattgtccttcagttcatcaaacgcagcattcactgttgcggtcatgccctctctacaccatgcacaatggcggcttagactatggtgtgagcagtgaagatggtgcaatggatagatttggagtaaatagcaaagtaaagcaactggactgtgatggattgaatgtgagatttgagggaagacaggggtagtcagtcctggtttctctgtttgggacctgactatctggatgaatgaggaagacccggaagaagtaaacttggaggagggaaaggcaagcattcccttggaggatgtaactgttgagatgaccttgcatttcaacatggagctttccttctcactcccaactccattagtgtctccatctatggcgatctctccaatgatattgggagagcttccatttagggctccctggccacgaggtcatcagtggcatcacaggaggtcctaccaggaggtataaatttaagtaaggagtcttattacaagctctgaattctttgtgagaactattttccaatttttcttaacaggcagtggcaggattcagcctcagggaacccaggagacatgcattctgtagcttgagattgggaactggcctctatgttccctcaacccctagctgaaagcatctcctgtattctagagcttctgatcatcagccagctttcaattcgggggaacaccataaataccattcttcctcagatctttgattttggaggtgttttgttttttttgtttgtttgttttttccccttgtttgctttagagataccgttccagaaaacacatgttctgttctgttattctgaaagctgtgaaaacatagagacaagtgaatcagctgcaaagctcagcactccaaaaggcaggctcagggagtggctggggaagtgacagatgttaatgaaggacataaccaacactattgtcatcatgcagtcctgtaattgcaagtgcttaaggtgtaataattacgttttgttgcattggtgaatacttctccacaaagacggatagatatagttttgtttactgtaagtaaatcaaacaaaaagcttgttgggaaacaactgcgacctaattaatagctttgtttatgtgttgactctccaaagggatttacccagttttggttcattaagcgccatcaatgtgttaagcttagaattttattttatgaagatgttctcccagttttaactttattaaacatggtgtagtcttaatgacagctaatttaatcttcatttgctcagttgccacaaaacagtagagcaagacagacaaattagaaatcctcttttttctaatacgcaccactatctccacattaaagacagcttcctccctgtagtttttaggattagctggttacttgtgacctgttttcctttcagccaatagcacagccttttcctccagtccctgcacacccgtccttacaacgctctggattctccctggtagtgtgagtgaacgaggaataagcgaatctgcagttagagaattcttcgggagtgaattacagagaagcaaaaccaggcctgagaaattcagattgtagctcttttctttgtaggcaatcttatgggtgtataatgtatatctttctttctaaacccaaatctctttttagtagcgtttcctcagagaaaacaaactagaaatcgttctagcagaaccagctggagaaacacaactcaaagctaacctgagttttatttaaattctatgtttcatcttcatggaacttctctttaagaaaccgacaacggccacaattagaacatttcagaagaggaaaaattacttcttgaaaaatatgctgagacatttaattaaagtgttcagggggacaaagaactaatgtgaaggtagaaagcacaaactggggctggg

SEQ ID NO: 73939 - DNA, 1641 bp, Homo sapiens
aaaacatctctcttaccccaagaaatttccttgtgtccatttacagttaatcctccagccccttggcaaccatcactcttattgtctctctaaatttctgtaatcttttaactaaaaagaagggaattttttttatctttctgtattttacctacagaatacttttattgatcatactgtgtttttcttaatgaaattggcccaggcagtattaacacgtgaccctgcatgaacagactgtgtttgctgatggtgataaaggagcatcttgggttccattgtttgttctcttaagtcagaatatttccgttttgtgttgactctaccatctttctcattgaacattaactagaggtaattcagcctcatgtgtgtgtccacttaagttatatctctcgagagaagggacttgaaggttctaatgtctatgaggcttgactacttccatagcggcttgaatgatagcagtcattcttctttgtacatctacaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaaggtataaagctgaggtccatgtaaccttgagtccacattttaagtgtgtaaatgggaaacatggaatgattctgagaaatatttctaagtgctctgtttgccccagacataacattttaacatggataaattcattctgaaaaaaaaagaagaaacccaaacgtgttttccagtgtcagagatattattcagtatcccaggagagctagattcctaaaatccactcccaataatcagctttaagcaatttggagggaagacatttttcgttgttttatgaaaattagtaaattactacatagatttttatacttgtttttaaagaataagattgtcctaaaacattttaacatgatttttaaaacattaaatagatatgatcttttttttttaaatctctattgtgaagtagagctttttaagtcttaagtctactttttgcatctttacgaaattaaacttaacttctttgattgcagaactgatgagttaatacaaaaaaaaatccgggagaaatttgcccactgcaccgtgctaaccattgcacacagattgaacaccattattgacagcgacaagataatggtgagtccttcacctgcggaattcctgttgctcccaattatgttcactttttcagtttattccttccttgtaaaacttgatagaaacccctagtaagttaattttctgttaattttggctctcttcccagcagtaattcatatgcttaactacaccctcagtgctactaacaatatatccaatgtatctctttgcatataatcatatgcaaaaatcatatgttaaaagtttaccatgaaaatattccaaatctaagattcagcttgtgatgctaactgtcatactacggagtagtatccaatagaagatcacagtcattgtcactgtcacagttgtttcagcatgcttgatccccttaatgaaagatttaggtttttatatactgcaagggg

SEQ ID NO: 73940 - DNA, 1480 bp, Homo sapiens
ctacaattaagactaggttatatcatgttggaatagtggagaaattatctaatcatgttcaacattgatagaattgctgttagaatacaaggatgtcttgtattcaggacaccataagacagaaatctgcacatcagcagtgtccacatcctctgggccttctattccccacaccttgcacctccatttttcccaggcctgtattgcccagaatgggcttccgctcgcttcgttcacacttagctgtgttcttgttaaaggttgttcccatctgttgagttgctgtttatcacatttcagtctctggcatcagagacttcctttatgaaaagtcagaaagttcaaagaaacatggaaacagaatctgacatccacatgagtctctttgaggctttgaaaacatttatgatgatagaaatgggctgtcttagaaagttcagttcattattttcacttttcctgtagtttcctattttttctaagcttcaaaataacctgatacattgtgtttgaaatgtatagtttcaaatagtatgatttgattttgttttcctgaaattacaacctttattaaatgtagaaaacattaagttttctatattttaaagtataatgttatgatatcttggagccaattaattttataaggactgtttcttttacaatgacatttagtaagaaaattgtatgtaaattctatttctttgtggatttactttgtaatttataagaatagacatgtcacaaaatgaggtatccttgtgacttcatacattcaacagattatgtgtggggaggtttttacataggcattgtagactctggagctatagcagtcatcaagagagataaaatccctaccctcttagggcacaaattcttgtatggaagatagaaaataagaaaatgcatatgtaatataatattaggtactggtaaatgcagtgaagaaaactacagcagtgcatgaaaagaactagctgactgcattattaaaaataggcggctgggcgtagtggctcacgcctgtaatcccagcactttgggaggccgaggcgggtggatcacgaggtcaggagatcgagaccatcctggccaatatggtgaaaccccatctatactaaaaatacaaaaacaaaattagccaggtgtggtggtatgcacctgtagtcccagctactcgggaggctgaggcaggagaatcgcttgaacctgggaggcagagattgcagtgagctgagatcgcaccactgcactccaacctgggtgacagagcaagaatccacctcaaaaaaaaaaaaaaaaaaaaagaataggcagtatttcattgtccaggaaggagcaaaataaacaaaaagaatagatattatctattgatctcttacttggtaccaagcactattgtaaatgctacacatactgactgattttatactccaacaattttaggagataaacatcttcaaaataatcttagtat

SEQ ID NO: 73941 - DNA, 2071 bp, Homo sapiens
cagaagtgactctcaaggagtgttctagagattggattatttgtacaataagagctcctgtcattgctttggttcatatttaacataaattcagaaagtattcattgagtaattactattctccaggtgtatagtcatgagcaacatagaccttgtccccaccggcatggggtctgcagctgtggggcctcatggcttccatcggacctcacagttccatcctgtccttcactttaacacctccacatattcaactccagacatggctgggttttttgtttgttttcttttaatgtgggttttttttttttttaacactctatagtcattgaggggagctgaggaacacacacacacacacacacacacacacacacacacacacacaaacacatattctggagaagagaaacacagagaggagacaagagcaaaacccaggcagtaatgagctttctgggcatgtggatataaacaactcttcaatgcctgtttagtaggaagcatagagaacgtgccaccggaagggaaggagaatgtgatttttatcttagaccaagtacagttatggctatcctagcactgacctctaaaacaattggaatcacgcttaagtaatttggaggatgtgaagaaattggaaccctgtgcactgttggtgggaatgtaaaatggtgcagccactttggaaaacactgtagagattcctcaaaaaatgagagctaatgtgatccagcagttccacttccagaaagaattaaaagcaggatctcagagttttgtacatccatgatcatcacagtacccaaaaggtggaaatagctcgtgtccatcgccagatgagcagatgaataaaacgtggtctatccatacaatgggaaattattcagctttaaaatggaaggaaatcctgacagtctataatgcagatataccctaaagacattatgctaagtgaaataagccagtcacaaaaggacagacactagatggttcccctaatatgagatacctagactagtcaaattcacagagacacaaaggagaagcgtcgtcaccaggggctgagggaaggtggggggttgggagttacattatttcacataggacttcagttttgtcagatgaaaagcgtcttgtgaatggatggtggtgatggctgcaaaacagtgtgaatgtccttaagaccactgaaatgttgactttgaaatggcaaaagcagtaaattttatgctatgtgtattgtaccacaatttttatttttagtttaaagaaaaaaaagtatccctttcaggataaaatgggaagaaatgtttagcacgttagattccctctggctattagaagcatgacttagtgcttacagtagaaaatgagagtataaattctcaagttttatattttggttatgcccatctcaaaaatgggccaaatgaggtttacttagcagagataatgggcatgtctgtaaagtgcttttatatccttggatgaaaggttctaggaacgtgccctgcattactttgaatgaattcttaataagaaatagttgtgtgcttgtgtacataaaagaactctaaataaagaagtaacattagatgattcttggctctgccagtaatgttttggaagcacatctgagcaaagactaaatataccttgacatcaccaggttttggttcagttccataagtttccaccctacttttgagcaaatgctctatgtatgtagtccagggagcatgcttacaaaacactgctaagctttgtatccatgtagatcctgatctccaagcattgtaaacagagagactttcctttttaactttgtatggctttgtctccaaggctcaatgttggttgaaaaaaagaaacatagtctagagggactgtgcaatacttaatgcgacccaggaaatcattcagcagactgcctgggatagaatctttcagagcatcttctaagcgtcaacacgacccacatttttattccagcactgcctgatagaagtgtgacctcaatgaagtcacttagcctccaagcttcagtttcctcatccttaaaccaaac

SEQ ID NO: 73942 - DNA, 1381 bp, Homo sapiens
ggatgtcatttcttgggaagttcccaccaggaaatttgcagttgtgcaaggtcattggtgcagaggccagtttctgcatacagatttatatgcacacatgtgaaagccagtttttacaatatagacgtattgcccccacctttttaccagcattttattgattctttgatcgtattggcagtgcacttcatttctctctgtcttggctttaatagaggagtgatacttgacacaaatgtttctcaaggggcaattgtaagtattaattagtttgcagcatgccttttgaactgtgcagatgaaaggccttacgtaaatagcaaatgttacttgcgttgttgttgatctcattatgtgttttttggctactggttactactgtcttttaagacattgcaatcttcacttcagaattttgaaacattttgagacaaaatataggcagatatttaatatttggaagtttctctaccaaagaatatgttatcttaaataatagaactctagaaaaatgaatactcgtttatgtcacttctgacacctctgtcttgaattaatatccctgtgaaattatctcagaaattcagattactcagatcctgcaagcaaagctaatttaaaagttgccttttcatgggccacttaggagactgttgacttttcaatgccagtaaacagattctgttattttcaactcttttttagaacagtggatctcaaccaggggcagttttgccccagaggacgtttgtcagtgacatttttggtggtatcattttgggagtgtgctcctggtatctatgcagtagggtccagggatgctagcgaacctcccacaatgcctggggcagcttccaaaatgaagaagtatccagctcagaaggtcatcagtgctgaggttgggaaactcttagactacactcaatatagaatgtccttaattcttcttcaaaaaccgaaagttttctcctagttttgctgcatcctgtgatttttttctttttttttttaatcctgccgcctggatctctctgtaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggtatgcaagtcatagcgtccttacctgccccttttataagagctactatgtttaattgcttttactcttattgctttttttaattggatgaaaggattgttttttttttcacccaatagagcatgtttttatgagcagatattttcaacaggtattttcatcagatatccagctttgttcatttctct

SEQ ID NO: 73943 - DNA, 1029 bp, Homo sapiens
aggcagagagctgtacttcggaagtttaatctgagaaatgagtgcacggggaagacgctgaaggcctgaagccaattgattttatgtactgctggcaagatgtgatggggcaagtgattccactttgtagaatcaaactaatgttgattaaaacaaagttataataccctggttagtgaatttgcagggatacaggtgggagtagaaattggtatcatatttctggagggtagtttggcatcacttaacagcctcctttgaaaatgttcatacctgttcctcagcaattccacatctaagaatttattttaagaaaccaattaagattgcttgcaaagatgtagcttcaaggatatttaacatggtattatttacaatagcaaaatattggagcctaaacatccacaaataggggatttgttgaataaataatcatatatactgtaatattatgtagctactgaagtaaatacttttattaaataatagattataatattctgtgcatattctcattttgcctaaatatatgagattatatctttaggaacacagataactcacactcaagttcagaaagaaaaggtattaacatgtgacaaggattctgtcagattgctggggttgtggccagcatttatttatttttcgaattcacttgcactgattataactagcaaaagagtttttgtttttcaaatgttaatgcagccttgcactgaggtaatggctgcagaaattaaagtgagggtattgagtcaagaaacagaacaagtaatatttttagtgcttggagttgagaaaacctgggagatgggtgttttgagcctgtgaacttggggaagaatttattagattaaaatggaggagttagaagcagcagctgtttggaggggggctgttgggtattaatcatgttgagtttcatatatgaagagagatccaagtacaaatgtctaatgtttggccaaagagaccactcttggcccagttggggaaacaaaaagggtcaattgtaaagcaattaaa

SEQ ID NO: 73944 - DNA, 2065 bp, Homo sapiens
ccttttgtgtattttaccacaatttttttttaaagaagatagcacgatggcatgatttataattctgggtcagcatctcacagtaccctgagcctcttaaagtcagggagcattttatattcgtctctgtacccccagaaaatggcatgctgcagggcacatggtgggtgcctgtgagagtgagggatatgcacatacaaagaaatcggtaacaaaacacacacgacagctcccgcaacagcccgttctctgggtgtcagtgttagatactttcggaactgctcttttcagctcttcccaccacagacccatttaatgggctatagtcacaattgaatgaatgatacccttgtgccatgaaaaataaatatacagcttcatgcccagaagatacccagggaaccagcaaaagctgattcctcattatctacccagcatccttgtgagtgtgaagaaggtggagaccactctgcaggcagcatcagctgtagctcttgctgaaagcaaggtttctcagattctgttcctgatggggccagggggatgtttgcttactctcagacaatgtgttattaggtcctacctgatcaacatcattctgttagtttggccacgttgtaaatttctcttgtagccataaaatatgaattatctacaaacctctgttgtacacattagaaaacaacctatatccccacattgatatcgttccatcttaaaacccccccaaatcataggattacctgagatctgaaatgtgggagggtaaattgaatttgaagactgaattatagctacaaccacttggcttttgagacagagtctcgctgtgtcatctaggctggagtgcagtggcgcaatcttggctcattctgcctctcaggttcaagcgattctcctgcctcagcctcccgagtagctgcaattacaggcacccgctgccatgcctggctaatttttgtatatttagtggatccggggtttcaccatgttggtcaggctggtcttgaaccccgacctcaagcaatccacctgcctcgacctcccaaagtgctgggattacaggcatgagccactgcgctgagccccacttggcttttgatttgtgtcctggttcactcacagtgtcacctttagcttcatttgtgtattcaggcaacatcgtggtgagttggttccactttttgtgtgtatattcagggttcgtctcctccacacctgcctgcagccccaggatctcaggcagtccctttgctgttggagctgatggagaggggcattgtttccagtggagatgtaggaatgtgtccacacagcagaaacagggcttcattctctttcaattgcttcatctgctcagatttcctggacattataacaaataggaaaaagtaataggcgctaagtaggtttctaattcacagaagaaatagcaagtaaaaaagaatgaaccaaaatgaggtatataccaccctagccttcctggttagattccaaacactggctgcatttttcatttagatggttttgtggttgatttaatcattttagagagtactgggccattttaaagcatttttcagctctagaggtagattgattttggtttgttatttttttttccttgctcaaagctattacttggataatacctttttacagatgtgtactagaccttgctatagtgtgcaaaaatattagtttcttatattctctccttttttacattaatgtttgctgagaaacccctcctctcacagccagattgtcccacttgccctgcctgcttgctcatctcaggggctgggatcagcatcacctgcctctgcttggaaacatgttagaaatgcagactgtcaggcccaccccacccttttgattaaaattgcactgggacaagaaccacccccactcctgcccctgcattaaagccgttgctctccggtaagcaattttggatgactaataatctgtgatttccaagaaacttcctttgacaacttgaagtggagctcgtggattgccccagcccctcttgtgactaaacatgagactctggatagtc

SEQ ID NO: 73945 - DNA, 1022 bp, Homo sapiens
ctgggattacaggcatgcagcaccacgcccagctaatttttgtatttttagtagaaatggggtttcaccatgttgaccaggctggtgtcaaacacctgaccttaggtgatccacctgccccggcctcccaaagtgctgggattataggcatgagccaccgcgcccagccagcaaaagattcttgattggtggctctaagtattcctttcctttacaaaattttcttgcctttaatacaggtgtgagaagtggataaataaaatctaagcattcatttctctcattcttttaacctaatgttgaaggaagtggttgtaagtgaaggtgttacacaatgatgaaccaaatttgtaagtcatcaacatcctcgtctgtctcctgcttctctccttaaccaactatgtatgaaagaagaacatttcattgacagtctcttaacatccataaatgacaccctccattcctaacccctcgggatgtcatatttctttcagatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggtttgtttaaagcatcttgcctcttctcaatttcagaagatttagtgctatgtctgcttgttgtcttccttgtggatgtgtgaaggggatcagtgatacgtaggttaacctgtcttggaaactaaccatggaatgtggataccaacattcttcctgctgtgaactgctttactgtggttggtgggccccgggcctcagggctggagcttaacgtgacccaggatactctgtttgatacctaattactcatggatttttccaggaagtcaactctggctttgtgtcaccaacactcctatgtctaattctgtcgatttttactttgttgcatttctc

SEQ ID NO: 73946 - DNA, 4049 bp, Homo sapiens
cggtggctcacacttgtaatcccagcactttgggaggccgaggtgggcagatcacctgaagtcaggagttcaagaccagcctggccaagatggcaaaaccatgtctctactaaaaattcaaaaattagccggccgtggtggtggacatctgtaatcccagctacttagggggctgaggcaggagaatcgcttgaacgggggcaggtcggggcagggcggcaactccctcttaaaaaaaaaaaaaaaaacctacaccacacaaacaaaaacacaatggctcaaggaggagcagctggtcagggaacctcatgggatatacagctcccaaagaaaaaagaagtcacacaaaaaagaattcacttcttaaaattctgtagagatgaagaacccactgagaccacagtcagattctgaaaaaagcaatggcacatgccatagagacctccagagatcaggacaagtttgcagtggggcagtcataaaaacatctgtccggttcctggagccaatgttaagaccattcagagacatcttggctgggcaggttccttgggcacggcacaagggcattgcagcacccaggtccatggagatcacaaaggattcttccagcatgagtgggcacagaagattccccaggatgcagggaagtgacagtctgtctgttcagctcacttactgagtacatgtcctgtgccaggtaccatccagttaccagggtgcaatggctatagctgacccttgagaaattagcaatttaaggtggggacagacacatagatggctaattgtaattcagtatggtgagtactcttaacagagaattgttttttaaaatcctactggctcaaaaatcagaaaaatatcatttctgcccaaagagatgtcagggaagaatatggagaggaggaagacctggaaggctgagttaggaaggaaagaattataactagatttgaatgtggtcaaaaataggacgtttatttccaggccccttatgtgaggtgtggtttgagcaggagcttgagattccagtggcagggtcccctcaggctattgggaacatttatttttccttgaaacatgaagcctcctaggaggcctgcgtgtgctgtttggtggatacgtgaccatggagcttgggaggccgcaggtttttctgcacccagcctcactgagctgttttctctgtctgtttccccagctcggagtccagtgttttcccacttatcatcttctctccaggggctctggaccatccgggcatacaaagcagaagagaggtgtcaggaactgtttgatgcacaccaggatttacattcaggtctgtctatttctggaaatggtttcaaaggacaggatctgctgctttttctggcttaacctccctggtcagatgagcttgttggcaggcacctcagggcccagccccacatcctgctttttttgcgcatcttcgtctccttccccatccccttcttctgggcttggactcctctcggaatcgctgctgcacgttccctctttgtgccccctgactggcttgtggggtctttctctcaccatgcatggcctgtggctctgtcagcaaacgttttctgcaaaaggccacctagtaagtgttttaggcattgtgtgccattattgtctctgttgtgatgaatcacctttgccattgtagcacaaaagcagatgtcaatacattggcaaatggctgtgactatgtttcaataaaactttatttacaaaaataggtgctggctcacgtgctgtagtttgctgaccccttgcatcagtgaagattttttcaatatggaaatttcagaatttccaccaaatctacaaaattcagatccgtcattccaatctttattttatcttgctgattaaatggcactttaaaaaccacatgctaaaaggaaaaaagaagtagcaaacaaacaaacaaaaaaccacatgcaaatcctgttagtgaggtcatttttatatagcccctaagcaatagtcagtgtgtgtgggccttctggtaagtatggaaggtgggagaagtaaaatgggagctgcactctgctgttggagaactggaccagtcaaccatgtgtgtgggtggacttcacatgagatgcacttcacataagtatttctcagcactgtacgagatgtccttatgagactacttttctcagttctttattaggatcatatttctgggtttcatattcgcatgcatcctcacagaaagccacggtaccattgtgtatgtgtatcgtatattgcctgtatcacttagctttctggaatctaaaggttccttgggtgtgcaactttggtgccctactccacgtaaaaatcttctgtagctcaactgagcaaaacacactcgcacattcatctacttattcatcatgcttattaccgttctcaaattcagaggcttggttcttgtttttgacaacgtcccgctggtttgccgtccgtctggatgccatctgtgccatgtttgtcatcatcgttgcctttgggtccctgattctggcaaaaagtaagtacagatgtgaataactatgtatggtatgattacaatttatagctgtgtttacatttattaaactcttgccaccttgtctactactacatactgtttggtcctaatgaagtgtattaaatcatttacgatgtgtcaggttgggtaggattcagcagtgtgactcatttaaggagtcatttgggtcttgatgggtttatctttctttgaatgggttgagatatgcgcagttgagattctgaacattcctgttagtgtctggtagttgtgaagagaaaaccaatttattctgaagcattttgtccaacttagggtgttagccttccaactacttgaatctattgtttgtagttgcctggtgcatgaggttgagaaaaattctcagcaggagagtattatcttcaatgccacatgggtaccagacaagcagggcatgagttcaccaccccagtaacaacagtgcattacaatacttaataatggaacaaggagagtagtattttagtctcaaaagcattggcacttacaacctattgctttgtttttagtggtttccagctgtggttgcattgcacgtagaaagtggaataatgtaatgagctttgaaaccataataatgaatgtctgaataatgacattatttcttgcgtttgtaatactgttaattaaatctatgtcgatcctgttggaattcataaaatcatctaaaaatttttctaaatatacagtgttgttttccccattgtatcttgatctcaagcaacaaatggtaaaagtatagctattaatgtcattaaatgtgaattgtttcaacattatgaagggttcctcttggtaagtggcagaaggagccaggcttaggtttgaagtgagactgactttattcccttcttcctccttacgtagctctggatgccgggcaggttggtttggcactgtcctatgccctcacgctcatggggatgtttcagtggtgtgttcgacaaagtgctgaagttgagaatatggtaatatttaccttcacgttctttgccttttcaatctccttgccattaaatggtataaaagccattcttatgtgaaatattaaaactgttatttttacatctttggtaacagattttttttaagatccttcctccatctgtttaaagttaatgtaaaataaaatatatacatctttttctgagtcttatggttgctctgtcagcaggttttatattcatcacaagctttttcagatgtaataaatgtctctgtaggagggaggttctgaaattctagagaggatataagctaatttcttagaagcctgtttaattttgtttcttaacgggtaattcctcattcctgttaaaagaagacttcagtattttgaggttgtttacatttaattaataggtctcctcctctcccagttctagcgtttactctcttatgtgaagaacagaagggaggaaggccttaactttgctggtgtgccttcttggtacagaaagcctcc

SEQ ID NO: 73947 - DNA, 1031 bp, Homo sapiens
ttttcatattattagtagagatggggtttcaccatgttggccaggctggtcttgaactcctgacctcaagtgacccacctgcctcagcctcccaaagtgctggaactacaggtgtgtactgctgcacctggccaacagtgaactctaagaggcatttatcctaagtgtctgcatgaagtagaaggggtgacagtccataaaagttgtagaaaaacttttcagtcatcaagaaaaccagctaagctaccatgaggtctagtcttgtaaggttttcagtgggcaggccgagcagtggagtccacatgtgagtaacacttggccaataggacttgctagggaaggtagagtataattgctgggagaccttccttgtgcagatgactggccctagccagtgttgtgtgtggacagcaaggctgtgcaggcattttatggtttgggcccgctcatgaaatgaagttattcgagagtcttgttttaagggagtctgtggtatgttgaaggaagcagccgttccagaaggaacatcttgacgtagactgtctgtgtcaacagccacatccgatccatgtggatgtggagaaaagggggacttaggaaggctttttgggaagcagtgtaggattttctctcttgaatttcagcatgtaccttaaagcttgaaaacattttcatgtggagattctgacaaccttatcatggcccctgaggcatatttgggtgttcctgtaccctgattggctgtaacaatgagttaaatatgcaggattctttctccatgcgctcagatcaccaaccacgggggctggttggttggaactatttactgttattcgtccagggtggtgggtctctgccataagtcacaattccactgtttcttctcagcagcagtggatcgtggtttttgagaccactgctggagtcaccagctgaaagcaggatgcctgactgccgtggcagggaggcataatccagcttcatccttgtgccctcaaggatttccaaagcctctgttggactgcctcact

SEQ ID NO: 73948 - DNA, 1114 bp, Homo sapiens
ggtgggcagatcacttgagatcgggagttcgagaccagcctggccaatatggtgaaacaccatctctactaaaaatacaaaaattaggcatggtgacatgcacctgtagtcccagctactcaggaaactgaggcaggagaatcacttgaacacgggagtgggaggctgcagtgagaggagatggcaccacttcactccagcctgggtgacagagcaagactccatctcaaaaaaaaaaaaaagaaaaaggaaaaaaaaacctaatggataagtttatatcatagtgtttggcacatggcaggcatgtaatagatatcatcaggaccacctatacttttgttattcctttgtatggaaaagcagtccctggtactacaataagtctttcagagaaaggagtgtaatcctaacaacaactcatgcaagtatttttgaaaagaatacttgataaggaaaacctgcatctacttctgctatttcagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaagtgagtatggaaactcgggttggtatagacatgctagctagtttccatttatgccataaattacagagaccccctgaaattcggcagactctgtcttccagaatttctctaacattaggtaattgaacgtattggccattatgaatcattgtgtcccttagagcatgtggaattgatagcctgcaacgtgcaactttgcatttggaataaggaaggagtgaaggccatatggggagtaatattctacaggaatgtcagcactgtgaagacagggactctccgtgtcttgtttatgacatactttcttacacaaagccggcacttaattaaacatttttcttagaaataaaatatttgatcatggtgaaactaatatagaaggaaaataattagggtattttagtatctttccccgaagatactaaaaatgacaaggaaatgagaaggatggagaaaggaaaagaggtgtcagaagcaatgt

SEQ ID NO: 73949 - DNA, 1046 bp, Homo sapiens
tgttttttgttttagtctcatgtgttcccaaaataaataagtagaagaatttcttctgccaccctatcagtaaacaccttactgatcaaaaactagtgggcaatttttttctctctaaatcagaagaaaatcttgccatagtctctcaccaagaagtgaaccctgctttgtttattacacctaagatttgtcttctgcgaagtcagtaatcgtttaaagcaatctggatgatttgtacttatcacagcttagaacacaattcttcagtggcttacagcagaattaaaagctttccactttctgtgaggtgttagcaaccttaatgatcctgattttatgttttaataccataaacaaatcatgaaaataccatctactgattaagtgacctcatgattaaatacatatttcatcttgtacctaatagaaggttgacagagagagggagagttcaaatgaggaatagaatgagccagaaggatggatggcatttttatttgcagaaaataggaatacatttttactgctgtttatagaaaacatgttcgttggcacaagcttcacaaagactagcaggaacagaatcccacaaaatgaagtttaaagtaaatagtggatagatacctaaaaatttctccaggactcaaagcagtttggtggttaaatgccaaacaggcattgtagttaaaattatgcttgttaaaagaatatgttccattctgtaatgttcggatacaaaattaattctagaagagtctgccgggggaaattttatatttttcactaccattcaaatatagatattgaatatgaaatgtattcaaccttcattttgtgtcctgaggttttatatatttattaaaatgtggttcttctttttttcttaagtcattttgttttctgggtctagaactcatctttttgtaagacttttagatgtaaacaataattcttaaatcaatatgtgttgccatgttctattagcaaatattttaagactttttaaagatcagctcttctttttgagctgagaagtctgttatttc

SEQ ID NO: 73950 - DNA, 1052 bp, Homo sapiens
actggtgtaaacagtttataaagtataattattttttatgttcttagattcagtgtatttagtatgttatttagtgttcttttttgttgttgtttgctttttcacccaagctggagtgcagtggcgtgatctcagcttccggttgcaagtgtttctcctgcctcagcctcccaagtagctgggattacaggtgcccgtgaccacgcctagctaaattttgtatttttagtagagacggggtttcaccatgttggccaggctggtctcaaactcctgaccttgtgatccgccctccttggcctcccaaagtgctgggattacaggtgtgagtcaccgggcccggacttagtgttcttaacacagtttggtttataattttcctttctttggtttttatatcaggataatgctggattccaattctctagaagaatttgataaaacttctgcaaaatcatcttgtgacccatctttgttttttctatgggaaatttttgtgtcatgaattcatattcttaaattcaataatagaattattcagatttaggttttttattatgtcagtctttgcccatcatttttccagaaatttgccttttgcatcaaaatttttaatttattggaacggtgtttattatatattctttttaatgcctgtagtatctcttctgttattccctgttaattcatgataatgataattttcctctctttttttcttgattagtctttttgaagtttattgatttcatcagtttttttatataatgaggctttgggtttgttgatttttctccttcaaattagttttctatttaatcattttctccttttttctaatttccatttttctcagattttaatttaatatgctactcatttttctatctttgtaaggtatatttttagatcctttacttttaacctgtctttaaaaaaaagtttgaaggaataattttacttgtaaacagcattagttgcagtcctgaaattttaatattattaggttttcattttcttttatttgaaaagtttctaattttattgtaatt

SEQ ID NO: 73951 - DNA, 1052 bp, Homo sapiens
agtctggtggtattcagcagagcatagaactttccattctggcatattggatgatgtccattgcaaaacaatagtggccattcgtggtgctttctcttcttgtcattttgcatccttagtaatgataaaatggacagctattacccaggagaggaaaatggccaaatgtttacttaattgaggacctttaaattctctctatgctattcttgattgattacattcatttttgtctgtatacctactgagttttcttgataagatgaacaaaaaaaggtttggactggagaacttgcctgagttttattaaaatcttgcagtcactattttctatatggatgtatcacttccatctgatgtggggcatgggtaagtgtaatctgttctacttgtgagttttgtgactcacttgttttctttcagccctttccctgggttcattgacttagtgttctctctcatttgcgttgagtcatgaagccgatagtgccgcttgtgcatcgcagcaaagggccagccacctatgggacacgtatcaaacatggatcaggagccatttttgttctagggcacatgggctggttaccattagttctcacatttgccctttcccaccctcaatgcacctgaggagatcatctcttagcgttatggttgtgtattgatacactgcccaacctctgcctgaacatggccaaagggatgggaatgaaattctagtgtcatattttttttaccctatctatttttattgaggtatagtttatatacaataaaatcgacagttttttttaggttgaattttactaattgtgtacattccaatatccaccctctaaaacaagatgtagagcatttccatctcctcaggaagtctcctttgctcctctgcagtcaattttcacacctctacacctcttccagatttctgtcaacatcaattagttttcctgttcttgaactacgtataaatggaaccaataatttttctgtggctggattcttttgttcaccatgtttttgagttctgtgtatgtttcagtggttcattt

SEQ ID NO: 73952 - DNA, 1265 bp, Homo sapiens
gtctgagttatctagacttctgctagctaaaatctttgcctctaagaagtcttcctactagaaaaaaacaaatgaaaaatgaagataagatgcagaggttggatttaggcattttaattttttctgtttaaatttgggagtgctccgagtgtgctaacttgcacacagctgcactcagcaaaatactgtaatatattgaggcacacggaattgcaaaacctttcttccctacacacccctcatctaaaaaaaaaaaaaaatcagcagcttgactgagcttaaataactgacttttcatatcctttcatggaacacaaaggactagtcctgaggctacttgagccaccaatgcaggcagcagtggagaccaccactgaatgtgccagtccctcctcccacaaacaaaacacattgactgcagctttatgaagtgaaatgcccaagaaaaagaaaatgtgaaggaggtgtcctcagtcatttcttccctaggggggtgggagggcaggatgaggggcaggagaaaaagctgctgcatctggatgtggagaacaaagccatcctaagacttgagtataataggttgggtcactcgcttttatagaagcaaaagagtggaactgccttgacttgtctcagtaccactgacccttacatttcattgtgtagagatgtcagggaaagtgtgtagaaagcacactgaacaatgactttgtcattttgagatttctgaggtttgttcaccccttcccccaactcctaccctcaaatccccattggacaaaagagatcgttagttaggtcgccttgccgtcatttgaaagatctctgttttactgagtctttcaaaagtaaactcatccattttaactgaatcacggcgttctcatgctttcaaagtcaacaaaagagttttagtcactgcatttacaaggatggactagtctgtgaaaatgccagccctagagataatgattcatgccaactgccacattaaagtggatttccttgttaatagacagggcagttgatgacatgagttactggaaatatttgccaactcttgacccctggatttctgagatcaggatgataggattcacacaggcccactctaacaattcctttaccttttcttttttaatgaaagatgcaatggttgggttttttccagtgtgatagcacatgtagaaagcagtactgtcaccattagtgtggtgacagttaatcactggggaccctcccaggcttcccaggctggcaaccag

SEQ ID NO: 73953 - DNA, 1122 bp, Homo sapiens
tttttcatgcctgtaatctcagcactttgggaggctgaggagggcagatcacttgaggtcaagagttccagactagcctgaccaatgtggcgaagccccatctttactaaaaacccaaaaattagctgggagtggtggtgcacacctgtaatcccagctacttgggaggctgaaagaattgcttgaacatgggaggtggaggttgcagtgagtcaagatcataccactgcactccagcctgggcagcagagagagactccatctcaacaacaacaacaaaaaaacccaaaccaaaaaaacctcaaaaccaactttaaggattttgtattgtgtatcccttatttccatgctggccaaatacaagttcacatcacagcagcaaagggctttgtctgttgccctgcttggggaagctggtaaggcttcctggttattcctgagccatgtaggggagaaggaggcacatatggcaggaagtgcaggagtttaggatatctacagggacactgcagtgtggaatagctgcatcaggaggtttgagacaaggcattagaggagatcagatggagagatgcagaggggccagatcacaagaaggcttgtttcttaagcacaggaatttagagtttagagatttgggtggaaggatatggagaggaatgggagactgtcagaaagatggggttgtaccagcatcaggaaaacaagaaaggatactggtttggacaagtttctctttaggacatccaggtcagaatgccttgtgtggctaatgaaagcccttgcttctgaatagggggcccacactgcaggatagtcgatcccctcaggcatgtgtcattcacaaggctgtgtcccagtagaaggccagttaggtttgcacacctccgtgaatgctttactagatcaactgttaaagctgtcagatatcttgccaatcctgtcaaattatagttgcttgcaaaattggagctgttctcaattccaaaattaaaaggaagccagcatcatttatgtggtctgtttagggtgattctacctcaggatatcagagccatgaaaattccctttgcaagtgctcttggttctctaggaaaagcttcaggttttgtttttgttttc

SEQ ID NO: 73954 - DNA, 1062 bp, Homo sapiens
tttgattacgttttctgtatgatggtgatcgttttattggttttgtaagtaggagtctggaactgtggaccattgggtcagaactgaactgtttccaattgagtttgccaaagactggaggggtagatctgagaggagaaccctctgcttgtggcttggtgtctagaatgtaggctctgtagaagcaagtctgaaaccatgcacagattttattactctcccgatgaaatcgctgagataaggaaattctggtttacatgtgaccagatttgctggccagatagaggcaattaacctaactttgatttttggacttcaataaaatatttgtatttgtgagttttcatttgtttttatatagttagatgttggcactcattgcagatgggaacagtgacactggtaacttaaaagtgggtgtcatttgctgtcctgtattaagggaagaaacccagaggggcagcgagggtaatgtgtcactttggaactcagattggctcaggtgtgcaacagtagtgaataaagaaaggtgaggtttttgattaggccttttggaaggaaagccagaattaagggaagtttttgaatatatcataagatataaatatatcactggaaataaataacttatagaatacaaatgaacagtctgcaagttacctcaaggttgccatgggctaatcagataatttagccaaggctggcagtgcacatctggcttataaagagttgttcaaacatgtttttcttgtctgctttttcaaaacttgtaacagctttgaacatctacaatatttctaaagccaagtcatttatgaacatagaatggctcttcacaggttaaaagtgaatatcttgttttcataaagaattgaaatacaaatagcataaagatcttcatctggaacttatgttctttgaataggaatttggcattcaaaacatagtatgtttgcgtaaatcaacaaacaaaaacatagagatgatagtcaacattcacattttaaagtgcttgattacttcctttttttctgtggttttttttttttttttctttctttt

SEQ ID NO: 73955 - DNA, 1697 bp, Homo sapiens
tttctttgcaacaggaagctaggcaaaggttgagtttccgaagctggctggcccactatgtgcttagcagagtgagcggtcgtaattagtatcccttatgtgctttgtctcacatatggagggagagggatggatgctacttgatgtcaatataaaacatttcttagaagcatgaggagggaaaattctagtctcgttgtacttctatttaaccagagagacaagggcgtttgttattatccactcacataatcttggtaaacttaatgttgtggaatcctactggccccaattagctgatttcttgaatctacagcgaaggttaaatcctaatgttattgtctccaagaaaggagttttatctaaaggataacttagttatcaattatgataaagatctattgtcacttgttttgtttgcaggtgtctttaataaggcttcccataatcccttcaggaagaaatattttctccttttaaaaatagtattagctaaatataaaagctctggtccctgccattgttgttgattctttgagggacatttcccaacattcattgtttaaatggttgtcaggaagaatcaagtgaaacgtggtaaacaatgcagtaactggttcatcttactttgtgtgccgagcctttctcccggggatttgcattcgatgagtgggcttttgactgaggtatcgccaggatcattttaaagtatttgggcctgttgctatattaggaagtgaaaatttttattaaagccacccacccaaaaaaatgcatttaacctgccctcaaataaaggccaacaaaaatctaaatgtaattttttttttttttttttaagttgcctaggcctctctgtaaggatgaaaacagcccagtgctgttctgggactcttaatggaatcatgtaaacttaaaataaacactattatggtaagcacatagaatgaaaactaattttccaaatcaaatacattatattcaattcattttccccaatcaaccaaatgtttaaaacctgttagttataacagcaatcttctggaaattaattagaagcctattagctctgctagctgagccgaatgaagggggttgctcggtacatttctaagtagtctcctgaattaaagcaaagcaaggtcaaaatgacagttagctttgttcacctcatggctttgcttaaagtcgttgatcttttaggggggaaggagggaggtgttttgttttgcaaaggaaattttgtctactttgactcagttctgtgatacatttttaaaatttatttctagagccagtggggtgagccatacaggaagcctgatgttatctgtgtggatagtagccttctccattgcatgggcatctgaaatggagttgaattttaggcctcgtctaccgcatcaattcttctacagggtttatttagcccctttcaaaattcagatagtaggaaatttcctggatgactttgtgtttaacatccttagcaaaacatgcttcggacactggggccctgggttttgtggctgtcatcaggttctatgggtaataaacatgctgctgacatcacgggccctgggttttgatggctctcgttaggttcaataggtaataatcacagtgactagcagttcctcctaagcccagagaaactcacagaaagtgaggccttctcaacccagcagctgagattg

SEQ ID NO: 73956 - DNA, 1038 bp, Homo sapiens
cttggatgatttgctgccgctgacgtttttagatttcatccaggtaacgttgagagtaatgtcaggatctcaaatggaaaacggaagttcctattttttcaagcccttttcatggggtctgggggtgggactctcggcctggctgtgtgtaatgttaacttaataaagggccatgtttgtaaaagaaaggtgcggttataactcagaggctaagttggcatgagtaataccttgtgtgtgggagtggctatacagtcgcgtcagggttagtttgaagcagcttcgtgcttggtaagtggctctccgtctgcctctaggtatctggcgtggattttgctttactgtgaacacatttcataatacagaaacaatcacctctcacggaaagatagcctagattaactaaattatgcattgtattaccacaaagggcaaatacttaggcactttttttttttttttggatagaaccaggtgtggttacttacaaagaaaagattagtaataataaggtgaaaataatactttattaacaaggacaatagagagcagttattgcggatacaaagcctttaaaggcaaggatatctaagccaatttgagtacaggatcaaagtcaactcagaaaatgtcttttttgttttcacacgttgattgctctaagtcttaagctgtctttaaaaaaaaaaaaccaacaatcctacagaaataccttctgtaaaacttttcttttgtttgtgaacttgaggctctaaaaaataatattgggtcatctctcatctccttattcagtactgttgctcatgtggtttggttttattttattttttcctattgtttaattttgtctacttgtcagtggttcaagctggggcactttttttttcccaagtgtttattttggaaatgcatctattaaaagctatacatattccaaaatctcagctgctgttgctaacactttatgaaatttgaacctctgtgactttttctaagtgccaacttagaatagttgtaatcattagctgaatttaaagc

SEQ ID NO: 73957 - DNA, 1037 bp, Homo sapiens
caccccacctgagttttgttacatgctggcagtttagataaatggatattataatctcagcacatttctgcccaacaccactgcacagatttgcaagagtctacaaaagtgataatattctgtcagtttggagcctagaaaaagaagaagaaggagaaaaaaaagcattttcttgttcgtatttctaggatgcctgtggggaagccggaaatgccatatagcagtttacatggctaaatacacatgaaaaaagataagggacccaaagatgtttctttgtaggcacacgggagaagagtcagttcaaattggtaattgtcagctgtgtttggagatacattctccatcgcaaccaaagatttttctttttcccccttaaactcaccatttccttgaagaatgcagtctatttttaatgactttattgatttgacgattgggttacaatgtactttatttactgcagaaatgtttcgttcctgtcagcacttaatgcgaataaatctactttttggcaccactttgatagactgtaaaactgcttatatttgcaggaaaatttgttttgccacggtatgtttatgtcagactcagtgtgactttttctcccctcaaaatcattttatatcatagtgtagctgacaaataaatacacacagtgcagtaatcattgtgtactgtcagagcagcagaaaacaaaatgtgggttttatgacagggatcaaaaaagagatttaatattcacaattaaagccacttatttaatgctttctgtttttgcttctgtattaaggctttccagtttttggttcatagtttgtatatctcttaaaaatagtaaatatacagtaaaccctacattcactgatattgtctgcatgtgaatttaatatttattatccaagaagacccaataaaagtcgatctttatttcctattgttcaaggtataagcaaagtcaaaatacatttgcaatacgataagttttctgttaagtttctttcttttcttttttttttttttttaagatggagttt

SEQ ID NO: 73958 - DNA, 2734 bp, Homo sapiens
cggatgataaataatgcatctagacaaaaagagaaacaaagtgaaactcagtgaaaagtaaatcgacctaaacagtctaagaacatttaacgttttgattacatctcatgacatttgatatcttgaccccttcagcctgtgctggctgttgcctttgcctccgacttgtaatgtcagaggattaaagctcttttactcctttctggtgaaaatatttgcaatttcagatttgtaactagtagatctgttcagctgtaaggaaacctttcagtgatgagcaacacgacttttcatctgagggatgcagagtctatgactgcccgagagattgggatcctgtagtggttttatttcattatgagcctccaccagtattatttaatgcaaccaggttttgaatgctggtgagaacacagttaaggtcatggtctgcaaggactttgatgtcgtgcagaagcctgattttcccataataggcatgaaaagcttgtgcaatatagctcttaggagatgaatatttgttcctgtaggttacaatagcagacataacctgtgagtgatggaaaatgtcgggcagaatatggatttggaggaaaaaggggaagaactagtatgaaaaaattagccatagaaatcgatagatactaggccaagaatataactgcaaacgtgtcagctgggttttcccaagaatgattgacagacactattgcagatcctgcaagtaaagaatttctgatgttttctttttttttcctttaaagttcaactaaatgatttccttatagatttgaaactcttttctccttatacagaaatttctcctctcttcttagttcccagatttttgtgctaagagaatgcataaaaggcaattattctgttgatatctttttaactatctgtaaagatatccatattgattcttagggccactaccctggtacagtttttggtggcttgaattaataggatggtttgctgtccattttatttgtgtctggagaaaactttaggttttaatgcacttgcaaattccttgggcaatctgtagcctgtttggctgtctttgttgcctttcctttagatgctatgccgagtccatgaagtgctcttctctctaaggaatacagagactggggatagtccccagagttgaggaaacgtagagccccgtaggtgtaccagttatggtgggtggtgggagtgccctgggctagcgctgaaacttcaggttttcagtggttgacatcatgagtgaggagacttttggaagaagcagaactgaaggtaagactgagtaagtggatctgtccaagagtaaggagagatgaggcctggagatggtcaaggcaacacacagaatctgactttggcagtggatcctagaccagatcagaaccagaactagagatcaggaggtcagcatggaatcagtgggaagccttccatctgcatggttgccagcttcgtgccaagggatgttctggcaattatggaagcacatattggtacaggtttgactaaccacccagacttttagcactggagtttgttgttgcttttttaaattttttcccccaggacagctgtcaatttggggagatatacaggtatgaattgcatgggaaagaaccattgaatatgactctgggatggttaaatatcttgaagctgcaaagaaggaacatagaacaaagaacaagatgaattctcatcttatgatttaaactgcatttaaacaatgtccgtagatcctgccttcctggaggtagaggccaagtagcaccatatacatatgcgtgctatttctgagcactcacggccccattgggcatgggctgtgtaggtgccaaggctggaggggctcctggggctgtgggtgttttgctcaccccctacacagcttgccctcatgcttctctgtaacagggtcaagtttctgggttacagctgccacaggaacaagctggcacattcttcttgttttgaatttgaccactgggtatttatttattttcccacctttgattgacatcaacgtttggtgacctccttcatccctcctttgggcggccaatcctgcccagccacaacactggtctcagttctcataatgatgttcccatcatgtctcttttgtaaacagagcaaatacagaaaatgccagtttctaaactttcacttaatttctacccatccactcagaaatacccactgagtcttatcttgagttaggcactgtgtttggagctaggccaagaggtcgtcaaaattgtggggaagatggatgcgcagtaagcagcagagggctgggcttgggattggctccgtggaaggagaggcccaggggccacgggagtacaggagacaagccaaccagatttgaggtggggcgagccttgaaggatctctcacggacctgtcatggggatgggtggttggggttacagcagccctggaggtaagggaaaggagctgcccagctggcgtggagtgattgcaggccaggtggtgtgagggcctgcccaggccaggttgggccatgcagggcagataaaggattttaaactttatccctagagcaggaaggctttgtcttcagtaaaatggatgcctgataacgtcacctttcggtgcttgccggagctccatttcatcagggaacctattaagagtaaaaatagggactcatttggatttttaaacttttttttttagaatcaggatctca

SEQ ID NO: 73959 - DNA, 1036 bp, Homo sapiens
ctaccatagctattccttggcatttgtgtcctactgggagtggaaataattctgtctttggtatgaacattttttccttttttagctctccaaagtgataatggagaactttttatttatattttaataaaaaggagagaaagagggaaaggagacagagaataaactctcaaatccttccaaattagaagtcctgttaactatttcaagatgtctttggtcattctcataaattttagatttaattataaatgtatctagaacatttcatgtaggctattttggaaatgcagttgaacttttaataggactcatcattgttagactttgaatgacagaataacatggtcagaaggggcatctcaggaggttcctgttagaagaaccacagccaagtgcctttcaagcttgtggaaatcccatccagctgttctctaggcctgaaaaaatgtgggaaatcgaaagattggtgaattctcttggtggtctactcagaagaaaccatattagtaatgttgatggttcagtatcaaacctggcttgggctcagagcttgtgagcctagagtcacacatgtaccaatccaggtgagaccccagctgaaaaatttctttgccttgttttatttatatagctaggctttttagtacatggcccactttttagctacttgccctcctccacccataaatcatggtgatgagaaagacagagattcttctatcatccattttattccttgtttcttcttcttattattatatttttttggcagtaatttaagagatttgctttctttcttgtttgctgtagaagtcaaacagtatttggaaatttgcggaaaatagcgtttcataaatcttctaatttagtcttcacaaggcttgatattttatagtgagacactgatttttactcatacccttttcacaagtagtatgatgataagatctaatcctaattctagccatctatttgttctttgttctaaaacttaagtgtgtaccttagatatcactatttcttttttttctgg

SEQ ID NO: 73960 - DNA, 1649 bp, Homo sapiens
caatgaactgtattgtagacagaagtatttcttattggtgccaagttggaaaagttagtcttgacgtggtcctgtaaatgaaaggaaaatcaacacatacatttcaggatcatgagtgatcagtgtcactagaaaagtgttcttctttcactttaagattaaataaatagttgttgacataaatagccggggtaataaaagggaacacctgtgtaatccagccatcagcagttttatcgtacaatcagataagctgctgtttgttaaggaattgtcaagtctttagaccagatgaatagatttagctcatacgttagagaattttaaaaactgaacagaagaagctttaatttcccttgatgccaaatgttctaaccactctcatctcctttcacacacgagaagctgtaggagtttaaagctcaattgacctagccttcaggtatgtcttcttccattagttattgctgtaccaaagtagctaaatgttctagatgagattagggtttgaaattttatatggcaaaataagtacctcatcatttttggataaacatggggtattttttttctaatacagctcatcttttctctccctttaattctcatgtccactttcatttgatgtcaaatgagagagaactttggttgtcatttaagagcctcttgatcaaaacagttatcttaagaagcattgattgtgtgtgtgtgtgtgtgtgtgtgtgtgtgtgtgtgtgtgtgtgtgttgtgatgggtaggggagagggagagagagactttttagttagcttgtcccaccacaataagaattatatttttggattctcttaataatatgtgaaatttaaaatttgaaaattaatcagcaaataagatgtcctttgacttcacccaccagcaaatggaaggatttttctttattttctaataggggatttaaatcactatatgatttgggatccatggtacccttttggtaaaaagcatgactttagaatcagcctgcccaaatgtgaatctcagctcttccttgctgaattacttaaactctttctgcttcaacttatttgtagtatggcgatgatattaacagtacaatcctttttttgtgtgagtgacaattaagagaatcaatatatgaaaagcatttgatatggtacctaacagctaaaaattgatttttttgactaattgagatgatgaaattttagtagtcttaaaaaatgtacaaattccaaatttgctagttttgatgaaacaataggagtctgggaagggtgtctgtgttttcctggatgcaaagaaaaatagataaatgaccaagactaacaagccacaaaagaaaatcaatagagtattttttttgtttgtttgcatgttttctttttggttgtgttttcaatggggcttagcttcattccagagttaattttaaatttaatttggttttacaatgagagctcaattttgcatgtaagtaccaaacatctggtttactttttgtttgaaaacgatacagctgaagttgagtacagaagtctattgtgtaattaaggaaagagagtttgaaattttgtaaaataagttctatttaaatggaatattggaattattccagagaagtggatatacttcttaggagtaggaga

SEQ ID NO: 73961 - DNA, 1074 bp, Homo sapiens
catgttggccagactggtattgaactcctgacctcaagtgatctgccttcagcctcccaaagtgctgggacaggtgtgagccaccacactagaccaacaatggattacttctaaaaaccatcctgtgtcagaatctatgatctcatatcaaaaagatgcatattaaaattaatgcagctgccaaatggaagtctagatacttttctagatacaacacacatgagcatagctccatcagatatgtcttcttcataattcattggccttgattttataaaatttccaaaaatggttcttttggcacttcaaaaccaattgtgttcaaaagaaatcataccagtgggagtagcagaggtgttcaggaaacaaaataaatgattctttatttcagatcataatctctaagcttcaagtggactcacaacaatttctagctagactcttgactgggcctagatgcttttctgagccactgggggaggtctaagtgctacagctcagcttaggaaagtgtgttggagaaaggggagggacttccagtgttgccctttacaagtacctgtacacgctttgggcttttagaagtattgataggagaaagaacataagtaatgatattttccctgtaagtaatgttatcatgaaattcaactatgattcactgagtgttctcattcttggtcaccaggattaatgtttgagaaatttcttcctcgtttaaatagaagctctttcatatctcaaataaagactcgacaagcttcaaagtacattttgaggccctggcagtggggaagggggagggagggggaggaaaaaaacaggacatttttgagaggaagtttattaaaaacaagttctctgttctggaaacattttcctttcatgtcttgtttgcatttgcattttaatagattatatcacataggcaaatgttccagcacctcttgaacacctggaaagcctgtcttagacttgttctggtgtttagaaatctttaggcagacagtgttccaaatacagtcatgctcgccaggcatggtggctcatgtcatataatcccagctacttggg

SEQ ID NO: 73962 - DNA, 1051 bp, Homo sapiens
aaaaaaatcagaatatttacaacgctgaggttgtgacattttgttttccatgaagtttaaaacatttttgcttttatcaagtttttgatagtgtttatgaaaatgatagttacattctaatttaggtaattacgtatttaccacccttgtcttatgttagccttgtttcccccttgtcttccttgccttgttttccccttgtcttcttggagcttatctgttgtttccttgctaaatcccctgagcccaggattggatacactgtatctgattagtaaatatttgttggctggacagaacaagaaatagttccaagagtgcatttgcatctctttaagcaacacccataaagaacaatgggactttacagtgttgaaataaaattagagtgttttttgtcttacagctggtacttatattaaatttaactcttgcttccaattttctttttcaaaagtacagtttgtaatagattactttggtggactttgtttctgatacgtgatggcctgaagagaaaaaccgtacattggttctttggaagctgtgattcatggaactagaccaagttctcctgttgtttaccagtcaaagaaatgaaactgtcaaacacctaataacttttttgggggtttagttgtgtgttgaaggtgacttttaacactctgtgggttaagcgtctggtactgtatagttttgtttcataaacttcatgcccttaagaagtaaagagaggaattaatccatttaaaatcatcagtagacattgaaaatctgttcttgcacagggagttgaggtgttgagatgccccaattctgctaggatcatagtttgtggtaactaagtcggtcacattacttctcttagcctcagggttctaacaggtaaaaagtggctttttcattcatcaagcatttcttggtcttctactcatcgtcagttgtggtcccaaacattgaaacaaaagtacctgttttcaagggacttgcaaacttaaatagttgccgacagtggatgatgatgatgatgatttcttctccttcttctcct

SEQ ID NO: 73963 - DNA, 2119 bp, Homo sapiens
ctttgtaagcatgagtttgcagagaaagatagttacacagttagtttctttagttttcttccacgccaacagagttagcagagacattttattcttatcaggtctctacaatttcactctttgttttggagaaaagatgagcggtttgttgtcctgttttctcatgcctaattatggtgacataacatttagctaagtacactgactctaatgggtgccagataaatgtttacttgctttcaatttgttaatttggctttaagaacccaagagctggtgttggtagaagtgtttgtttactctctcagggaagtaaaagttaatattgggttacagccagtgtgttttacacaactggtttttctccagtgtgtgcgtggggagtatgtgtgtgtatgtatatttatgttcatcgatgccttcaacagtgtaacaaaaaaaccagattcatatcattcttttttctttatagattaaggtaaatgagagctaaaacactagataaaagaaaaaagaaacatattgacttcttcccatgtttcttttttttaatccagtggaagatgcttgtggtcactgaggtatggaatgcgaatgctagtactagattttaagatagacatattctcctatgttccctaatcaaaaatcgagggttgccccagtgattaagattctcagcttttagccaggcgtggttgtagtcccagcagctcgggaggctgagtcaggaggattacttgagtctgggaggtcaagactgcagtgagctgtgattgcatcactgcactccaacctgtctccaaaaaaaaaaaaagaatgattccttcccagcttgactgaatgggaagttaggatgtgcatcctacaggaattgaggggaggagggtggtagtggtttgaactattgttctgtttctgaaacctggaaagggactctggaatccactacaagttgctaaataatttgtggagaactgaaagcaacctccatgatgagctttttatatgatcagaaagactgtcttgcgatactctataaaatctgatgtccatatcccacttccttgccagaaaaaaagagtcatcaataaagaagaaacataattgtagggatacctatttatctgtttattcagttcaaatgaccactggagttggtgctaaatgtgcatttttaacaagtataatatttcagcactgtcaaaattacctctacaataataggcttgttaaattatagctctataagctagggggtaagatggctctgcccagcacacattaatctatgcctgttcacacaagtgattctgctgagcaggtagcatgtttaaacaagaaatactggtcctaaaacctctgatttatggtaggtgttgttttgacacagcaccattcagacaatttacaaggcaaagcttcgtgctaaaatatttcctcagtgtcatcattcgtcaccagtataaatattcagtagtgatgctggaaaattggtaatatgcccattgatgccaaatcactcgctatgtttcctttcaagtgagatctgttgtggatatggttaaaagaaactatgatttttcttccttgagagcagatgagctgtaagaaattgagaataacaaccgtcctgacagctttcatgtactcaatcttgcctatattgcttttaattctggcttaagtcctgcgggctttccctcccacccccttgcctgatgcgtattgtaaagaacacatttatatgtacattagttagtttaagaggctttttgtgttcaaaggaagaagttagtcatcaccagaaaagctttgttgcaaaacaaaaacacacatttcccctttcattttttcttgttaataataacaaatgcaagtgactataaagggaataacacaaaagattgcatcaatcataatgattctcaatagccacataaatattgttttttcagctttgaatgaaacagctaagagtttgaagtaggtgtggtaattaaatcctgtcgggttatcacaaattaaaaataatgtttttttcacataacaatggttatatgtacttaaactcttatcaggggtgatacgaagtcatattttatgggagttgctcctt

SEQ ID NO: 73964 - DNA, 2312 bp, Homo sapiens
tatgtgaataatggatcctcattcatgtcttaataaaatgtatgatttattttattcatttaaaaatgtcttgtgtctatgtaaaacagtgggggattagttgcttatttagattaattatcttatgttaaaatataatttgtgttttcttgcaattcaattattcaagaggttttccacatgcaacttaatacggtatttttaaattctttaaagctacttgggcattttctacaaggaaaaggtaaatcatttctcctattccttgttaatatcacatgttggtatcaaaacataccaccttttttagattatgggacataatgtaagtaataagatttggaatatggagaagatcaactacacttcatgattatctatcctacttctgagtttttaatagaacttgcaattgaattagagcctagaatgaaattgtattatacacctgatttttcttttctgtgcagtttccattcagtgagagaaaaataaactattttaatccttctttgtcaatgtattttgtaaatacattatacttatgtagaatccagatgctttatggaataaattaagtaacatctttataaactacctggcttgctttagcaactattgaagaaaatgcagagatatgctgtgttctctaagtgatatttctttatttcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggtaagtctgacaccaagtttctcagtaagtatgtcttgttaacaacacatttaggatctgattacatttccatctttgaaaatggaagggatgctgggaagaaaatcactatgcatgttgattcattttccacaagaaacttcactgatatttttctcctaccagagaaaatctaaatatgcggggggaggggggggcatacaatcttttattccaatttatatgtgtgtggaaaaataaatgaatgttcactttgcagaatgctttaggaatccatttgctgtgaggcaagtgaagcatcctgcattccctgtaaacatgtttaaatgtagttgaatagttgctaaacattggctgtgtttacatagtgttaggttatgccatttttcagagggatctttgtaatcaggaatgctctgacgtgagacaggccgtgcatttctttctttcattgggaaacccgttcatttctggaaacacagggtttttgtacataccctgactgtgaggtttccctgaaagataatatgtggttaattaaaagccaagattgataaaatgtaaactccccttcaagaacagtttctaactctgtggttttgaagtagacttttggttctataatagagactttgttgaacctgccatatagatcttcagtagcttgtttcctaggtatacccaactatacccagtattttccaagtggttgatgcctctgcactatgcgcttcttatctgtcctgcttctgaggctagccttcctgacctgggttcctagggagaattagttgtgcctataagtccccaccctgctcagttgagtggacttgtggggaggcctgagtgacattgtgcaaatgataactgccctcatagaagcagggaggtggcctggagagaacacaggcacagctttggcctggccattgactagctttttgaccaaggccagagcacataggtgctattacacaggcaagtctccaagcagatgctgtagttcaaagtgtgaactcaagctaactacctgggttcaatcctggtgctggttactaattgttatagctgattatagttacattcatattcatgtcctagttacttaatttttctgtgtcacagttttcttatctgtaaaatagggatactattcatacccaccaaattgaaatcttatgagaattaagcatgttaatacattcctagcacatgaaactgggtgtagcaacatggtcagtgcctaacgaatgttagtgacaatgaagccatgtatctgtgaactgaatcaccttcactgtggggtggaaattactcctaccctctctgttttacatgatttttgtgaagattaaagaagactgttctggaaagcatcttgtgtagatttatttaacaaatacttttcagtccaagcactgtgcaacgtgcaaggatttgtaaactgcagagaccacacaaatatcggtctgatttcagctgttattagaaa

SEQ ID NO: 73965 - DNA, 1050 bp, Homo sapiens
caagtttgatttttgtctttgttgtttctcccctcctaggttgcctatgtgcttcaagattggtggctttcatactggtaagttatttctggtctgatgtatgaaatactccaaaatcagtaagaagactcgcttttccatagagttagagggaggtgtttgttgatccttctcttctaatcctcacttcgtttacccgaagaaaaattagagtgcttgctggtggagtgtaaactgcggtggtctccacccatgtctgatccgcggcatcatgttcacagacagtttcgggaactgaaagttgtgatttaaattgaatttttataaggtagatatacacaagactaagtgagctgagaatcattttccagcatgaagcgtttctcccaaattgtggttcatttttaaaaaaatgtatttatctaaatttcatatatagcttaatatttttttctccccatgttccatagggcaaacaaacaaagtatgctaaatgtcactgtaaatggaggaggaaatgtaaccgagaagctagatcttaactggtacttaggaatttattcaggtaaagtttaatcatttggtgtattgtatgagaggctgaggtgcttacaatgagcctgtgtgagtaactagggcttccaggagtcattcagtaatgtcttaacagatcaggagtctcagtcgaatttactctgtgaattaattagaataattattttaaaaatctactagaagagaggttgactgaagactcttaatttgctctgtactggattttgaaagttaaaccaggattgagcattcagaaaatcagccactggaaatatgtggctattgtctattctaataggttgctttagctaaatcttatatcattatacggatgggcagggggattagaaacggatctccaccctgtggttcggatggttccaattctgtctaaataaaccctggcttttattgaacttggatgaaatcctctggcagcaaggcccccaaaataaaagcattattccctcccaggtatgcaaagctcccttcagc

SEQ ID NO: 73966 - DNA, 1009 bp, Homo sapiens
atagctgggtgtggtggctcatgcctgcaatcccagcgctttggaagtccgaggtgagaggatcacctgaggtcaggagttccagatcagcctggccaacatggtgaaaacctgtcttcactaaaaaatacaaaaaattagccaggcgtggtagcaggcatctgtaatccctgctactcaggaggctgaggcaggataattgcttgaacctaggaggcagaggttgcagtgagccaagatcgcgccactacactccagcctgggaaacatgagcaaaattctgagtcaaaaaaaaattaaataaataaaaaataagtggatgtatagtttggctagctatttccacacccttctccacaggagatggatcattttggacttctgcctgtttccccacagctttgtcaacagagtgcattgtcatctttgggaacagttttgtatactgttttgtctcttaccaccttttttcctctgcagacagagaatgtcccagttacactatcagaggagaaccgttctgaaggaaaagttggttttcaggcctataagaattacttcagagctggtgctcactggattgtcttcattttccttattctcctaaacactgcagctcaggtaaataatgacatttgttttgcgccctcaaaatgatatttacagtacctatgtttatgctattatgactgcatcttgcagttcacttggggtctgaattgaaatgtgctgtctttggggaacaaagtgagggctgcctactggtgttccatgtccgttacaaagacctgcgaaaaaagggtatctttcaatgattttaaaatggaatatgcattttcttgaacccttgatatctgggagtttgggcttggcacagacctgagctggaagaactatgcgagttctctgagccttttattctttctttctttctttctttctttttttttttttttttgagatggagttttgctctgttgcccaggttggagtgcagtggcgcgatctt

SEQ ID NO: 73967 - DNA, 3003 bp, Homo sapiens
gagtttgagaccaacctggccaacatggtgaaaacccatctctaccgaaaatacaaaaaaattggctgggcctggtggcgctgcctgtgatcccagctactcaggagcctgaggcaggagaatcacttgaacctgggaggcgaaggttgcagtgagccgagatcgcgccattgcactccagcctgggcaacagactgagaccctaccacacacacacaaaccatttttccactggtgggcacccaggatgaatgtgtgtccattcttgcttcttgctgtcgacccagccccttccctaacagcagacagagcacggttccccctcggaacccactctgcattgctcctcagtactcggcttctgaggaaaattgccatctcagtaccagtaggagtttccttgtgtgtcttacagatactatgtgaaaagtggtcattttatcaaactaggtgtgtcacttttacctcctgtgtggaagaagacacaatgtatcatgaagcatttttgaattctccagttatcaaactggtccaaagggcccaaggtgtcgttggattttcctcagtggacccaccttttgggggtggggaggattggggtagcagggagggtcctggccaccttcccccacctgacttgccttagccaggagctgctctcctttgatttgttttgtattctgggagtttgcctaatattttgtttgctgctgtttgaggaaatcagttgggtctcatttcatggggtacacaaatagtaaagatatttgtacattattttctatgactttgtaaggagagaaaactgtgcaaggttgtgtcccatggaatgtcgaattttcagttaggaactccctgagtctttggggcaattatttatttatttatttatttatttatttatttatttatttatgagatggagtttcgctcttgtcatccaggctggagtgcagtggcttgatctctgctcactgcaacctccgccttctgggttcaagtgattctcctgcctcagcctcccgagtagctaggattacagatgcccggctaatttttttgtatttttagtagaggtggggtttcatcatgttggccaggctagtctcgaactcctgacctcaggtgatccacctgccttggtcttccaaagtgctgggatttcaggtgtgagccactgcacctggcctgtggggcaattttagagtaaagaccgtgaaggtgcagttcatggggtctatgtccaagtctggttcccacacgcctttttccagcagggcccatggccagtggaggcttgtggagtgcttcctacctgtgcagatatgcctgttcctacctccctatcagtgttaggtttctttcctggaatatcctcctcaatttactcattccttcaattcttattgcataaggtttatcacagttttcatgttctgtaataagactaccaatacggtcaccaacatctgtgtgataataatcgccatttgtaacacactattaccattttaaaaatattcttcaggacctaacacagagtctggctgagaacagaacactcagttgtgtatcaagttgaattgtattagatttgtcaactaggattccggacctaagtataatcataacttaagatcagttactttttctggattagaattagattaggttaacattatcacctgcacatgtatctctctgaaattctttatttttattttagggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgtgagttcacctcctgttacaacatggcctggttttgttcactgttaatggccttatggatctttggtctactctgttcaaagcttcatcttttgtcccaaagtggattctgtggtttcagggctctattccatgatattggtagattaaaacggaaccaaggcaaaccaccctggttggagttatcctttgtatgtaggctggggaatgtcaaggaggtgagtagcgggtgtgtatgctggtgcaagtcctaagctgtgtgtgactcacactaatactacaattcttgaatttactgtagtgaaatcctacttagtctggtggcccccgacttctctttgcatctggaggcataatttgaagacccccttagagaaagtcctgctgtgggccacatgaaattagccacttttcctgtatgttggaatgttctgatgctgcaggtggctgatggaggtattttgccctgttgtcagatggtttatgttagttaggccagaagtagcatgtgcaaagacccaacagttcctgacacacagcagcccaacttccttctttacctttcaagaataggagctgcatcttactcaccttggtgttcccagtggccagcatagagctgctcaatacatcttcagagtatgtgaatctcatgccttctaagtcctccgggcagaaatgtaccagagctcacttaaaagcatagatattccttgccacacaaaccctgactatccaaatccaggagactgaaggattcttgcagatattcagattaggccctcacatgccaaattatcaggagtcaatttctgaaactcaggaaccaaatagattaggatcatatgctatcccttcctttccaaactctggttactgagactcactgcttgaccccagttactgtgttgagctcatgttttgaccccctgctcttttatgtttccatcttgagtgatgcagttgagagttccatatctttttgtatatgattttggaacaagtttctgtattgacacttgaatttgggtgtgctaggtaagtgctgaacatcctgatggcatcct

SEQ ID NO: 73968 - DNA, 2725 bp, Homo sapiens
tggcctcattttagtgtaattacttctctaaaggttctgtgttggccgggcactgtggcccatgcctgtaatcccagcactttgggaagccgaggcaggcagatcacctgaggagttcgagaccagcctggccaacgttgtgaaaccccatctctactaaaaatacaaaaatcagtggtggatggtggcgggtgcctgtaatcccagctactctggaggctgaggcaggagaattgcttgaacccaggaggtggaggttgcagtgagccgagatagcgccattgcactccagcctggatgacgagtgagattctgtctcaaaaataataataataaaaaaaaaattttaaaaaaggttctctgttcaatttctaaggtgctagggtgagggctggaacataggaactttgaggggagcatggttcagtccataacaagtcctggatagcaaagtggatagcgagtcggctgtgtgagagtaactcatctctgggctctggattccaggggtttggacatgaagtcatccactgagcatggggctctacgtgggttcctgaacgtttacccaccagagtgcgtatgcaaaatgtgcctggtatgggatgatgaagtggatgtgtatgatggtgatggttgcacaatggtgtgtatgtacttagcgcgaccaagctatacaattaaaaatggtgtaaatggtaaatgttatgtcttgtctatttttccacaaccaaaaaaaacgtggatggcagcattgaatctttctgaatgcagagtgcaggataagctggcacttggcattgccgcagcagtctgatcagagcctcgtttcctgctccctcctcattgtgccttgatgaattttccatttcgccgagaagggcctctgtggcttgcttgagtcttgcgcgaggccccaccagttctttatcactcaaacaacaattcccggtgggacgctgtttagagtcgccgcggggaaggaggaaggtattttcattgctgagtatcagtgtgcgtatcgcacaagctccctcagattttcatttgaacacaggaggtatttataaagtcctcttgcacctttaaggattaatgactttggatatatgcttgttagaagcaagcttgttaaaattgttgtttgctaatcagaatcacattctttggggaaacttagggcagggagcacgaatgcaatttaggaaatcactcagcagcaactggagaatgttctcaacgagttagaaaattggattgaacaatatgctatgaaagatggcggttgtgttgaagcttagaaatgtgaagtgttttgtattaaaagtgaatgaattacgcttctatttgccattaacagttttacttcaatcatgaatatatatcgagagttgttaagagttgtgttttacaactatatgttgcaaacactaagtggattttatcacatacaaaaagtgagggtcacttagattaaaggatgctaatccaatttgttgcctgctatagatgtggttgtgttctagaaagcctcaaattctcagacccctgcctctttgagtctcctaatcagatctcccacactgttgcctacctatttgtcttagtccattcaggctgctgattcaaaatagcataaactaggtactccatataaacaatagaaaattgtttctacagttctggaggacaagattcaagatcaaggcgccagcagttttggtgcctggagagggctcacgctctggttcatagacagctgtcttgtcactgtggaaggggtacggcagcttccctgggctggccccttctactaataccatttgtgttggcagattctcatgaaataggcctcacctcctaataccattacattggtgattagggttcagtaggaatttggggagggccacaaacattcaggcacagcactagttcaccttccctctttcaggtcctctaggactcccctacttttaagctacagttctaagtcctcgaatggcaaattgccctttgcagtctgccccattcacctttccaacccttgccatgcaagaccagtcctccagccatgcacacttctttggggtgcctggaaggaggtgtgaatttctcacgtctgcctgtctgtaagggtatttttcctgccgttggacaaccagggatagtttgcctgggcaaaagagaaaaatgaaagacacagatcctacctcctgcctttctcttctgctcctcggagggcatggcgctttctctgtcttcccacagccctcaatgagctgctcttgatccacctatgtgttcttccctccagcccccgcactagactgcgaatgcatgaaggtgcctttgcacagcgcatttgtgccccgggaccattgcacctgctgtatctgccaggaatgcttcccccagatagtctcatggctcatacatcacctccttgcagagaggactttcctggccactccctctaaagtacaacctttgcctggctgtctcttcatggtttactttactatccaatagtgtgttttctgtgtttgtgtagtgagtgtccctacacgactcagggtgttgtctgtttgcttgaccagtggatgtatcctcatcacttagagtagtccctggtacttcgtcagtgctcagcaaatgtatcttaactgaatgaatgaaggtagtgactgtatctgtccctctctccctccctccatcccttcct

SEQ ID NO: 73969 - DNA, 1739 bp, Homo sapiens
ctctgtgccagccagtccatcccctgacaggtctctgctcagaccccctcgatcagagcccttgttgacctccctatataaagtggactttccctctgtcactctgtctccctaagccagcttccttctccttcttagcacttatcacctcttacatttgtgtcaatcttttattgtcaggtcactcactgtggaaactctttcgctgctgaattcacaaggagttgctgctcaaaaaatttctgttaaaatggctcagtgcataaatgctatgaaaagctacagcattaaaatagataacgtgccctgactgtgtatttgataggttcaaacttacaatttagttactatgaaatatttccattgctgttgatcaaatacatgtaaatttctgaagaactaatgtgcaaagtttaggataactttggaagaacacaaagaacagaggaagaacatgttttaagtctctttttccccccttctttcctttgtccatacaggatttacagctgttggaggatggtgatctgactgtgataggagatcggggaaccacgctgagtggagggcagaaagcacgggtaaaccttgcaaggtaagttgcatttcagcagccactatgccggtgtcttttgataccttccagtggtggtgagcacataggacctgcttactgtgtattgcgtcctgtgtgaagcaccttcttgggttattctgttggcatttgaatgaacatcccagttgttgaaagttgtcatgttcctgggtgagagtctgatacctctttgtattttctagagcagtgtatcaagatgctgacatctatctcctggacgatcctctcagtgcagtagatgcggaagttagcagacacttgttcgaactgtgagtgtgtttgtgtcttaagtcatttctgcttttccagagccatttcgagttggctcaggaaagcctttatggctttcagctcatcctactctggtgtccgctcccctccccacactgtcccctgcttccctgaagatccattttagagaaattttgcagaaatacaaggtcaaggtaggaaaatacacaaagtgatttcagtgtgttgcagtgagtggagtgtatcatgttttagggagttgagaaacagatggcaaattttgcaagttttcccctactagtaattacagttgataaccaagaaactgctgatggaccaggccccggagataggaaagatggtactccatttttcaatggaagggtggcacttggcaacctgagccttgtctttcagctcttttcctccatcatttctctatgacaggttagaagtgacgtccttgggaccaacatagggctttcttgggaaggctttgttgctctttacatactaatctgtcagtttggagataacctactagtaaaatctagaatttaagaatgatttgctccatagtagactgtggtttcaagaatctaatgttgcttcatggattcttaccagagtgaacacttaaaacccacaggcatgtaggcctggcttgcctttgaaactagttgtctagaatctggcttccctcccaactcttacgtggtgtttctgggattttctttctttggctcttgcttagacactgagccatggaggtagaactactctggaatcttttctgtatattctataaactcatgtgtgccgactgacacttcctacatagtctagactggcctttttgaaagcattgtga

SEQ ID NO: 73970 - DNA, 4221 bp, Homo sapiens
cactcccgcctgggcgacagaacgagactccgtctcaaaaaaaaaaaaaaaaaaaaaaaaaaagaatattgttttaaatgagaacacatggacacagggaggggaacattacacatacggggcttgtcggtgggtggggggcaaggggagggagagcattaggacaaatacataatgcatgcagggcttaaaacctagatgacaggttgacaggtgcagcaaaccaccatggcacatgtatacctatgtaacaaacctgcacgttctgcgcatgtatcctagaacttaaagtaaaaaatatatatatattgttttagtaagttagcatgagttttcatttcaagaagcttgtcttgtcatttttactatctaaattttgtggaagtctggagctgtgttcacatgaaaatctggtaaaagggaatgggccttccttaagtactgaagactccaaactgtgtaaaaccccaccaaaaaaatatgattgtatgaaaaggactctaggatacaatatcttaaaataggaaggagaaagatttgggttatgttcatgtatcaatgactgttgtattgttttcttctctttttgaagtgatttgtgtgactttattgaaatgggcacattttataaactttaatttgtaggcatcagagaccccaactctacaaggcctttcctttactgtcagacctggcgaattgttagctgtggtcggccccgtgggagcagggaaggtgagttagaatggcttttggcagcttgttgcaaccccacttatcatattaacttcgtgggtttgagcccaaggctacgtgtaacacaattttgaactgggtacacttggcacggcatttctcagtgcatggaacattcgttttgcaagaagggtcacatgaccaaataaatgtggacaatgcatatcatgtttcccttggttcttcaagttgagcaattgggaactcctagaagttggacatctccatgaaagaaattatttatgtgaccactatgcaggatggattgactaagaaagtgggaacttctttttgtcagaggggaccctagatgctacaagacatctggaggttatgaaggcttgtctgaaaagctttaaacatgttttgatatgacttctccaagtcacatgaacacacatttaataaacctgtagccaggtgtatagtcctgtgttaggagtaaaagatacacctgtaatcaagacccagacgccactgccctccagaagtttctggtatctggggtgagacagatatacaaacaggtgatttcagttcagtgtcgtaagtgctctgatagtggggggcacagacacgtcatgtctgtgcattgtagaagatgtgaaggaaacgtgcgtacagacttagtctcatatattctaaagcaacgcaataaatctagttgtaggtgtataacaaatagggtggtttaacaattgaagtttgctcttcagagacacgattcttgggtatttaaaaataaaagtccttcctagtgcacaggatttattatttatttttatttattcattcatttattcacgtatgtatgtatatttagtttttgagacatggtctcgctctgtcacccaggctggagtgcagtggcgtgatctagagtcactgcaacctccatttccctaggttcaagtgattctcatgcctcagcctcccaagtagctgggattacaggcgtgccaccatgcccggctaatgtttgtagttttagtagagatggggtttcaccatgttggccaggctggtctcgaactcctggcctcaagtcatccacccgcctcggcctcccaaagtgctgggattacaggcgtgagccactgcacctggccaggatatgttatttacatacagcatttctaggattagttctttgtcaaaaaagatacccgcatgcaggaacaatgcattcagtattggatatatgaactatatatgtcatgcttggctactctgttgctgtaaacattcttagttgatctttgttccgtgtaccatttcatttaggggcatgaaactcatttagggaaactcattagggcagagtagattgttacactctattttgttaatattccttataaactactagtttatgtggaccattatgttatttccaatttttaatcacaacttcctgtgctcttttaaatgaatgaatggtgtttttcaagctcccagggctgggcaaggctgcattgcagtggcttattcttgtctcgagtgttgactgaacatgtgcttttttacaatctgtttcagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggtgagtgatgacttttggatttcatgtactcgaatgtccagtaatactagtgttcacttgaacaacaaggtttattaacttttttttaatttttaaagacctttgaatgttatttaatactttaaggcggtcctcccagtaaataaacacacacacgctctgtccttttacgtctgatgcgaaaatgatgtttacagggtgaatttcgggggtttggttggttttgtgaagttttatttacttttaacttttctttttttcaaaatggacaattataaaaatttgcaaaagtggagagaagggtgtcttgaacctgcctgtacccattgctcaagttcaagtgcgatcaacttgtagccaattcaactccgtctctcccctggccctctgctagctccacccccaacccagattcttctgatgcatacccttggcctcaattgtattttatctgtaattgtattttatctgtaataccttattacttatctctagaagataagaacacttttgaaaaaaaattacatctcactcaagaaaaaaaatcaccagaatttcttgctatcatcaaccggctaggcagagattacagtgctttagtatctcattacccattggtttgcgtcagactccggaagatgtctgcaccgtgcacttggctgatgtttcctgcttgggtccctctcaaaccacaggtttccttctccactccctttaaaaaagaaaatttgtttcagtagattttggggtacgggtggtttttggttacatggataaatttacagtgcaatttattatttaaaggaaactgttttaaaatttatttttcattgtgtatcatttcaccaagagagtgattgttttcagaaaagatgaagtgtttgattgtacactgaggttttcataaacctggtggatagttgatgaaaactgagcatacttaatagagggctataagttctagaagatagaaaaaatggtaaatactgataaatactatgttaccttctttgggccataaaaatcagtgaataatggcattaaagggctctccccaggccctgtgcagtgtggcctggacatcctactgttcttttatgctgtctggaaaaggccgccacagactgtcacaggtgtgatgcagaaggcttccagccaggtttgtgaggaatgagtaattttgcttgaacaatggctggaatatcagagtctgtcaatcaggtgagtagtatttgctggcgatttggatagagaaatcattgcttgtttaatgggctgtttcttcatcctggactattgttaatgagagatgatgcattttcggaaatgacattaagttagcagtaatgagctagatttttattgaatagtatacactatataggaaaagatgcgctaaggcaagctcctagttattcagatcctaccaggtcttatttttttttctctgtctcacacgctcacacatatgcacacacaaagctgtgtaaagttttaatcttttgccatgatttcccagtgcctttgctattgctatcctcattttgtttatttttctgatattgctagcctcgcttttttaaagtaaaattttcattttattcaaagtttgtacagaattgctaacatttccctaaaataattactatacttcagcttgtcctgctctggtgtccccccactgtcccctgcttccctgaagatccattttagagaaattttgcagaaatatag

SEQ ID NO: 73971 - DNA, 1245 bp, Homo sapiens
aatctaagtgactggccagagccagggctgccttcagaggctctgccctgtgtttcctgcctacccttctgggctcacttgcttcctgaaggctgggaatggccttgactttcatgttgccagcatctagcgcggggcttggcacatgatgaggattcatgaaatattcatcagatcatttccaaccaactcccgtgttcaccattagtaacacaaaagtacaacagtagaactatgcaggctgtcaatgcactcagtctcagagcagtattttcggtttatttaggaacaagtatacttgttgaaaaaaattacacagatagttcctaaaattacaaagatagttcatggccatgaactctttacatgtttatttattaaataaatatcatatgctgatgtgaaccgatactttaaatagggttggtaaaatgatctgtaggctgtataaagttttatgttacaaattccatggaagcagtgacttttgtttgtgcttttgtttctgtaatttaaacaatctgtgtttttcccattttctttagacctttttgctacttgatgagatatcacagcgcaaccgtcagctgccgtcagatggtaaaaagatggtgcatgtgcaggattttactgctttttgggataaggtaacatatccttaatgcaagatcatgactgctgaagataatgagtgacattgatttaatagagaattttgaggtgttacacatggtataaaatatggcttgcttatttactgaaactatgttacaaagattctcaaaattaggagtaagttttgcaattaatagaaagtaggtatgaaatcagacttaggtatttgacaagttgtattttatctcattttcaaaaaaccaaggaaagtgttacctcgttctaaactaaatgtcactaagtttggacattggcaacgctggattttataggattggacagactaggggtgcagcatggaatgggttaactgctgagtacattgtagattattacggagactttggggtatcagtgcacattttcagcttagcgttttcaggtcatcttattacatattgagaaagcccatgacttggatttttgccacggggttggggtggggctcccctattccaagcatctggatgttgccagctgctttggtggcagcccaaggccgaggggaggctgcaggccggcgtagcaagctccatggattcctgactgaagggtttcaccgtgtggtaa

SEQ ID NO: 73972 - DNA, 2783 bp, Homo sapiens
ggcggaggttgcagtgagctgagatcgcaccattgcctgggcgacaagagtgaaactctgtctcaaaaaacaaaatatgtattttttttttggcttttggattaaatatttgattagttgttgcattccagcacatgatacttcttatgatttcttgggtagttcctggccacctctcacctttgcacttttttgttgttgttgcccaggatggtctcaaactcctgggttcaaacaattcatccacctcagctcccaaagtgctgagattgcaggcgtgagccactttatctggttgacatcactgcttttttaaaaacctgtactctctttcaggaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccaggttggtgtcagatgccattttaaagttgtaggtgcatttgaagtagaatgatgtctccttttatttagcatcactatgttccagtgtaatgacatttaactctctcataaccaaaacgtgccgccattccagaatgttgtgtgtacttccctatcttagatagagcgcggtaaagacaatgcaagcattgtgattcatttgttggcagcaacataaacagcagtggcacagggcttttgatgtacaggtggtaactgcaggggtgattaaaatgtctaagctgtctaaaagcaggaaaagcaaatagatttcatctcttatgttaacaccaatgagaaagtagtgagtatgagttgagtatgattcttctgtgggctggaaggaaagagcttgctgggggtctctgcttcttggtcaggaagaatggcctcaacttcacttagctatccctgtttgaaaataagttctttcctctgtagatgttttccttgttaatttctgtgcatgcctttaggacctctgccatttctttcctgtccgcttttcacttttttcttactgttgatgaacctatctctgccagacttctttatttccaattggttgatttctactgccttgctccatttgtacgactgtaacaaggaccactctctgcttcccagatggacctctgtgtcctcccatcgtggaggaaacagaaggacaaaatgggcctggttagttctctccagccttctgtaaggacactaatccccttcaggagggctctgccgtagcgacctgatcacctcttagaggccccacctcttaacactgatgctggggtgaacttccaacctgtgaatttagaacaggcatgcccattcaaaccatagcatccactttacacaccatcaccttttcctaagtcgctgtcactcaattgccaggggcaaataatttatatcaccaaggtaaggtcctggcacataatgtatgctcaagtatttgtgtgtttatgaataagttgaaaattaaaataaattggctttgtgagagggcttggcaagaacttgactgtctaagcttttcaaaaatctgctttgttttattcctggttcttaatagagatggatgcccaaggacagactcgagtgaacttagctgacactggctgtgattatttttttatttttatttttttggtaggggagagaatggggtgggtgttgtcataaaagctaagattcttttttatgatgaagtttgttttttaaagatgagatcttgctgtgttacccaggctggagcatagtggctattcataggcagactcccactactgattagcaagtttgtatttcataaaaaatattacctataaaacagaccatacagggtcatttcttatccccattctttctgacaacagcttcaggtaacactgtgaagggatggtccatgcaggtcagtaacacttttttcatgtagcttttgcatcttgaaagaaagaacttaggagtatactttgaccagagtatctttctgagtgtgcaggacacctttttcagacggaagggccacatgtgtattgtgctgctgtaattctctgactgctgttgctgcccctcaccgtgattgcaggtgttggtgtgtgtaccgtggaccagggctcttggaagcctgtacatgttatttcatgttatcctcacaattgaaggagataagcattagtgtccccactttacagagaatgaaactggctcctgtaataggttaaggagtttgcctatcttagaactaggaatctgttcagaaccatgatttcttaaccatggtatgttgcctgttgtattaatctgtttttatattgctataaagaacttcctgagactgggcaatttatattggaaagaggtttaattgactcacagttcagcatagttggggagacctcaggaaactcacagtcatggcggaaggggaagcaggcactttcttcacagggtggcaggaaggagaagtgcaagcagggaaaatgccagacgcgtataaaaccatcagatctcatgagaactcactatcactagaacagcacaggggaaactgcccccatgatccgattacctccacctggtcccacccttgacacgtgaggattatggcgattacagttcaagctgagattcgggtggggacacagagccaaactgta

SEQ ID NO: 73973 - DNA, 3970 bp, Homo sapiens
acctagccctgtctcccaaggcaggaaaacatgactgtgtcactgtatctgctggggctcctggtgtcctccagatagttgatactccatatttgtcatttcccattgaacacattgaaaccctgtgatccaggcagggtgaagagactaaggccccatgtgtttaataatgttgcacagagaattagtgattggtacggatttatagtccacgtcctctcattttgttcctctgacagcctctctgttcttccctaatttggctcaaaattactttggttggctcttaagtagaaacttatgtccttttgtacttgggggcgtgtccaaattcattaaatgaggtgggagatttttcttcttcctacctctcgctttgctgtcctgacacagctgccaccactaaaggtgctggtggggcagagagagggggcagtgggggggtggggatgcttgtgcttagatctggtcttgacatcacacgagacttcctcaggtctgctgtgtcctaagcctgacttagtatcactgcatgaatacaattctctacttacctcttttatttcaggcacttcgtcttagtaacatggccatggggaagacaaccacaggccagatagtcaatctgctgtccaatgatgtgaacaagtttgatcaggtaagctgcagctcagggatcctttttcattgcattaaacacccctctttccccttttattctttctggaggcaggggctcactctgttcacactggattgcagtggcaggatcatagctcgctgaaggcttgaactcctgggctcaagtgatgtgcgatcctcctgtctcagcctcctgattagctgtgactacaggtgtgcatcaccgtgaacagctaatttctttttttttgaattttcatgtcagatgggctattgtggaaacatcataacaaaattcaagggtggcacatctcacacaagtgcgtgaacacccgattatcatgctcatgaactacaaaaggattgctggctaatttctttttttattatttgtagagaagggatcacgccttgttgcgcaggctggtctcaagattctggcctcaagcgattctcgctaccttggcctcccaaagtgctgggattacaggtgtgaacaccatacccgcccagtatccattgtttaatacttaccttgtagcggtatcatttttccagggcattctagctgctggccatattcattttgcactaggaccacttcttttttccaattattcattcatcagaatgaactaaagcctccgctcagtgtcagggacaatgaataagacttggtttctgttctgaagaagctcactgcctgtctgggagacaaacacacaagtaaattactggagtatgtggtgggcactgtagtacaggttttcttggggtactggggagccccagggcatatgggagctgaattctgtggcagagagttctggaaaatgctcagctcatcagtgaagatagtcacgatcaagacattcttctaatgccgctggtcggattctcttgcgagtctcccagacccactctttgtttccccagaatggcttcacctgtggtgggtgcttggctttctgctttagcaggtgtaaacccactgtggccatttctgtttaggatcttgcctgttcttttccagtggatcgtttctgtactgtgttcttactggttttgcttttctggagtcctaagaacgctctgtctttttctttaaaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggtaagagaaatactgctgtgaaaaatgtcatatgtatttggtaacatccacagtcttcccaatgcttttgttcagaaacaaactaaatgccttttattatctcttccttgcatatgttgcagctcttcaggctcagccaagggggcctctgtccttatgctgaaggcaaatcttcaagggagaaaggtgaaggcattcactggctcctcccagccagcttttcaggcgctgtggcctcaataagtagagtgtccttaagcagaaatcacatatgtagaagttagttaaacatataatgaataatgataaattgaaatgtttcataggctccattctagctgcatacatctttaccgtgcttgtgttagagctgttttcacgtgtatatatgtgtgttatttttaattcagtatttccattaaattgtaagctccccaaaggcaaggtgaattttaatgatgtagttataaaatcacacagtcctagtagcatatgtgttaggaatatggttgttagctggtcgtggtggctgaagcctgtaatcccaacactttgggaggccaaggcaggtggatcacttgaggccaggagtttgagacctgcctggccaacatgacaaaactccgtctctactaaatttaaaaaattagctgggcatggtggtacacgcctgtaatcccagctacttgggaggctcaggcacgagaatcacttgaatccaggaggcagaggttgcagtgagccgatattatgccactgcactccagcctgggtgacagagtgagactctgtctcaaaaaaaaaaaaaaaaaaaaaaaaaaaaaagaaatacagcttttgatcaagagattaatgatgataaaataaattagacttgaagcaggttccaacgaattggaaatggttcattgtcaaggttgtcagctggatcgagatgagccactgttggaagtgcattgagttctttgttttatgcttttgcttatggtgtattttctacttggaccttcccctctttgccatctggagaaatagtccttgtcctttgaggccccgttcaaatgctcctggtcctctgaagcttttttttttttttttgctctcctctttcccggtggagttaacaaacagccctttcttttctgctccccagcacttcattcccattttagcactctctgaccactgtgttatcgtcaggctcgggtgcctttctgcctttcctgcccacctgtgagctcctcgaggggacagatgacatctgactcattttcatgtcttcctcagcagatattacaaattctccaaaatacttgttgagttggtatagattgttgacttcctaatcgaagtctttttctatttgtattttgagtaggacctgtctgtgttgtcggaagcaaaagcgctgtagggaaccatgtgatgcaggtccctgcctgtgcctgccgctgataagggcaggctgtgatcgctcaggctcatctcccgtgtctggttccccttaggagtaaaactgcaactttcacggatgccaggatcaggaccatgaatgaagttataactggtataaggataataaaaatgtacgcctgggaaaagtcattttcaaatcttattaccaatttgagaaagtaagtttttgtatacattgtaccatatttttgtatttttctatttgctattcttgttgatggttttagaagttttactatgttttcacattatgggaagttcagtacaatccatcccagtccccacgcttggcagttgggttaagtagaatggtagagaacgttattttcacttggtcttccatttaccatgttcttaaacagaaagcatgtatgcttcttactaatacaaaagtgaaattccaaatgtttctgaatatcccaaatcccaacaatgagtctaagatgttagtatttgagaataatggtgtttaaaataaaactataatttatattaatgtagccaaatggacaagttatagagactgggcatatctatattggaccaaactatatgaatcagtatttttcattccaaac

SEQ ID NO: 73974 - DNA, 2439 bp, Homo sapiens
ctggccagttatttttgtctgtctttcagcactgtaaatattgttctgttgtcttcttgttttcattgtttctggtgtgtcagcttctgcttgtttttgttgtttctctgtgtttaatgtgtgtctaggtatagatctctttgtttttgtccttcattgaacttgctaagattcttcattatgtaaattaatatttgctaccaactttggtaaaattccagtcattatttgttcaaatattttttcttcccctatttcttcttcttttaggactccaattacatgaatattttattgcttaatattcttccataaggaccttcattcagtctttgttctttttcttaactctttttttctgtttgttcttcagatttcagttgtaaactatagaaggaagggttagcgactctgggaataaatcaatggaaagtatctgctattaatgatatctaatttatttttcatttcaggtattaccttttcagtttgagaagttctatttggttctttttgatattacctatctcgctcctaaactcacatctacttgttataaccatatttttctttaactccttgacatattataataggtgcttcatagttgttgtttactaattccaaaatctggatcatttcagggtctatttctgttgccatttccctcctttgattacaggtcacattttattgtttccttgtgtatctagtaattgttttactatgttgaacattatgatcgatatactatagggagtctggattaaagagcattgagttttgttcatgcaggtagttaaattcctggcagattggcccctttagcattgaatccttctgtctgtctgtcaatcagttaatcatagggcaggtagctccattctgaacttattccaagtgcacagctgttaatctagggtgagatctttattactaagacatagccttcctggtgtctcaggtgaatgcctgaggcccagtggagatttccttcctctcctcgggcggcatctcctactgcatgacctccagaatcttcggtcagcactcagccccatagctgctgctttcctaggcctcatggagtctggccctgcttatgaagccgttggcaaagtaccctgggtaaatccctactgaaacttctggggcaaaccctctgctactcaggctcacaaattccagatgcttctacaacttggaacaaccatctcttcctccaccgctcagtgaaactgttttgcttgggcagaaaatgtcctcaggcataaagccaggtcagtcccgggccaccacctacatttcccgtctcttgaggctcacagcctgtgttacctgtggtccagtgcctgaaaacagctgtgtcatatgttttgcccaacgttacagttttccaggggagggcaagtcctctctcatggttggaagcagaagcctggtagtttgcttgtcagctgtgtcttcctctttttttttttttaagatggaatcttgctcagtcgccgaagctggagtgtaatggcacgatcttggctcactgcagcctctgcctcctgggttcaagtgattctcctgcctcagcctcctgagtagctgggattacaggcacctgccatcatgcctggctaatttttgtatttttgtagagacagggattcaccgtgttgaccaggctggtctcgaactcccgacctcaggtgatctgcctgcctcagcctcccaaagtgctgggattacaggtgtgagccaccgcacctggcatgtcttcctcattaataatattcatggcccttcatgattttttttatcctatctggagtatgactgatttaatttcagcaggcccttaatttctgtgttgactgtagagttatcgttcacttgggttaacttctattacaacccgagtatctgcccagccttttattccacctctacacctggtcacagtaatacacgacttacaagtagccctcctggtgcacccagaagaactttgtctttttcacaaattggcatctgtgctgtcttacctaaatcctcattgttggcctcagacacaatctgtggatgatagttcaagttgggcacaattgacttcagatttcttgaaaagggtcagcttaggcttagagtttggtgttgacattttgcttttatttttttaaaattaggtatcaaatttacatgctttaaaaatgtggtattttctgcatgtgggattaacattttgtatgtaagactggctttataaatatttacagatagtttgtagtcaataaggcacattacgttctgtttctttcctacaggggcgggctggtctctctccttccctttcttctccctcactcctacattttcttctttctttgtattttacgattgattcacttatatttgcataatagcattttttaatttttttttttttga

SEQ ID NO: 73975 - DNA, 1053 bp, Homo sapiens
tctttccacctcagcctcctgagtagctgggactacaggcatgtgccaccatgcctggttaatttttaaatttttttgtagacaggatctcactacgttgcccagtctagtcttgaactcctgggctcatgtgatcttgccgccttggtcttctaaagtgctgggattacaggcatgagccaccctacctggcctacggagaactttctgtataggttttcaggcttgtattccagccatgaaaaatcaggtgaaacacaaacaaaagcctcagaaggcagtgaaactgtcagattataaagaacatacaggttgttgattttggatggacattttcatctccttaaatttcatttcttttacagaattagagaaggaatgtgactttggtagtcacccatcatgtttacgaggaaggaggatattagccagtccttggatcatcccctcagaaacagagattattggttttagattgtgcagtcattaaagtagatatgttgttactaagcaactctggccaacagtattggaaaaatacaggcaattttctgcttcaagtgattaaacatactcatcctagttgcctgttgcagaaatacccagtttaattggaagtttcattacctcacaaactcaactctggggtagggtcatgaaccaggaagtaagcaaaacataaaataaataagatagataatacttactttatatgcttattcagaacgtttttactctgactttacttacagcactcaaaagccacatcctagtctaaaacactagtaggtaatggtgtgacattctgatgagaataaagagatacctgatagcctgacagccaggggcaagatggatcaggaagtacccgaatccgaaaagtgtggccatttggggactctgtgagaggagcatccctgtccaccccgggtcattgacactgggtaagagccatattgttgtgaggaatttgcatcgtgaaggtgatgaactgcggtttgcatcttttgttttatttatttatttttttaatttttgagaaggagtctcact

SEQ ID NO: 73976 - DNA, 1797 bp, Homo sapiens
gtgctgggattacaggtgtgagccactgcgcctggccttgatcttttccttctcttttcttggcattgctgcagggcaggtatatttttaggtcagtggtcagagcagcagacagcctcctctaccacagactgagtaggaagtggaaggtgccctcccataatgcacagagaggctgggcttgtgcacccttcccaagtcatgtctgccgccctatgcaataagtagaacctgaagtaaaaaaaataaatgcaccgtcatgcgctgatggtgagaagattgcagccacctgtagctctctggctgcatcccagtcttcccaccccgtctccctctgggttttctcagtggatgtggacagacaattgatagcaaattttgtcagcaactgagccatacagtgttgtggtcttagttttaaaacagaacttttgtttttatttaaagctatttttatttcactgtagactgtatattgctttatatttagactgaatagtatgaaattacagatattcagggccgggtgcagtggctcacacctgtaatcccaacactatgggaggccaaggtgggtggatcacttgaggccaggagttcgagaccagcctgaccaacatggtgaaaccccatctctactaaaaatacaaaaattagcctggcatggtggtgcacgcctgtgatcccatctacttgggaggctgaggcacaagaattgcttgaacccaggaggtggaggttgcagtgagctgagatccgtgccaccgcactccagcgtgggtgacagaacaagactcttctttaaaaaaaagaaattacatatattcaactcctttgggcctttttacaaaactagcaatttcatatggctcaaactaatcttttgtctattagtctgtagatcggtttcctttctgaagattcgtagagagcctcttgacagtgttgtcaaagtgaaactgtgtggtgtgtgtggaagttatctccctggacacatgtgatactttggttggacttcctcttctaatgttattttctaagtttctgacaaaattagaatgacccagtagtgcttcttacattgtccataatacgttaaaatttttgtttcaaaaacttttctcccccacagtttttggttttacttctgatgtgaacttgaattgtacctgggcattttgtgagacattaatctcatcaagggacaatttgtcagtcttctagtttgctagggaatagcttaagaggagccaagttaactttccatagcttggagtttgagctaagaaagcaagttaaggagggaggacttgttttgtttggatttttccaagaggaaatttctgctgctggagatttaggagtgtcagatgcgtcccatcatctgataattgtatttgcttcactggggtgtgggtgcaaactggaagaaaatgctttagctcagtggttcctcaaactgctctctgttgtattcatgaggggaaatctttaaaataccactggtgtctggactcttcccctaaacattctgatttaattgctttagggaaattttaaaagctcctatgtgatactaataggcctcaaatatgtgttcagcttaattttatgctttataactaagaccttccagttcacagagatagcatatgggttgcgggtttaatccccctcattggtgaataactccttcggacttgtaggtataaacctcaagcatggtagctgttcatcagcccgagtgtcctaccatctggtctgggaatctcatatgcaggagagcccgggtgttga

SEQ ID NO: 73977 - DNA, 1353 bp, Homo sapiens
tactgtttttcacagtggccacaccattttacattcccacttattctttaataatttgtctgtttaacttgagaactaaatgagatgtttttatgaatcatgactagctttaatttggattgatggctccaagggtggtctgttgaaatggttcatggtggtttgttcaggttcctcggaactctgtgttatttcttacaacttttaccaaataaaaagactgtgcagcacaggctgtattttaagtgaggtcaacagattggcattaagaatatgggctcctcatggcaatagtgtgctgaacattgtacttgctcatgttagaatgtcgtcagtcacaagtcatattcccagcatgggttcgtataacctctgcagtggggacagtgccttatctcctgtttttactttttagctatctgggacacagaagcaggggatgtgtccatcttcaagtctcaaggggttacttctatagcttagagcacatgagttggggagttggctccatgttggaggaagagggtccctttagtcaaactgagcctggattaaggatagctgaagatcttcagccccagccaccagtgagactggatctcccatttgcccttgcctaccttgacttagggccaggatagatctgagcctgaatgctaaacatctgaatgctagacctacgatggaatggaggacagtttcattaatcaggatgggcttgtcatcccagcttttgtattatcaaatacattaggcatagagacttttccttaagatctgtggcctaattagctcaagatttcttgactttgtatctaatttgaagaaccgtggtggttcctgcagtgggttggcttctgagttgtggattttgatgttgggttggcttgtcctgaatgccaggtaaagctacagcagtacctgagcctgcttgctggtgctcctctctgctgtttgcagacttttttgcagaattgagaaagtttggggaaactttttattctggataaaactgctcgtcttcactttctttagagttactctgaaggatagtttgaggtaaagtatctgtctgtccttcatcttccaccttctaaggtgtgttgagtccctgcagactttctagttttcctttatcatttattacagatctgccctagaagaatatatggaatatatgtatgtagtgtatctcagaggggtgctctctatagatttctgtgttgagaaatatttgtagttaccctaagtgtattgtttaaccatttatgtgatactgtgtggttctctttttagaattctgtaacttggggggaaatgcatattccctgtatgcagggaatatggatactc

SEQ ID NO: 73978 - DNA, 1494 bp, Homo sapiens
tttcaggttaaaactcctatcggcttgtcttaaagaagaaaacagttctgcttttcttttagatgagtgatgaatgttgcactttgaaaatataaaacttgtgttaagaaaaaacgagcctaggtgccgtggctcacatctgtaatcctagcactttgggaggctgaggtgggaggatcacttgaggctaggagttcgggaccagcctgggcaacatagtgagaccctgtcttgaccaaaaaaaaaaaatttagctctacatgatggtgtgcacttgtagtcccagctacttgggaggctgaggtgtgaggattgcttgagttagggagttcgaggctgctgtgagctgggattgtgccactatactccagcatgggtgacagagcaagcaatatctgaaaaaagagaaagtaaaaagaaaaaatggtgtggtctgtatgtctaattaaaggcttttctttttcttcttttaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggtaagtgacattcagcattaaacatgtacctcacctgaagcatcagaagcattctgaggaagttttatgtaaattaaatactgcataaatagccactgcactccagcctgggtgacagagcaagaccctgtctctaaaaaaagaaaaacgaagaaaacttctgtaaatagaatcatttacaccttactagagaagcttgctatttgcatcaggccaatgttttttttctttatgcaaaattttccagtgtataatgaaagttttctactgctgtcagggcatggctgcctttgataacaggctgttgcagaatactaaatttataatgaaatctaattaaaaatatcaaattggttttcagtgtttctttgcctcaatctcatagttgtatttatggaaatttttgttgttgttcattaaaaccttcacttacatcacagttgtattcagaagtgaacttcagtgaaattggatctatgaaattaaatctaggagaaaagaatatatttgagaaagggaattcttatattttttaaatgaaccatttagtcatattccatataattttcttaactgaagaaaaatgtaaatggaatccacgtcggatacaggctttctttatattctaaatctagttgtggttgtttttaatggtatttaagaaaatagttggatgtttgggataacactttgaattgttgattgtttttcacaattttggagagaacttatagtgtttctattttatgttggttttcattcaaagtaagtttttacattaaacagttgtcccttg

SEQ ID NO: 73979 - DNA, 2196 bp, Homo sapiens
ccttatctctggatctttctcaaccctagttttgtcccctgttcccccatttctttttttttttttttttttttctgagatggagtcttgtgctgttctccaggctggagtgcagtggcgcgatcttggctcactgcagccttacctcctgggttcaagtgattcttgtgcctcagcctccccagtagctgggattacaggtgcgagccaccatacccagctaatttttgtgtttttagtagagatggggtttcaccatgttggccaggctggtcttgacctcctgacctcaagtgatctgcccacctcggcctcccaaagtgctgggattacaggtgggagccaccgcgcctggctgtatttccccatttctaaaacaaactgcttactcatttttccacagctcactcttttctgcttgtatttttcactcaaacatcttctttggtagcttgtttctatttcctgtgttttctttccttcccatgcaatctggtatggtgcagttgggcaaggaatatctgaagtgcgtgggggagcaggagcatggaggccgcgtgcccgctgggcctagacatgtaatgtgtcactccaagaaagcaagggatggggctcgaatgtcaggaggctgagtaccaaatactccattgagaagtatctgccttcaagtactctgggactccagtagaacctgaagtatggaacattcaagtatcctactggactctcaaaaacctccatggtttcacagtcgaggagaattcttgtgaaggagtaaggactattcttagcttgtttgtggaaagactcttcaccaggtcatagattggttggtctctaaggtggagaatttatgtgagttacttttgaccttggtactgatatttagaaagtttaaatttggttagttgtaattttgataatgagtattttcccagttgtttcgtttcttattagttgaaggttaagatggagaggtccgtggaaaagcatggaccaaaaaccagcattactcaccaatgagcccatttgcttgactggattattaaatgctgtctctcggcagggaaatctggacaattaggtagtcgtgacctacctgccttttgcattctctttcgctgggtttattgcatctgttatttcctctgggggtcatccctcttgccgtttgaatcatactcacctacggctgaaatggagaagcgtgtaacaggtaacagtgactcccagggactgtgagaagtttcaggaacatttagaaaggcaaagagcactgagcgtctggctgatagcccaggtgtgtctgctgcggccctggttgcccttggcactcctgagccagggctgcccatgtgtacagtttggccgtcttgcttcttgatgtaaacgtccagattttcatctcagtaaactctaaacagtccgtgttatgacccattgtactgggggctcttccataaactcttagtgccttttgaatgattggccatgctggaaatgtaatggtgagcctctgcattcttgatatctgatcatcttattcataattcttcaactaaatggtattttctgatttctgtatcataggggaaaacttccatgacctcatggaaggcagtgcagttggtgaagtgtgtgagagagagtgtgtgtgtgtgtgtgtgcgcgcacgcgcgcgttcacatgccgagacaggcttgttgggatttaatatcatgacccatctgagggatgggaatgtcttctgtaaatatcctgatcccgtgctagttgtttgggatgaaagtgtgtgttaattttgtttttgttttttactgattgttcttctctcacttcagatggacagaaaacagctatcaatggcaaacctgtcaggtgtttattatgtctttgttaagaaggagagattgcttaaaaggaaaagttgtttttcaaggttaaggtcttgaaagattttcaaacattttgcattttgtcttttgagaagtcaggaggaaatgatgtcgagggcctacatgtttacttttggtgacctggatttgcaatgagtgtttggttttctttgttgggggaaaagggtcccttacaacgggttcgagagggaggaagtaggttgccgggtgaagtgctcatttggcagggagggtaaaggaaagctcctttgcttacctcaaaccgtggctcaagctgcgt

SEQ ID NO: 73980 - DNA, 1494 bp, Homo sapiens
ggggggtttgctcctgttgaacatgctttttgttgtggagggcacggtgggcagtgggaggcaggtaggtgagctctgccctacaccagaggaatctgtcagacaacaggggactggacggtcctgggagatgaatggtctcattggtgacaaaggtgttttggccagggtgccagatggtgaatgccacctttgagagggtacccgccctgcctgcatgctactgtggctttgtggcagatggggtggacatgcagaataaccggtggaactgacttgagggtggaagagggctaggagcccctcaggttctcccagcccctcttcaacctgtgctggggtgtcccagcgatagtgtttccacatggccccgatcagtttcagttggaaagaaatagaatgacaagtcggtgtcaatgtggccagtgtgtgcaggatttcctggcccagtttggctgtgcaacctcagagaagttgtctggtagccatggagcctctgtaagtgtctaaggctcatgccaggtgtctggttaggtgtagtgggaatcaatggcctcacataggtttcgaggcatgcctccctcagctacttccatttctctagtttccctttgtcaccagctgcttatgaaattgaaaacaggatgatttagaaggaactgagcttgtcatgctcagggctgtccatgctgtcatgggctgccagccacttggggtggggtctctaacccacagatggtgactggactacagtgagatttgggtaagcttttgggagaagcaggcacagaagtagaggctgtagaagcgtgaatttctcctgagacttgaggacaggccccactctggtgcaaggagcatggtaatctttactgctggtgggcatgtgggaaggggcccggatcgaggggagctttaatatgggtacagttggtggagagctggtcttttagcggggtggttattgggcagtcatggcagaaaagtagggagtggaggacctggcaaatatgggggctcatgctcagtactgcttagcagcagcagtgctagtagaagcagcagcaggattagtagtggttggtactcagtagtagtagtagcagcagcagtgatagtagcaatagttgtaataatactgacagtgagtacttgaaaaatactatgtaccaggaactgctatgatttctttctttctttctttctttctttctttctttctttctttctttctttctttctttctttctttctttctttcatgttattttattttattttgttttttgagatagggtctcactctgttgccaggctggagtgcagtggtgctatcttggctcactgcagctttggcctactgggctcaagcagtcctcccaagtagctaggaccacaggtgcacgccaccatgcctggttaatttttgtatttttgtttcactatgttgcccaggttggtcttgaactcctgggctcaaatgatcctcccacc

SEQ ID NO: 73981 - DNA, 1700 bp, Homo sapiens
tgtcatgatttatttggatgcttccattatcacagacttgtctagtgggaccccgtcaagctgggtcctctgttctttgggcccatcctcttgattccttgaatgtttccttatcgtatggtatctcatgggccatctttttctgccccagcctttgaatcagctatttcttcaggaagctctggttccttttagataataatggttttggaaaccaagatctgggcaccagcatgctctcagctactggtgtgtcattgcttctggggcctgtctgtggatagagctagggactgtgtgtgtgtgtgtgtgtgtgcacatgttaacttttctctctctagctctatatattcatatctgtctgtctatatatagctgtatgtattttaaaggtaagtttaagcaaaacccatggaggtaggagtctacttaaacacggatgtgtaattctggatatatgtctcttttctcttgttaacaggtggctcaatcccttgtttaaaattggccataaacggagattagaggaagatgatatgtattcagtgctgccagaagaccgctcacagcaccttggagaggagttgcaagggtaagtcggaggcagtaaagtgggcattaaggaagcgtgggtgtctgtgtgtggggagtgggttttgccttcctgggtcctgtctggagcctccgtttacccttaaggtgaatatgtgtcaccttcctcaggctgcccctaggctcagcctaccatggtggcctgggggaaactcctgttgcctgtgcctccgtagaggtcaggggagccagcaccaaaggcccgagatgcctgaggtctgtccctctaggtggaagtgttgtggttggaggaggttgtctggcttatctgtgctactgatggggcttcaatccagtaaagcttggcagtaacttgtttccccagacttcccctcaaggcctgtttttctgatgctccagattctgtaccacacataaccttcaggagccctgggagcaattagtagcatttatgaaatcgtcacaaaatgccctgtcttaaatgcatacctgtcactctgccatctcccctgttttatattgtggcagggttcactcttatttacgaagctttttcctcattgtaggttctgggataaagaagttttaagagctgagaatgacgcacagaagccttctttaacaagagcaatcataaagtgttactggaaatcttatttagttttgggaatttttacgttaattgaggtaaaagcttttacataccatgaattgtttttcaggacacatagagtaaatgtgctcgccattgactggtgctgtaatggatgggggaacagaagggagaagtggccagatggggtttgaaggtattttaaggtctaaggattaaacatgtctaggaagtattaggtagttagttcagtgagcgtatttatccaggtgaatacttaagtgactgaagttcaaggtcattattgtttttcttgtaaccaattaaaatgcagtgtcatggaagaagagtattttattctatggtaggacaatgttggtgctcggtaaatgttttaaatgctaagagtcactcctggtcaaaagaggatcctacagccttgaggagtgcgtgccctgtggtttagaggaagtgattttggatcggagcccagaataatgtaagacattttaca

SEQ ID NO: 73982 - DNA, 1048 bp, Homo sapiens
gagtttaaatatgttaaaataggtaatttttacaggatgtgttcattcacgtgacaaatctgggtgacttctatgtgcccagcatgttgtaggtgtgggtggcttagcagcaaacaacacagaaaaaccccatccttgtggagcctagatgcctccaggggaaaacatgatttcaaaaaagtgaaatataatagcccttctaatgttgacaggtgctgagtagaaaatttaagcttgggcaggggcagagggtgagccttatagggtcaatgtgactgtttctggatatactttgcatgttgaagtaataggacttggatggcttagatgtgtcctatcaaagagtgacaaagaagggatgggctgcagagtcacctgaaggttttcttttctttggaaaatctgggcaaggggaaagatgtgacggctgataactgagagggagaagcctgggaggagcaggatttttttgtgggatgaaaaggtgttctgtttggacattatttagtttgatatgcttatcagacacccaagaggaggaggtgttgaatcagcagttggttatgagtcaggggtattgtatgtgcccttaggcactagcaatgttttttgtgtttttttttaagcaaaattatgaccatcatttcagaaaactattttatatatataaagaggttgaaagcttattaagactagatttagaaaaaacatataatactctgagaaattctgtgtgtagtgtcaggtagaaagtaaagtgttaccagttctgtttataaaaccccctttaggccaggcgcagtggctcatgcctataatcccaacactttgggaggccaaggtggggggattacttgaggccaggagtttgagaccagcctgggcaatataatgagactctatctttacaaaaatatacttaaaaaaatagccgggcatggtagcacgtgccttgttatcccagctacttgggaggttgaggtgagaggaccgcttgggcctgggaggttgaggctgtagtgaggtatgattgcgccactgcactcca

SEQ ID NO: 73983 - DNA, 1046 bp, Homo sapiens
aaaagtcattttttctcttccccttcccacagtcattgttgattagagaaaatactaacaaaatatattaatttaatttccaactacagataacaccaatattaatagttgggtgactgtccctcttttcatggagaaaacctaatgcctatcaaatgcccaacgttgaagagctatacaaatgtggattttctggtcgtcttcctccctcccttcctttatcctctcttatgacagaaaattacaaacatgtacaaaagtagagggaacagtaatgaacccctgaataccagtctgtcaacaatgatcaattcccagccaatcttaaccctccttctactcatttcctgccctagaagtgttactttttttggcacatctgatgagtgaagtgaagaatggtatttcattgctctgtttttcttttctctattcttttcttttcttgcaaaaccccacactgtcaccatgcatttgttatgtaattttcagatgtatctgtaggaaatggtcagtatacgattatatatacactgttaaattatccattgaaatcacattgtgtaccttctcactacattttttaacctttatgttataaagcagatacagaatattatacaaacaaatgtgtaacgtggataataaattataaggttaacatcctggtaagtagcaaccagatcaagaaataagattttgctggtccctgttctgtgtcctgtctcaattccaggctcctcccttccctcagaaagaactgaaagtcaacttcaaactctttgtggtctgtattacttttaaatcttgatcaatgttgtgtgtatatatatatatatatatatatattttttttttgagatggagtctcgctgtgtcacccaggctggagtgcagtggcgcagtctcagctcactgcagcctccacctcctgtgttcaagcagtcctcctgcctcagccaccagactagcaggtgagctgcttgtgctgctgacaggttgtaggctctgtatttggaagatttaggtatggcaaatcagggtgg

SEQ ID NO: 73984 - DNA, 1063 bp, Homo sapiens
aacatgctggagcatttcctctgaggaagttatctcaggtactagagattaatcagcctgcacctctttgtgtatattcaataatttagattttttgtgagttcaaactggctttttcttaaagttggtggggagaggcatgtgatcagacttcttgggtggttaggagctttttggattgagtcccgtctgttttccaggctgttggctaatggtgattaaaggcccagggaatcctgcttgtctccttccagtttcgtgcagagctatgtcacgctgcgtgctctgtttctgttaggaccaatgtctgtttgttatataaatagaaaaggaacataaagctaaggaaccaagaaggttccattacagatcagtgtctcaacgtatccttgaggtttggtacaagttctccgcttcctgaaatttttggacaaacattgtgacattcataaataccggactgctaggatattgagggctgaggtaacgcaaatacttgctgtggttttatagagtaataatctgttaatcatagctgtggccttagagaataaacaacctctgtgtaggcttctttgtaagaatggcacagctgacggggacctctgcgaaccaaaggccagcgtgtgaccttcttatcctctgcttcctaggccagcagtgactgcctttggagatctcattgtttacagccctgtctctgactcagggtggcagattatgtttttggtagagcccagccagcccctatcacattgcacactaatgtaatccgtcggcagctgtctctgtattcattatttagctgcactaactggagttaatcatagatctgagctaaactttgttatgggtcaagagagaaaggccatctggctatttcttgggtcgtcttgggtgtatttttccactgcttatcatttgaccaccatctgttttttgagacggagtctggctctgtcccccaggctggagtgcagtggcgcgatctcggctcactgcaagctccgcctcccaggttcacgccattctcctgcctcagcctcccgagtagctgggacta

SEQ ID NO: 73985 - DNA, 1416 bp, Homo sapiens
aacctgttttattttattttttgagacggagtcttgctctgttgcccaggctggagtgcagtggcacaatctcggctcactgcaacctctgcctcccgggttcaagtgattatcctgcttcagcctcctgagtagctgggattacaggcacccaccaccacacctggctaatttttgtgtttttagtagagacagggttgtaccatgttggccaggctggtctcgaactcctgacgtcaagtgatccgcctgcctcggcctcccaaagtgctgggattacaggcataagccaccatgcctggcttattctatgttgttttttgtgatggtcagtgagatgtggccacaggaggaggcagaggaggtgctcaggaaggccaaggttattatactcacaggtcttagagacgggaagcatgtcatgccctgcagggccacatggggaagcatcagtcttggtcccccctgtaggagcctgaaggggcaggagtgaggggagagcctgggccatggtctttcttgagctttcagggacagggcaggggagtgcatgtgaacagtttagaattggctagtttgaataattttggcaggctgtaagctacaggcatggtttctagttgcttgttatcaggctctggcatgatataggtgaagaaatactgcttcctggggtggacaggctagataaagacggcatagctctgggttggttggtttgcatatcagagctgtgctcctggctgggcccttctggttctaagaactggccagctctgggaaggacagtctctccccagccagagaggtttccaaaacgtcaagacatcatagtatgcacaaagtaaaaaatataaacagtacaaaggccctgaacagggtcaccctgctgtatgagaaatctactggcctggctgaaggggaaagttgcttgggcagaacagtgaaaagctaaagcaggcttgttagttgtatgagtctgttttcacgctgctgataaagacatacctgagactgggcaatttacaaaagaagaggtttagtggacttacagttccatgtggctggggagacctcacaatcatgacagaaggcacggaggagaaagtcacgtggatggcagcaggcaaagagagagcttgtgcaggcaaactcttatttttaaaagcatcagatatcgcgtgaaccccggggggcggagcctgcagtgagcctagatcgcgccactgcattccagcctgggcaacagcaagactccgtctcaaaaaaaaaaaaaaaaaaacaaaccaaaaaaaaaacccatcagatctcgtgagacttatccactatcacaagaacagcacaggaaagacccgcccccatgattcaattatctcccattggatccctcccacaacatgtgggaactgtgggagc

SEQ ID NO: 73986 - DNA, 1286 bp, Homo sapiens
tttatcacccatattacgggctgaattatgtccccccaaagttcgcatgttggagtcctgatctctagtacttcagaatgtgattgtatttgaagacggggattttttttttttttttttaagatggagtctctctctgttgcccaggctggagtgcagtggctctgttgtccaggctggagtacagtggtgtgatctcagcccactgcaacctccacccctcccaggttcaagcaattctcctgcctcagcctgacgagtagctgggactaccggtgcgtgctaccacatccgggtaatttttgtatttttagtagagacggggttttgccatgttggccagcctggtctcgaactcctaacctcaggtgatctgccctccttggcctcccaaagtgctgggattacaggtgtgagccatagtgcctggcctgattgtgattttttttttatggcagcctgagcagactatattacagcccacaagcctcacaaagatattgcctggagttagtgccactggttgtcattttccagagctgctttgtagggcagtaatgtgtcctctgttagactgaactcgccaaggagtttgaccctctattccacctgcttattatagaactactccctcttttcctcatatttcttgggttgagtttgggtaagattactaaaattcttcagatgtggaaccaatcttcataaacacttcagaatactttgcttccttctgaattactacagacaagcagtctgggaggtccaagtctgtataattattgttcttaacattctgtcactcattattgttggtgttcgtttctcaatgccagatgaggtgtgtcttgggcaaaagcctgtccagtgtaagctgttctgttctttcaggcagaatcactcagacttatgctctcaactttctctctctctttttttttttttttttttttttttgagagagtctctgtcgcccaggagtgcagtggtgtgatcttggctcactgcaacgtccacctcccagattcaagtgattcccctgcctcagcctcccaagtagctgggattacaggcttgcaccaccacacccagctaatttttgtatttttagtagagatggggtttcaccatgttgccacagtgcctggcctgaactttctcttttacagccacatgcaaattacctgaactatctggcttttgggaaaaccctgtgcaagttcttagcatccagtattaaaagaaaagagatggctctgttctcttagcaactcaaaatcctcttc

SEQ ID NO: 73987 - DNA, 2203 bp, Homo sapiens
gtagctgggattacaggtgcttgccaccacacccggctaatttttgtatttgtattttttatttttatttatttttttgagatggagttttgctctttttgcccaggctggagtgcaatggcgcgatgctactgtgcctggcctcacgatttcctcttttttttttttttttttttttttttgagacagagttttgctcttgttgcccaggctggagtgcaatggcacgatcttggctaactgcaacctctgcctcccaggttcaagtgattctcctgcctcagcctccccagtagctgggattataggcatgtggcactacgcctagctgatttttgtatttttagtagagatagggtttcaccatgttggccatgctagtctcgaacgcctgacctcaggtgatccacctaccttggcctcccaaagtgctgggattacaggcgtgagacaccacacccggccatgattcctcttaacacaagctggctcttggtgctgcttttcatgaatatactctcaaattgctcccttcaaatgattgttgatgtgcattatttcttttaaccttattagctttattttttctaaattctttttagattacatagcagtttcttagccctcaccatgattggatcacctggacagccataaaaatatggatgtctgttccccttataggccaattggaaaaataatttctgggggtgggatccacgcatctatctatctatcatctatctatctatctatctatctatctatctatctatctatctattttttttgagacagagttttgctcttgttgcccaggctggagtggaatggtgtgatcttggctcaccgcaacctctgcctcccgggttcaagcagttctcctgccttagcctcctgagtagctgggattataggcatgcgctaccatgcctggctaattttgtatttttagtagagatggggtttctccatgttggccaggctggtctcgaactctcgacctcaggtgatccgtcagccttggcctcccaaaatgctgggattacaggtgtgagccaccgcgccccgcacatcaatattttaaaaaggttctctacgtttctgatgggcactgaagcccaagaaccactgatcaactgcttgccaaagtcaaaaatatttctgtgcatatttccatttttctggccaaaggttcgctgcccctttttcaggttcctctcaaaggacttgtctgatctcaaagcatgagaaccattaccacaataggacttactcccctctgtgggtgctcagccagtggctgagggagaagggggattgctccgtgccagggatgttgttagagatgccgggttcttcgatttttatagtaaccccttgttgagggtggctctgctcttgtgttacatacaggtgaaggaaactgagagagtccaggtagcataatgagggtcacccaggcaggacatgatggagttgggaactgagtcaagtctgacaaattccaaagcatgagctgcagcctctgcgtcactatgtttattttctcaccctgggtcagagattaattgagctcatgagagtacttgacaggaaatctcacacttgtgaattcagagctcgtgagcataaaattgctcttctaatcacttgcttttatttgctgatctttattggtgcattttattggtcaggatgtgattgagattatgtaataaacccaactgaccgcttcttttaacttctgctattgaagtaatccctcagattactgtcttgagagacggagagtgcatacagtccaacagtgtgtactcttcctctttaaagacagtagaaaggtatccatcttgttttaaatagtagcagggaggtttatcaatggcttaacatggtaggctgggcctggagagctctcaatgtaacagagctcaaatgtggcatttacatgaattctaagttgattaagcgacacaatttgttcaactataaaacataatacattcttaatagattttacctattattgtatatgtaagttcctagtacatattaggctgtaggtaaatgggatgatgagggttcttgctaaatttatcccccatccttttttttttgagtcagagtcttgctcttgagcaacctccaccttctgggttcaagcagttctcctgcctcagcctcccgagtagctggaatt

SEQ ID NO: 73988 - DNA, 1147 bp, Homo sapiens
agcctccaaaagtgctgggattacaggcatgcgccatggtgcctggacaggagtttatttttgaccctgttaagtttgagatgcctgctacacattcaagtggagatgttgaataggcattcaattggtcatgagtttggggctcatggagaagtttatcttattattattatttctttaaatggagtttcactgtgttgcccaggctggcgtgcagtggtatgatcttggctcactgcaacctccaccttctggttcaagcaattctcgtgcctcagcctcccgagtagctgggattacaggcacgcgccaccacacccagctaatacttgtattttagtagagatggagtttcatcatgttggccaatgtggtcaggaagtttatgtcaatttgggcatcatcagtgatacatgcagttgagctatattggacacatggccaattgacctcacagtccgcagggcttgtccccatgtaactgctcttctatccctatgcaaattcattttgtagatgctaacgtttagcagctcattgttgctgttgaaagttcttggaacactttcgtagtctgaatgctagaaaggatgggtcctaggaatgtcctctaggttgtggcagatccactaatcaacactgtggttgctagattaacttggccacaagtgtcaagagaggtcgtgtcatatggaggtctgctttatggaagtcaagaggtattggagtattggatcacctgggcacttctgtcttttttttttttttgagacaggatcttgccttgccagccagccttggagtgcagtggtgcattcatagcttattggagccttgacttcccaggctcaagtgatcctactgcttcagccccccaagtagctgggactacaggtgcgggccaccacagctggctaatttttctaattttttgtagaggtggggttttgccatgttgcccagactagtctcgaactcttgagctcaagtgatccacctgccttggcctcccaaaatgctgggatgacaggtgtgaaccgtcatgcccagcctgggcagtcattcagaaaccctaccaagaaaagggttaaagtcatttggcatggtttcctctttttttttttttgagacagggtcttgctctgtc

SEQ ID NO: 73989 - DNA, 1011 bp, Homo sapiens
tttcacctatttctttcttttttctttcttttttttttttatgagacagagttttagctctgttgccaggctggccgtggtgtgatctcggctcactgcaacctccgcctccagggttcaagtgattctcctgcttcagactcccaagtagctgggattacaagtgcccaccaccatacctggctaattttcatgtttttagtagagacagggtttcaccatgttggccaggctggtctcgaactcctgacctcaggtgatacacctgcatcggcctcccaaagtgctgggattacaggtgtgagccactgtgcctggccttccattttcttttagctattgtttcatttctaacaataaaggcagctagaatttcttttggtatttgatatgagatagtccccattttttccccaaacagctcgttttccccattatcatttattgaataattcctcctctttcccgttagtggaaataagtggcatagcctatgaactgtggccagctgggcacaagatgggtcaatccctgagactctcctaggaattgtcctgctgccccctggtgcccggcaggcactttgcattcctctgcccacacctgatccagaggtgatctggggtcagcagcagggtggaggctaacaacgaaggacttttccctaaatatgggcattgagagggatctccagatgcatctggcccacagaaagtggttaaatccttgctcccctgttgctggccatatctcagtgggtgaagtgtcatcttgcaaagcctgtgctgctgtggaaactgccactggtgaccagacagactctctggagacctgccctagagagctgatgacatgactatagaagcaaacacaagtggctgagggcaggggatggcttagagaggaagggtgtgtgaggccctcagtcaatgcatcaaatgtttaattttatattttctttttctataataaaaaaaatatttttcttgtagagatgaggtctcactatgt

SEQ ID NO: 73990 - DNA, 1616 bp, Homo sapiens
ggcggaggttgcagtgagctgagatcgccccactgtactccagcctgggtgacagagtgagactccgtcttgggggagtggcgggtgtgtgtgggggaattccgtctgctaactacataagcctgaacctttgaagggcttcaatctcacttggatgattattagatcttctgtttcttgacctctgccgcctcatctttcccacatgttgatattgccttttattatgggacaacctagggtgggggtctccaattttttgggttccctgggccacactggaagaattgtcttgggccatacataaaatacactaacactaatcatacactaacactaatgatagctgatgagctaaaaaaaaatcgcaaaaaaaaatctgatgttttaagaaagcttacgaatttggcagcccatgggcctcaggttggacaagcttgacctaggggattccaagaggatgagtcgcttactcttgtttcgattgtggtacactcagtgggtgtaggaacttctcttggttgtttggcggcctttctcttaaggagaggggcacgtggaggaggaaggaatatgggtgtggtttctgcaaataataacttgaggtagacaaatggtctcctcaacttcaggcagggcaaggaactttttttttttttttttgagacaggatcttgctttgtgcaagctgtgacccaggctggagggcagtgacacattcatagcttgctgcagcctccaactcctgggccgaagcaatcctcctgcctcagcctcccgagtagctggggctccaggtgtgtgtcaccatgcccggataataaaaaaaaattttttttgtagagatagggctctctatgttgttgctcaggctggtcttgaactcctgggctcaagtgttcctcccgcttcggccacccaaagtctgggattacagatgtgactcctgcctccttatatttttctccccctgcattttcaaaatgtaggtggcagggaaataggaagtgatgcgctcccattgatgacttgagtaggtgttcatttccggtttccctgatggaagggaaggagctagtagacctctgttttactccgaggacacttaagctgagagtggttaagttgcctggactcacacaacaatcaagtgtcagagcaggctccaaagctgggcagactggctccccagcctctttggagctgctgtactgagctgcttccagttcaggtgctgtcggaaatgcatggagaaggcgctccctgttctggaaggctagagtttctcaagggaaattcttaaagtacctgcagttggagatgatgcatgtgtaacaactattagtgtgctttagggcagctgttctcaaagcatagcactcagagcagcagcatcggcatcacttgggagattctaagagatgcagattctccagcatccactctggactgattcagtaaaactggaaacactgggtgtgtgggtgggggtggtgaggtttcaagtgctccaggtgatcctgatttgaggcgcttactgcttccagctactcctttcattggagtattattacagtattatgcttttctttatttttaattgttaaaatttcttt

SEQ ID NO: 73991 - DNA, 1026 bp, Homo sapiens
tttttttgagacagagtctcactatgttgcccaggcttgagcgcagtggcaccatctcggctcactacaacctccgcctcccagattcaagcgattttcctgcctcagcctcccaagtagctgggattacaggtgcccaccaccatgcctggcttaattttttgtatttttagtagagatgaggtttcaccatgttggccagactggtctcgaactcctgacctcaaatgatccgctgtcttgtcctcccaaagtgctgggattataggcgtgagccatcgcgccctgctgcatttcatttttttgtataaaatttggtttgttcgtttttgaggggaaccattcctttatgttgccccttactgatgcccaactaatgtgtttctggttactaacagaccttcatcccccaccctccctaaattcttcggtgtaatctaagcgttatctgcaccacttctgaataataaatgtgtttgaaatgcacacctacacaaccctgtcccacactggcctgtaggacctaatctaccttcatgtctttcagttgatttgtatttctgcaaaagatatttcaaggattatcaaggtatggaattttttttattttttatcttttaacaaacttgttcatttccttttctttccattgagcacctctgaacaatgtgattcttttttttaagtctttcacacttcaggaaaatactacattcacccacgttgtgattcatatcggacagtttcttactcaaagataacacaaataccaattcttattcatactttgaaactatattttaccctagactgccttggttcaaaggcctagtttcgacattactgtggcaaattatttaagctctctgttttcatttctttttctgtaaatgcaggatgaaaacaatatgtatctcctaggatggctgtgaggagtgagtgagacaggacatgaaaggtgtgtatgaactgtgataactgttgcccttgtgggcatgttatatagggctggctctaggaagaagc

SEQ ID NO: 73992 - DNA, 1149 bp, Homo sapiens
gattaatgacaatatgaaattatggatttttatagacttgacaatgtgcttgtttaaccattgaggccttctcttctgcctctacccaccacttacaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaa

SEQ ID NO: 73993 - DNA, 1076 bp, Homo sapiens
atatgaatattccactcatgcaggttatctcactgaaattaatttctgaccacacacttgaatgagatcctctttctttgatttaaaatgtaaactttaggccaggcacagtcgctctcacctgtaatcccagcactttgggaggatgaggcaggaggattgcttgagcccgggagttcaagaccagcctaggcagcatagcaagacctcgtctctattttttttaattaactaaataaaatgaaaatgttatatagctcatagtctgaaggattatgatttttttaaggattgtgtgttaaattttctaaccccaaagtacatcaactgattttattttaataatacataattacttccaaagcttagactctttcaaagtttcctgtaaggttattttggaactaaagatagattaaatttttaaatacttaacttgcctaatttttattgatcttataggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaaggtgaaatcacttttacttgctagatatacataaatttgtctttggacagcaccttaatggtcacactttttgtagtgaaatataaaacagatagttagctggtagagtagaggttgagattttcacctttcttgttctcagtattgcatttctttccattccatagacaaagatattggagtgataactgtaacaatacataataagcatgacactttacaggttttcaagatcctgtcacatgtattatctgatacttgcagatatcaaatggtttgtacaaagaaatttgtgactggccagaattggggcccttcagatcttcttcactaccctggcatgagaccttaggtacttttgagggtttagctccacttgggagccgaagtgagggtggaggccaagctcctctgtctgcattagagaagaagcccaaacattttcccagtggttctaacagccaggacgccagaggtgtttctg

SEQ ID NO: 73994 - DNA, 1050 bp, Homo sapiens
ctgagataccacacatgtggatccctgcccagcctcctggtgagcactcggtaactgttggccatttttaccctggctcatcacccactcccaggtctggtggtagaatgaaatgacctcccccttggaggtaaaagtggagagctggtggggggaagtgcactgtatcagtctccaagatgaaggtgagtgaaccatgcaccaactttgctggttgcatttcatcccatatctaatgcctgaccaccatcattaaaccttcacctaaaacctgaccttcaccatgaaggaaatttccttcagttggtaggatagggcttggttttatacctgctgctggcaggcttccttgtgtatgcatataacatttctctgggaatagtcacccaaagacctcatctcccctgagtgcggttgccattctggggtgagattgggaagagtccttcctcatctgcccagctgtggggctagggcattctccagccccagaactaggtcgtgaaatgcatccatgcaggtgtcgaagaatggctctcattcttgctgctgacctctcgcctgtcgttccccttttatattctgggtcttaccacttgaaaaccgtggggttagcacccagaacaagtgggaatcccaggaccttgggaatttttaatgtttttgtagttgaaatattttcattaattttctgtttagccacttgattgaaatactttataagtaatgaagatcttttgcagttgtgcccttgtgtcttaaaaggctaccgtgtactaggttgatgaatgagaaactttaacttaattatttaaaactataatttctgtagagtgtagttaatggaaagtacatagaaatcgaagatatgatgaaaaggtgaccatctatgactgattgcctcaacgttttttcctcagtaaattcttgctattcaggcatgactaaaataccatggaatgatatctttcaaaatcatttgaaaggaaactaatgtaactttgctgttgtcctgtttgtactgttcttatttttccttgttaatagaac

SEQ ID NO: 73995 - DNA, 1357 bp, Homo sapiens
caaagtcacattcaacgccgccacactgaagaaaattctcattttggtgagtaatgagttctgtttgaaagctcttttcttcctgctccctttttcttttggcaatgagacttggtccagtgcatttcccagtcctcttaaaagaagcatcacggtccctgtcaattcagtaagtaaatatggagccctcaggaggtgcatacagtgcaccaggtgctggagatacagccacaagctgaacggagaagccccactctctctcgagttttacattctaaagggggttgaggagacacatttaaacagataaatgagtaattaaacagacaaatgagtaattcttctcaaatggtggcaaatgcgatgaagatcatagcgcaggacaatggggtagagagtgactccaggtggggtgaaagtctcagaaaagtgtgtcacaggccaaggaacactgactgtaagggacgtgaggtgtgctgggatgatgtgtttgaggaacagaagggctggtggaatggaatagaataggtgaggtgatggtgtgtggtgaggctgaagtgctgggggcctgatcacaggaagccgtgaaggcgtgggctggaatgtggagtttttatatgcgtaaggtggagccactggaggattttaggtaggggaagggcatgatctaattaatgtgtaccttagcatgacccttctagctgtggatagagactactgttggggcgacagtggaagcagtggatgagtgaggggaggaggctgcaatcgcagccgaggtgagagagacgggggcctggaccagctttgtccccaggcaggtgggcaggtgaagttgtaacagataagttgtggacccagaagctacagaggaccctgggtttctgtcctccatgtttgggtgaatggtgatgctttctgtgatggagggccagggtcgggaggcaatttcaaggaggaagagggctgagagtttgtacttgccatgggtgcgtttacatcacatgtgcaacagacatgcaggtgggggtactgaagggctgcagcttaaggtggagacccaggctggagatttaaatctgggaatcactggagtagagctggtctggctgaggtcacctagatagagaatagaaagtgatgaggtcagccccaaggtcttcccaatgctaggagctcagaaagagcagcagcagagagtgaggaatagtctctagcaaagctggagggaaacctggggagtgtgttgtcatggaaaccaagggaaaagtatttcacagaggaggcagtggtcagtcatatcaaatgccgctgaggtacagagtaagatgaagactgacaatggacggctgttgtc

SEQ ID NO: 73996 - DNA, 1076 bp, Homo sapiens
gttaaaacctctaacatacagaaattgtatgtttataaacttttttttccttttttggggttactatagaaatggctgttataagagaagattttctttctttctctttctctctctctctctttttttttttttttttgagatggagtctcactctgtcgcccaggctggcgtgcaggggtgcggtcttggctcactgcagcctccttctcccgcgttcaagcgattttcccacctcagcttcttgagtagctgggactacaggtgtgcaccaccatgcccagctaatttttgtatttttagtagagacgaggtttcaccgtgttggccaggctggtctcaaactcctgacctcaagtgatccacccacctcagcctcccaaaatgctgggattacagacgtgagccaccacacctggcctaagagaagattttcaaatgtgaatgataagtaatgattaaaaggtaatgactcaatttatcaaatgagtgacacctactactttttcagctaccagaccttggcaagttgctcaacctccctgtgcctcagtttctactctgtgaaatgggaatattaattgtacctaccatatagcagttgttaatggggattgaatgacttagtgcatagactgtgcttagagcagtgcttggcatgtagttagttattgttttagctaatacctgggaatgagggaaaaacgttttgtggcatgacaaatactaaagctgacttactacaaaatgtgaacaatcatatgactgctatcatgtgagtttttctttcttcccctatacagaaaatccaaagcctagactccttgttctgacacaatgattgggtccaccgcattatcagttttacctttgagaaattgtggtctcattctcattctcataccacttctctttgtctctactccctttgctttaagaaatcataagaactgagtagctgagacaaaaaaaaattaaagatgcctgttcttgaaggcttgaagacacagacagacagacacacacacgcacgcatcctaatgggttttttcccccatggggtgtgcgtgtgtgtg

SEQ ID NO: 73997 - DNA, 1042 bp, Homo sapiens
cagttcccatttgataggcctgtcccgtatcaccactctttcttcttaaagatttatattgtatatcagaagacacagtatatttaagcaaaaacagtcatttaaccaacaaatgtcatggttcattaccttctgcagacaatcaggggattaataattaaacaacaaatgtcgtctgtggtgctttatggaagttatctaaatgctggttgttgaaacactttcctcctccgaatcaacctcaacatgaaaaaaccatatacaaattgctgttgaagccagtccccaaacgatgcagaatgtttaaatttgtagggtctttttctcatttttataaattttgaaatactttcaaactgacagaaaagttgccaggagactgtaaggaattttcatgcgcccttcacccagattcccccattattaacattttccacagtccctctatttctgtatacatattattattacttttgaaccatttcacagtgagttgcagatcctaaatatttcgatgtgtatattttctaagaacaagaacattcacttacataacagtatttaaagaataaaatatttttatcttctggtcttaatcttctactgttttgggttagacattgagtccaagataaatattgcaatttttgagtataacataaaccaatgtattttttttttattgactagttggaggaagtgcagaaggtataaacaatgattgagaaagatattgaagtaagcaacagattaacaagattgatgtcatgcccttactttctagtcctttcggctgactatggcttaaaaggcctcactggatttaggaatagtggagctgatgcatgaatgctggagagaactgggtgcagggcagagaaaatggtgcagttaatattgctcaggactgacccagcaggagtgttgagtgttcttaagataggggaacagtggccgggtgcagtggctcacacctgtaatcccagcactttgggaggccgaggcgggcggatcacgaggtcaggagattgagacccgagac

SEQ ID NO: 73998 - DNA, 1024 bp, Homo sapiens
ttgatgctcttaaacagatggaggaagctaagtcttagagctgacaatttgttctagatcagggagcaagtaagtgacagaatcaaactttgaaactatttatgtctttagcactttttatgcctggttgcagggaataaaggccaattaacttggacatatggtttatttgaaaccatatgaagtgcgtgttttatttcctggatgtttttgcatgggtttatttctagttaacaatatcttgaaagtgctaaatatatttgatattacaactttgcttccagttactctgaattgtattttcctttcttctgttcacatatttggatgttaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaaggtaaataccatggccctgtaaaacttgttggtaaagctgatggctaaaatccccctccatctgtttctaccttcagcattttgagtatgtatccttttggaaagacaggtgaagtattacatattttggggagttctttggttcgtacttttatcaaaatgttatatttaggctgctaacctacaaaggaagaaagactccatttaaaaagcaacttgggtgtcagaaatctagaaagcctgccatcaaatatgattaactgcaaatttcatttaaaaaacaactttattgagatataataaaaatgtacccttaactttaaggacacaattcggtgaatttggccaagtgtatattgctgggtaatcaacaccacaatcaaaatgaaaaacatttctgttatgccaaaagcttcctcatgcccttttgcagcgagtccccctctatcacatttaattatatatattttattgct

SEQ ID NO: 73999 - DNA, 1049 bp, Homo sapiens
tctcctcccacgataacatcaggcgccaggacggtatgaggggcaggagttttttaatgttgctcacttattgcagatacctaaaatagtgcctagtgcattataggtgcttaataaatacttaaatattgtaacagtctctatgatgttcattaaaggtgagattctaccttcaaacaattttcattttattattcaaaatatttttactacttctgcattacacaacttccctttattttctggactggttacattcttttgactgattaggtcaagatgggtacattttttgtcttgtgctccatataatgaaatagggtttgtattttatgttacgttctttacatcatttttcagcttctgtgacttttctcatctgagtagatgactgagacagataactatttttaatattatattttttagaattaaatcttagttcgtggaaagttaactgattgtttttaattttatttttaggtgctgaatgtggagtaaatgcagatgttgagaaacatcttgaattgggcaagaaattacttgcagctggacagctagctgatgctttatctcagtttcatgctgccgtaggtttgtatcatggaaccaaatcactcagtgtctgtcttagtgaattctagtaatagctctttttttaaaaataacatttaaaataaacattatttcatgtttaaataaaacatttaaatatatttgtgggattctgagcgaaatagatggataaaataaatatataacacttaaatgtatgtgcatctaacatgagagaagtttgaaggttagtgaggcctgctactaccaaggataactcaagatatttctgacaaacagcttttctcagtgtattatttggcttctgactttttttttttttttttttttttgagacggagtctcgctctgtcgctgtcgcccaggctggagtgcagtggcacgatcttggctcactgaaagctctgcctcccgggttcataccattctcctgcctcagcctcccgagtagctgggactacacgcgcccacca

SEQ ID NO: 74000 - DNA, 1050 bp, Homo sapiens
gctgcagagggccatgatcatgccactgcgctccaacctgggtgacagacaccttgtccgccccccccccccccccccccccccgccgaaaaaggttataagttgaatatagttaatattctagaccaggggtttgcgaactttttttctaaagggctagacaagtagtttcggctttgcggccacagtcttatgtttttcttttgttctttcttttttttgggcaacttttaagaaatgtaaaaaacattcttaattgaagtctgtaggtcggatgtggcttgggctgtactttgctgacccctattctaggtctatttgcactgatcttgctaggcaacatgactcttttttgatgatgagattcttttcttaatgtccatcttagtagagttgcaagtgctgatactgtccaggtgatttgtttttttttaaatttttatttttgaataaatgactaagaggtaatattattttaattttcagatggtgaccctgataactatattgcttattatcggagggctactgtctttttagctatgggcaaatcaaaagctgcacttcctgatttaactaaagtgattcaattgaagatggacttcactgcagtaagtatatctcaactttctttaaaggggaacttaacagaacttggggagagataatttgtttcataaggtgaggactggcatgctagacatagctggaagagatcaaagctacagtgatgttgtggactgaggaacaagagaaattcaaagtccctagaatcaaagatctgtgtgaaagagaacagcgggtacattagatgtttttttttcagaagtctggcagtgatgtcagctttgtggtttagaaagacaaatctgtgtggaggctggagtgtgaggcaagatgtgaggctgagacatgagttgatgaagaggctgaattaagatgctatcaggtgactggcagcagttgcacttaaggctgtaccaggaagaataaagtggggattacttaattgggctatgatttgtggtgacaataaaatgctaaattagc

SEQ ID NO: 74001 - DNA, 1039 bp, Homo sapiens
aatgacagaattctacaagtgaatagattagtggttgccacaagctaaggaagggataggaacaagagggaagtaggtgtggctataagggcaacatgaggtgtccttgttgggatggaattattctgtatcttgactgcacccacgtcaatatcctgattgtgacaatgtactatagttttgcaaggcgttatagtctgcaagatgttgggggaaaccgagtgaagcattctcatgatggcaacttacaaagctactaaaagtagaggaattggagcctattttctattaggcagttttgtctgcagtgccctctactcttttcagtcctcctgcccagcctataaaccccctacaaacaacactcacacagacacagcctcttacttctgtccacttttacttattctttaggattaggatttaaatatctatcaccttctctaaaaaaaaaagctcctcttttactccttgcctttaccatcctggtttggagtaaatactcctctttggtactccaattatcctatgtacattctatcactttggtatcatattgtcttttaataatcaattcatatatttgtctcccacgcaatgctataaacttcttaagaacaaaaactattgtcaagtttaagtctgcaccctcagtacatagctcagcctgatataggagataataaatatttggtatagtacaagtaattctgctggtaaggatactacacagttactattatttatattcttccctattccaaaaatgtccaattctggtagttttgctaaggcccagggctatctagaataccccaccctcaatggctgagaagtaaaagagcagttctgtagttcacttgtgcccacagccccgcacataaggaatggctggacagttggaacaaccatattctcacctgccatctctgatgagctcttcagctgactcaatcagcttattaagtttctttacttgtttatagtgtgcaaaacaccttttatgatcctggtcaagtttaagacattcccgaacttc

SEQ ID NO: 74002 - DNA, 1255 bp, Homo sapiens
ttgttgtaaatactgacattaattatataaaatggcacgtaatgggttccattattttcatggaagtgtttactgaccaagaaataaaacttgatctctgtattgttcaaggtgctcagtgtaagtcagacttcaacagggtgttttactcaggtttggaattctgagcaatgtttctgtaaggaaattcttctggtttgattggtacttatactcacaggtatgctttgttctgtccatctgcatctcctatggtcatatgtttttatttcctaactcttaattatggagtgtaccttctatgggactctagattaataagggaaaagccgaatctgaagccatgggctcatccaattggattgattaagcaacacatggtgaagaggggaggagcctttctacagctctggaaatcaaatgtcatcatttcttatcatgatttgctcatttcttagatacacagatgctaccagcaaatatgaatctgtcatgaaaacagagccaagcattgctgaatatacagttcgttcaaaggagaggatttgccactgcttttctaaggtaacagttgacttgttcccagaaatgtgaaaactcaacatgtggaataccaaccataaatccttgtctcacatttccttttaggacgagaagcctgttgaagctattagggtttgttctgaagttttacagatggaacctgacaatgtgaatgccctgaaagatcgagcagaggcctatttgatagaggaaatgtatgatgaaggtaaatctttaaggatttgatttgcagtaccgaagtgttgattaggaaattatcacattttaagcttccttttccttaaaacaaatttaccagagtacctggaaatgttgacaattttagaaaaatggcagagaacttgaaaattactcttccatagtggaacctgaaaggtataccatgtgaggaaagagttctgccattgaaaccagttcagtacaatagaaaaataaatattttagctttttttgtagaaaggaaaaaaaataacaaaatagaaaatttaaattgtagctctcatgttatccggaagtaatcactgttcattttgcatttatcttttccagcttttatctatgcacatatattactctatattttatgcacatatacatattctctctctctctctctctctctctctctatatatatatatatatatactcggtgtgtataaaacataaatacagaaagcatacatacatgt

SEQ ID NO: 74003 - DNA, 1569 bp, Homo sapiens
tatggaggccccgctcccctcatgtctgaggagccttagtgctagaatgctcattagatgcttgatgaggtcattgccttacagactttattttggggattagggtggtgagctggctgtttcattagaattgtagactcttggaagtttctcttgaattatttttttccaaataatttcattgggtagttatcaagcttgggtggcttcttctggagtgagatttaggggcctgaatctcaataaatacctattatcaaccctgaacctcaccctccttgtggcaaatttctctagtctgtttcttcagggtgggaatgggagagcctggatttgaatgtcaggcacaactcttgataaccgaaaagtaagtagctcctcaagcccacccaccctcctctgcccaaagaaaacattccccctgcccctataccttagatattatctggttcttaattttctgatttctttctagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttctccacttcta

SEQ ID NO: 74004 - DNA, 1054 bp, Homo sapiens
tgtcagagtgctgtgtcctcccatcttagatgacgactatatattaatatgtcctctgctttctgttgttccattacattaagggtagaatactgtattcacagtgaataatctgttagtattcttcaagacctcttatctgccaggcaggatgctagatcctaaagataacaaagataagtaaggtatgttccttgtcctcatagactcatgggagctcacattctaggtgggtagaaagaccagtagttatgagacaatataatagacatcacagtgtacaaagagctattctcgtgttgcgtaatgaagcatataggtactgaactagcaaataaaggatcctcagtcagtaccggtgcttcctcatcatatgtaagtaatatttaagatatttttatgtttaagatgccagaagctaaataaacttttctcccttatagttttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaacctgattgttcctttttcctgatcaccagttaaagtttgacattttgccagatagcccaggtaccggactagctggtgtttatcaaactatagccttttgtatctggttttatgtgcatccacatttccttattcacaaaatgcatttaaaattacagaaatgcatttaggctgggtgcagtggctacacctgtaatcccagcactttaggaggccaagacaggtggatcagctgagttcaggagtttgagaccaccctggccaacatggcagaaccccgtctctacgaaaaatacaaaaaattagctgggcgtgacggtgggcgcctgtaatcccagctacttgggagcctgaggcaggagaattgtttgaacccgg

SEQ ID NO: 74005 - DNA, 1028 bp, Homo sapiens
gcagcagccaggcagcccagctttgctaagggtctctctcagtgtgctgaggctgcggaaaggctgcagcctgcaggcacttggcacacaccctccctgctgctaggatgccaagaggaaggtcagctccaccgaagggacagcgaaggagtagctcatgagaggagatctgcacacttgtcagctaaacctgcccctgcgaaagtggaaactaagccagaaaaggcagcagaaaagggtaaatctccagacagaacgtgcaaacaaaagggaaaggaggagcaaagggaaaatgggctgaagtggctaatcaagaaagtaaagaagatttgcctgcagaaaatggagaaacaaaaaccgtggagagttcagcctccaatgaagctagagagaaagaagccaagtctgattaatatcctataccatgtcttatcagtggttcctgtctcccttcttgtacaattcagaggaatatttttatcaactattttgtaaatgcaagttttttagtagctctagaaacattttgaagaaggaaggaatcccacctcatcccattttttaagtgtaaatgctttttttaaaaagagctaaatcattcaccagtttatttttgggtacaaccagaaaatagtgtgagatattgaattataggaggctttgactatcttaggtgtcaggttaacattccatagatggggggttagtttttatatcctataatacaaagcatactaaacagcaatatggagtcacggtcctgtactgaatgtcttaaacatcttaaattacttctgttcccttgttgttttttagtagaattgtttcctaaagaaaaccactccatattcgtggatttccctgtctgaattgtgtgcactctgtaacatatttagttgtgatagtcctgttttccaataactttgtgaatgtgctgtgaatgaaaatttgagtatgtagtgtacatgctattcagttatgaattggtaggacgtatttaacagcttatcaacatgtgaagatattgg

SEQ ID NO: 74006 - DNA, 1026 bp, Homo sapiens
attatgtgatacatacacatcctactactagtaaatatggagttggaaccctgagaaccgagatgccatttccatgtttttctactgtgcctacaaagcacactagtctgctatgttcttctacatagtggtaatgtaattagatcttttgtcaaaaagttttacataatttttttttgacagacttatgagtcatcagaatgtctttcaacaatttttatttaaatttctgattgaggtatttgtattaagcaattattacatacataagttgtgatatatcatttcacctgatcctgtgtgtattaaacttccagtacttagtaggactctgctttttataaaatgtattttgtttgccctagtgacacagcattgtccttatgtttccaggagcatggtctttcattaacaaaatttacttaaacttttagtgcaataatcccaaaacaaaagaatccaaactaaaagctgctgccagaattgtcccagaatgggtggagtatgatgctgagataagacaactattagatcatcttgaaaacaagaagcaagatacaagtaagtcatcaacgtgttgtgatgtctgaaacatgcgttgcattaatgagattagaatagactacagactcatttcttagtgaatttataaaatgattaagaatttctttaagaaagtctgtggcataatttaaaggtgtatttttgtgtagactaagcttacaagtttaaaacatagataatctgtttccccatggatacagcttcagctcataactctatatggatagatagtgtaacattagtctcctgacacaacatagaggtgaaaaataaaagtaaaaggagtgtttgtctttaagattgcactgaatttcctaaatgtgaaaatttgagcaagtcctaaaaattaataaaagctttacatagctaactaaaaatatcatttcctatctccaaaattaatctcatatataacagaggtttccccacgtgtttgtggttctagtatgtttaatcatgggc

SEQ ID NO: 74007 - DNA, 1044 bp, Homo sapiens
tatttttaaacagtttatatagaaaggtcacagagaataactcaaaaatatttgaattgtagcactgatacgttaaaatggaacttcagattcatttgtatcctttccatttggaggtttaggttagcaaaccaaatgacccatccagtgaatttgtcaatatagatagatcattcagctcttcagggtttgtagacttaatattaatcacacagtcatggacagctgggcccaggtgaagctaccatgatgtatatgtattcatccttacacattacatacttgataaaccatattttagtttatttcttcacatttcattgtgaaaaccttctaattcataccttcaattatttaaaagcctttaaaagacctatgtaacaaacctgtatgttctgcacatgtatcccagaacttaaagtaaaatttaagaaattaaaattaaattttaaaaaacacttcaaggttaaaaaatatatatgagctcctgttactgttaatgtatattgggtttaatattcttttatacagaattatgatgctttctgttttgcgtaacaccaaaacaccagtgaaattctggttgctaaaaaattatctctcaccgacatttaaagtaagtacatagctttttttgtagaatggttaatgtttgaatagtaaattatttgtatcattgtaagtttatatgatatttctcttttcagaataagctttttgaaaaaatggtatttagtatttttatgtagcttaagaaaaattctgtacaatttttatttagagatgttcaaaggagaggacagaagactgtatatttttaagtaaaatcaaaatcagaatggctagtagtttttcatgataatgagtaattaaatacaatttggcaatggaaaatatatacagattttcaattaaaagaaatggattctgtcatttttgcaaagataggcagaaacagtagtagtatcaagaaaatacaaagactatacctataccgtagaaaatagttttacagtactgaaacaaaaaagctctttcgtctgt

SEQ ID NO: 74008 - DNA, 1052 bp, Homo sapiens
cagaaacaactggaatgtccagccatttaaaatgatatttatagagacagagacatgttcttagaaaaccatgtttaatgaaaaggcaggttactttcttacaaaaaaaatttatgaagacaagaaatagaaatcagtgtgttgatgtttatatcagtgtttattctgttgaggtgcgttctgttttttcttctttccactttggaagtggaaaacgaatttttattttttaaaattaactttaaaaatatatcgatcaatttataattagttgattatagacattaatttttttaattacaagaaagccaatagatagtaagttagctttcttgccaagtctgaagtgggagcttcaggacaacagcaaactgaagcagattctttaaggaatttcccatctaaatctcatgttcacgtctttcctgcttggttatattggtgcatataccatgaggttcaggtaaagctgatgtcatgaaaaagaaaaagtttatcataagctttttgtcttgaagaaatcagttcaactcatgaattcactcatgtgtaaaataaagacttaaagttagccaccaaaatacattggccaatattaaaataatcacatttatttatttcaaaattttgtattatgagttttacataacaccaaaaacaatgacatacttcctccacagactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgtaagtattatttaattgatggtgtttaatttgatgttttggtgaattctctgttttcctaagagtaaaatgaaataatctttattctgctgttgctgaacagtttgcagaaaacaaaattgaatctttgaataagataaataaaaaatggggaaaatcatactttaataatttttgacaggttattgtaaaatctctttacttggaattgat

SEQ ID NO: 74009 - DNA, 1744 bp, Homo sapiens
tggcatatcgtgcttactatgtagatatatagtaatactgcaatatcagttgttaattgcaacgataggttccccactcaaggccttcttcctaaaaaaccatgaggtccgtttcttagagaagatctgtataaatgggtcaccttacagagataccattttatgattacttgtattaagcatcctaggttgcaaacttaaacaataagttgaaaattatggacatttggacatcagtctttgcagggggcaaggtggggaacaaagttgggggcacacaatataattggatatacattccgttggtaacacaaaaactatctggaatggtgagcgaggaggtgagaacatctaggactgaaggcagaagcaggaagccaactctgaaaagaaatacatggcaaacttcaaggggccatcatatggattatgtgggtcatgaaggggcaggaccccgggctggtggtttgaatccagcacagaggtaacttctgaccacagaaactggttagaataggatggtggcacatcggaattacctcttgtatcatatcactgatgattttttcccattatttttgtgttgcttttccccctcagttatttttttggcaggccattctttctcactctctttatgcttccttctttattactgtacgccccttaatctgcatgtccagagccttaaaagactcctttttagcattcttgagtatatatagaatcatagcattttatggctaaaaaggattgaagagagaatctagtcccacatttttcatggggaatgtaaccataaaaaggtgaaatgatatacctaaggtttcttgagggaattcatgtctccattttcataatttatattcaatgttttgcttactatatatcttgtgtttactatggaaagtgcagtggagtgtgccttaagcacctgcttactatgtgccaggcactacgatagttctgggaattgcattttgaatattggcagccctgtgtagcctaggcttcatctctggtaagtgagtatctctcccattcttaaataatgatggaaagatattctatctgcatcattttgtaggatagaatggcaatttttctcttttataacgtgtattccattagttttgttagaatagtttgaaccctgtggatgttatattaaataggaccttctgtgttgcaggttataccaacctaacccaaatttatttcagccagaggggaattattggctaacccagtcacaccaccggaaggttggggagaggtggtttcaggaatgactggaactggagatttggggtctttcttcccatactcctttcgatattgatctcattctatcaaattggccaattccacaagatgggcaaatgttcttcatatctaatagctccacagccgagagggaagcaggccttctcttagttccagtttgaaattttggggaatgactctgattagcccagcttggaacttgtgactattctttcagtcaatcattgtgtccagagagagagataaggttatctgactcaccttgtatcacagaaccatttatatgactggtgtgtgtgtgtgtgtgtgtgtgtgtgtgtgtgtgtgtgttatcaggaagaagaggagctgccatagatacagctgctggatggaccactggattctggacaacccctccaactgtgtcaattgtaggtgcaaatacatgagaaataaatgaaccttcagatctctt

SEQ ID NO: 74010 - DNA, 1285 bp, Homo sapiens
cactctcagtaaaaacttgaggaatgtctgggtaactactgatgttgtaaaaggaatttcttcttggggaaagggttagcctggatggccttttattttaagtttcgttagttctaatgtaagctgagtgtggggtatctttcttctcctccttcctaccccatgcttagaaaagaaaaaaaggattataaatgaactagtcctctagcatttgtaaatatttctaccaaggaaactttttgtaaagtctgatggtatagactgttttacacattcagggccaaaagcagtaaatgggtcctgtgtattaggtcgtctgcttcttaataataagtataaaaagataagatgagaaaatataacacaacttgccacaaaaaccagaaccactttgaaacattgtctggttattgcttttcctttagacagcaggctgaaatatataaggaggttacagagctctgtttcaaagactagactattatggcctgtactgctttctaaagcataagctgtttgatgtctcttctaattagaattgttgaactaccaagaaggttaatttttaccataaggtttttgtagtgtaaaactaaagagcagtgtaaaactaaagagatatgagattgttctgtctgtaggccatatctactgatttgttcattaccgagtctcctaaaatactgcttctgcttcaaaccaacaatatttgctataaatcagaaagaggttaaattaaaccctgtcagttttttgagtagtgaagacatgaattggaagtggtaaatggtaatagatgatttatgcttctgccttcttcctgatggttaccttggaattttgattgggttgattttagagaaattgaaatgttttcataatagaagtgaggcaaatttagctgccaacaatgtggatttgcttagtcttagactcttatattaatattccccaaagctaattattatcatctcattttgactaaagacaatcagaagcttatggcatttgaaagttatttatgcttgataatgaactaaacagtttaattgagaccggcaaatcctaatgtgattttaagagtcatgaaataaattattgggccaagaaataggttcagtatgaaaacaattaaatggaaaatccaaattaatattttgtagtaatcacttatcttgtttttgagttcgttagattgtggatatcatttataaattccctgttgattttaattggccaaattaatgttttgtagtaatcacttatcttgtttttgagttggtta

SEQ ID NO: 74011 - DNA, 1053 bp, Homo sapiens
atgatggttattaaacagtgttttgaccgttgataacagagttacttcagagtttagggaaaatctgagacctttttaaaacctaaagagagatgagtccaagaagaaatcaaactaccaaattcatggcaaagagaacttctgcattgcataatttggcagagtggtatccagaaaagacctctaaatttgtaatcaggcaaccaggatttgaatctgggcttcctcacttactcgttcacttatttattatatcatttcctgccaacatatcagtttcctgaggttggtgagtttgtggtctcctctgcattatcagtgcctagagtagtgcctggtacataatggctgtcaaacaaatgttgactgaataaacgaaagaatgaagcaagcgtaaataaatttactaatttatgagacaatttggataagaatgtgtgccctatatcctgtttttttggagttgtggggtgagaaaatgactacgaaggcacttcgtaaattatacagtactgtgctatacaaatttaaatttatattgacgtaagaaggcttttgatataaaatggaaaaggaaggaaagttggattttgaaaatgcaatgaatatgtaattcagcttttatagagcatttcaaaacaccggaatgacaaagatgaagttgaaaatattcaaaatacacatttagctcaacgacttgttagagtaatgagcagttccttttaaaacaggacattctatatcataaatgacttatctaagtgcataagtctttcgcttagaccatcaggaaaccttttttcctcctagggatttggcatagatcaaggtttgaggtgtttttttttttttttttttcccattgctttacccttttgagaaaattatcatgaaattaatattttaaattttgtgttcatgactgtatatgatagagataaattatagctacaggttaatatgtcctgaaagtgacctgagaatgtaatttttcttcatttaagaaaatgaagaaaatttctgatttgagaagactgttgaattgttctattc

SEQ ID NO: 74012 - DNA, 1017 bp, Homo sapiens
cctagtttatttagtcagggatgcagggttttattggagtggggaggtcacatagagcaggagcagatgtagtgaattccaacagctctcttctgtcttggggacttctagtttggtaagggtgtagggctgctgcaatgggcactgccctcatggtgtgtgtggtgttcctccagatccgaggagatcaggtggtgctagacctcaagcctgtttatgctcagggcttaaatcaccatccaaggatgagtcacacaaacacggattcacttaaatttaaggaggtgtttacaataatcaagctctcctgttcttgagccaaacttagcctcctcaaggtcacagactatctatggggagaagccagactcagagctgaggccaggtatctctgagcaggagctcagtgacttgttttctagaagtttggaaagcacacccctgccccccattaacagattgacagagtatgacaggaaaggattattgactttcttaaaggcattcaaactggtggaaaacattattacattcttaatagataattgggcaaagcttatgtacagttgtttcattaagaaccttagtaaataaataactagaaaaatattaacctcatctgtaagcaatgcaagtaaaatataaattaagaaaataacatagcttacacttactaaatgagtaaacattaaaaagcatagatataatattcggttctcatgaaattatggtgaaatgggttcatttgtaaatttggaaccttccattgctggtttttggaaaggagtctgactatatattaggaatcaaaaacctgcccatggatgtttgtaccaggaatctcacctctggaaatttatcctaaggaaataattcaagagaagaaaagacagaaagtatatgcactaatatattcattttaccattatttataatggcaaaaagttggaaaagtggaacaactaggaatttggatagtaggggaatggttaaactatggtacaacaaattgatgta

SEQ ID NO: 74013 - DNA, 1019 bp, Homo sapiens
tccagtctatcattgggcattcgggttggttccatgactttgctattgtaaatagtgctgcagtgaacatacacatgcaagtatctttatagtagaatgatttatattcctttgggtatataccccataatgggattgttgggtcaaatggtatttctggttctggatccttgaggaatcgccatactgtcttccacaacggttgaactaatttacattcccaccaacagtgtaaaagttttcctgtttctccacatcctcgccagcatcaattgtttcttgactttttaataatcaccattctctgactggcatgagatggtatctcattgtggttttgatttgcattcctctaatgatcagtgatgttgagcttttattcatatatttattggccgcataaatgtcttcttttaaaagtggtgtttatttttaaggatgctggggcaacacagcagcatctctggaaaacaagacaatagaacaacaggtgacaggaagagtcataagaacctggtcagcttccgggaactcggccgcaggaattagctctccttcaacgactcgagtgcatagtctgttcacttactggcttcttttacactgctactacctgaattgctactcataggcctgattatatatttttggcagagaaatctgactggcccacctcacctttttgtgaggtcccatggattgccaatcagctatagtcaggtgtctgccctgacccaactgtggggtgggagtggcaggagggaatatgctggtgatgatgtacacatgtggtctcccctaatcagcagagattttccctgaggcaggctctttgagaaagaaacaacagcatggcagacacccccaaaatgcgtttaacgtgcagtgaaatctcccatccccactccattcccaaaccatgaggtttcagcagcagataagcgtattattcatccatgaattctaagcaatcagggtggtgtctggcatgcagaaggtgctcagtatgcactattgaa

SEQ ID NO: 74014 - DNA, 1025 bp, Homo sapiens
gtttagaaatgaggagaagctcatctaaaaaattgtatcctggaaaataagaaaggatcaaaagaattttataaaacaaaatgtcagctggcaggaagagatatttctgttggttcagagcaaggcaaatctgagtaggaatagacacagcactgacatttcagaaagcaatgaagtatttgctcagggacctgtgagataatttgtcattttggactttgaaaggaggaatcaagaaagcaacagtaagcagttggctgacttgggaaactggtgtgctcaagagaaactcttttatttgttcagtgcaggtaactttcagtggataagaactagagggttatattttgtgaaaacacttatttcaggaagaaaaaaataatgtcatattaatcacctcttgagctgtttttgtggttttacataatgaatgattagtgtgcaagaggactcaaaaagtgacttaatataagtgttatttcgaatgcggattctatataaaccttaccagacagatggattagctcaacgaagcagatatctttggagacgcactgtgagctaggacacagggaggaatgcaagacagccccttccttcaaggaacaatgaagacagaaacagaaatgaagtggggcgggactgtacaaaggtaccgtgggtgccgggatggtaaatgctgtgttactggtgtacacaaagtggtttgggaacatcgaggaggaaatgagttttcttaggaagatgagagaaagcctcacaaagtatgtgacacttgagtggccatctgaaggttaagagcgatgtaaaggaaggacaccattgtataagggtatcaaggctgtgggccattcctgggggagaactgtggtgtggttagatgggtcgcctggctgtgcaggaggagtgctaagacatgaggctgtagagggagatgcgggaaggaggtaaaaatgattggtggtttctgctgggagatggcatggatctaaattgggaagaaaagctaatttgaagtggagcct

SEQ ID NO: 74015 - DNA, 1116 bp, Homo sapiens
tagagaatagcaacttgatgtcagagtagcacagcctacttacattctcttcctcttgcctaaaaataagtcatttcatgtgatcctgttagtgagcttttcctgcaggggcaatgaggcagccaagcaattttctaaagtctgcagatctccagaagtttaaaaatggtgggagagagggtttttttttcaaaagctaacacctggagaaaagctgatgagtaaggaaaatcttaggactcagattgataaagacctcactggaactgtcatggggaactcattgctacagaggaggaaaatggagatgagaaaacagtgaacccatttgactgcattactgataggcacaggaagtggtagaaatgctattgggttgtgaaagctcaaaaaccaaaatgaaaaattggacaattgatagcaagtgaggccttgatgtagcacagaaacgtggtggaggaaactgtattgaatttctggaagtaggaatgccagatcaaggggtttatattatttaaaacacacgcgcacgtgcgcacacacacacacgcacgtaggccaattggattgtactgaaattattttaaaaatgtttgggaaagatttaatctcaggtcatgctgataagtggaactttatccacatatagattagttagatacctttttatgaagaaatgttgaagctatatttttggtgaagaccacaaaatcccataattttagaatcagctatgataggaaatgctcagatgttaaattaaaaggtgaatattattttaaaaatatgaaaccttagagagaatggttgagaacaaagtacccatgaacatgaaattctgaatttccatgcatttatctttaaccatctccttccaccttcctcgaccctttctcacccctcatccttgcatctgtcctgcgtgagtggtttctcaggtcaaaatgtcttttctttctttggcgacagggaagcatggcccagctgcagggctgtacttacggaatggaattgccctcccagagtttcctttgcagaattctttgatttggtgtccaggatgcttgctcaggcctctcgggttatcgggatatattttctttgacaatattcttc

SEQ ID NO: 74016 - DNA, 1051 bp, Homo sapiens
attaagagtctgaggcttaaagccattaaataagttgttcatagctaccaagtggtgagtctgagatttgaaccaaagacaattgtattaaagtaacaaacatcatccatccatcctttccttcctcccctctttccttctcctttttttctttattaatgtggataacttataaagaggcatagggaataagaatgtttgactacattggtatggagttatggagagttaatttgccacaacatacttaatttttataaaataacattctgcttaaggtaataatattaatgttctgttatcacatgcattggttatttagtgaacagtagtggctgactaatttaagttgttcaattttactctgcatgtagtagagaaatactttatcttattacataagttactcaatataatcaaatttagcaattttatcttctaggatatttggtactagattataaaaattattcctactcaaaatttcatggtatattacagacctttttttcccccaaactttcaactgtgagaaacttcagaggcacatttcctcaaaaaaggagcaatgggtcttcaaatgtatacacattgatatttcctattgcgagtcatttacattgacatgtttttgctattgcgtcgtgctcttaaaatgtcaaatgcatttatcgtagttagcaatgactggaaaaacttttctctgaatattttcctgaggaaaggagaggttttttctgcctcgtttgagctcagtggccagcagtttcctgggtctctagctgtgctgcaggcctctcagggccctggcctggtggagttgcagatggtctgcttttcagagctcttgctggggtctctgtcttagaggtgcgcaggaggcacattcgactcggaaggctgatcctaggatggaggatgcttgctgccatttcagaactctgtgactgcccaacatgctcctaaaacagaatccaccctcttgagatcttttagattgagcgtatttgggagttggctagaacccccgcccttcaaagctgtttctcta

SEQ ID NO: 74017 - DNA, 1024 bp, Homo sapiens
tgacttgatcatctttcctattttgacaggcctggcattctcctgccttaggactttgcactggcagttccctctgcctggaaggctcctctcttaggtattttacatggttaattcccttaagtcctctttgtgctccaatattgcactcttataaagcataccttggctatactatctaaagttgcaacttggccatctttcctcttctctccccagaccatggcatacctagtcctccttactctgctgtagtatttcattttggcacattttataactatattattttttcccatttgttatatctgttgcttttggatatcttcccccaaactacttgagggcaagaatttttgttttgctcgctaatgtatctcaggtacctagaacaatgcccagctatacttttgagtggatggctacagaatataccttacatcgtattcagaatgcctctcatttcaaattcctctcactttagcttttctttaatacatgatcctactttgcctctggactgtaaccctccttcattcctagcctgatcccaccatcccatttttgtgtgtgctctagtgccacccttgggcctgtcaggacagagcccaggctagaaaacttacggctgtgagttcatggcaggtggccatggtattctgcctggttatctctgagattagagacacagttgataaacgacagcctgccaggcatctattactacatcccagctgtgcatgggagtgggtgtgcatcccgcagacagctatatgcagatgcacctgtttcactctgagctctggcatgtctcagaatttctgacgataggggctaaatagacggatcgatttggggcctgatttaagtggtgaaattccttgcctccaaggaagcttggcctgcaaaatggcatcatcagaatttcagatgagagctgatctgctttccaattagcttccatttcaaatttctaaattccttgcgtggaggaagccatcctagattaggccagttgggataa

SEQ ID NO: 74018 - DNA, 1027 bp, Homo sapiens
aatttttatttgatggtttatccgaaacacaatattagacagtgttaaatagtagcagtcctcttctttgatattatttacataacacactttgatatcctcaattaaaagggtacgaggtgaaagagaatttttgttttttgtttaccctcatttattttgggaatagttgttaatacttcagataacaaggcagatttttcccatgtataaatatcttcttggaaatatggaatattggggaaaattagcaggcacctttttttgggaagagaaatactgtttttaacattactgcttcactgagcccattaactgcatgagtttgtgcacactccaaagttatgtaacagataatttcggattttgaatttggcttgggatacagaactaccatagacttgtcaattgtaaataagttttgaatgcggatttgactagtaggagatacagagtgtagacatcaatatagtaatatagatggaaagatggattgtctatgtaattccttgatcttacaagggagagaattgagaaaatgagccattgagcaacttacagaagttgtgggttagcggtagcggggatcatattagaacaaggtgtctcaactcctacaccagtgctcttgccacctactatgctggattttgtggagaaggtctgaggtcatggagtgaatgctatacaagggtaccacagtgtaacagatggttggtgctccccagcttttttctggtttcctgtgagaaaaaaaatcttcgttattgttggcctctagactttctcaagctcattatctgttatgaacaaggagtcatgagaataggtggatgtaaaaatagtgggtctgatagtagtaaaagtagctgatacctttttgggagaatttctagtcaaaaaaataacatttggctatagcagtgtcagcaggaccttctacaggttgcccatgtggtgacccctgccacctgccccacctctcatgccacccacccatccaggcttttatttcctcaaatatttc

SEQ ID NO: 74019 - DNA, 1420 bp, Homo sapiens
ttgggtttttagatgcaaaagtcaaaaatttgcttatttgggtctactctgaaatagaagcccccaagtgcctacctgtttcctagattttgagaatgtgggaataggggaacatcctgggataatagggaatatagagggggaaactacatgagttaatatgttaaattattattttctgcaagtgtaaacaaaccgaatagagttttggaaatgttaaaaaaagattagggttagtcagtctgagtaacagaaagctagctaaaatattaatgaaatatattctttattagattaaataatatgtatgtagatacatgagtggctgttttgttgtggcttgtagtgacctattagtttctctctctcagaggagagccatatctgtaaaaaccagatttagtccagtactttaacaattagaaaacagagatccatagcatgaagacacacagccagtgtagccaaccaggccttgaaacgagattctcttacttagaattctttgcccatttcctccctccctgcccaagactgaaattattttgcaatagaagaaaattaggttagctatcaaggtgaactttttgatgctaataggttgaaacattgaaatacattatcgaggacatttgcagtggttattttaaaaaatggttaggcagctaccttttcactctggtctggggacagtcctgtagaatcagggcttactgaagttgatttctttaccctggtttttagattacatgattttaaggcagatacttcaaaaaaggtttacaaatatagacttgattgaaatatttgccagagaaactgccctggtagcttctctaaattccagaaatacagtgtttgtttccttttttgtgtgtgtggaggtaacatcaatctgccctttcaagcaaatgtaaggatttttcaagatgtttaaaaacaggagagtgaaattgtcttcagatccctagagaagatcggattgcatagaactttagcttcttccccacgatggaatggatttccatcaggagaggatttataactttatgggccaggtagtgtaaaagatgtgacaggcttcaaaaataagttttcagtgggactatttcttgagaatggtaattgattttgcttagtatctgctgctaaaaacaaacctggaagactgtgttgcattaaattaaaaaaaatagaggaaagtattcacattcttgtgaggatgtgtagagatttagatagattttagagagattattttgtattttattacaccctgggctgagagagctacattgtggaaagcaaatcagacatttcctttccctctggtaatatttaaaatcttaactttcaagagaaatctctcagaataactttcctctcccatcctggaccccagaacacctctccagtcctt

SEQ ID NO: 74020 - DNA, 1061 bp, Homo sapiens
atcttgaatggtcctaggcaaccaggggatatatggtctctctatttgtggttgatgtgcttcatttgggatctggtttaacatttcagctggagcatttctcaaaaggacttcctgtttctgttgaattaatatcataactgcattctaaggatgagtggacttatttctgaggatggcctttctcagaagctttagagattcttccaaaggcaggagtttcgccccttcactgtacttaatagtgccagtacttaatggtaccaggaccttgagattaatgggtttaacaagagactagaggattttccttcctaatcctactacgctggcctcagaagagtctttgccatctatctactgtgcatctgcaggaaaagtttaattccagtcaagtaataacacctgtaatacagagctctgtgattcaaagtcaaagattatttatagattatttgcatctttccaattatccatgctgatactcctatccaaggttgttatagggattatcatatttatctgagaggcagcctacctggaaatttgaacaaagactagtgccaaactgtttgggtttgaaaccttgctttacccacttatcaattttgggacccttgacaagttacttaattttttcaatttcttcattaataatataataatagtagctacttcataacattgttgttaattcatttataaattaacatttttaaaatgctcattacagtgcatactacttagcaagaagcatatacatatttctaagtaaaagtataaataaagcttctacatataatcaggtactgatgacattaggtttgaaatgcttgcagacataaacatgggaataaaggaaagaataaaataaaagtgagtgctatagacagcacagagtattagagagaagaagaacagtaggaaatacattccacaggagattttaagatagaaatctttgtgttacaagagctgatatttcattgggtataatgaacccaaaagacaaacgtcattttttcctttgctttattctttgagtgcaattgaattttgca

SEQ ID NO: 74021 - DNA, 1071 bp, Homo sapiens
agatagaatgtgtagaggctgtggctctgtagagaatatggtccctgttttattttttaaattgtttggtttctgacattgaaatatgaagataaaggtattttatggttccagactaatccatttcagcctagtctggtcagtgtgtttggaatctacaagaacacaggtaacctgaaccaaggctcttatggaaggaactgagagaaggatcaaccgcttttgtagaggtacaataagaaccctagaatcatcttagaaagtaaatgtgtattaccatgacagtgagatgatttatccctgtggtgtttatctgggatgaatgaaggttatcagaatggtgcatcacgactgtcattcaaaatgtctcaaaagtaagatatcaacatcatcacaactaggtatctttatccccaggaaattaagaagggccatttaactctctgactctaaataaataagagtgagaggaaaaagttattagcaggtggaaaatgtaaagaaaaatagaaatagaaggcaaacgttttctatgtttaaaagactgttagggcccagggacctcttgtctagtctggagttgttggttgagctttaagacagaagcattaaagtgggaaagtctgaaatccctgaagagtctgggtggatatttctgtcttctgtgacgtatgtgtctgaggatagcatgtgtctttttggggaaaaatcaagaaaattatgaccaagcctagattgtaattgttcctttacatagtaccttttaaagtttttgacttgatgaaatgaaaaatcagacagtaaaaaatacaaaagtaagattatctgtgaacagtttttaagagttacatggtcagttttgtgtccgtctacccattctgggtttaccagagcagaaattagtccttattcagctaacctgactgttgtactcatgcatcaaccagagagctgggaaagttcctttctctttagctttcaagaaaggatgtctcttaaaagaacaagaactaatcagaagtgacatctgcaattaagtcaaaatagggcatacgatattatcagatacga

SEQ ID NO: 74022 - DNA, 1053 bp, Homo sapiens
tggaaaatacaagttgctaactccccttcactgggcgcctcagatcagagtgtcattcatgttaaccagttttggggacccaaacttctgttagaagaggtatggtcattcctgactctgatcctgagagggtttggtgcaggcattacaatatgcagagattggagaatcatttgcaaagggaatgtgaggttgggtgtaaagattctgagattacctgggacagaggtctgggctgaaggacaggataaacagcaagttactttttgttgttcccactttacacagtagatatgtgtcaataaatatttgaaagtaaaattttacattattcattcatttctccactcaaattttgctcatctttttttcctaaaagggtgacagagtagtttaattgacagaacaaagggctgggagacccaattttagatttgcactaattcccattttgactgtgggtacatcccttgaaatttctaaaattcttttcattttcaatgattaggaatgttggattaaaaaaatacactatagctaatatatttgactttagactttaatgagtctttcattcatgcaacaagtgcttattgaacgcctgttcaataaatgcctatatgccacacacattccagctaccaataaatcagaagtgaacaaaataaatatagtacctgcctccaaggaatggtcagtctgcgtatcctgagctgtatgttctaaccatttctgaaagattggtgatatggtttggctgtgtgtttccacccaaatctcatcttgaattgtggttcccataatcaccacatgtcatgggagggacctgatgggagggacccagtggaaggcaattgaatcctcggagcgggttttttgtgtgctggtctcatgatagtgaataagtctcacaagatctgatggttgtgtaaagggcagttctcctgcacatgctttcttgcctgccaccatgtaagatgtgcctttgctcctccttcaccttccaccatgattttgaggcctccccagccatgtggaactgtgagtccatta

SEQ ID NO: 74023 - DNA, 1034 bp, Homo sapiens
tggctgacatggctaacctgtcttaggagagccatcttggaaacttgctatttatctatacttattgtaaggtcgatatttcaatttcctcccaggagtagaactgccagtaggatatctgaaattcaagacctatgacaatcaataccttaaacttcttgtactcaaaatccacatacaagcgctttttgggactgtcttgcattttgtttgtgtggcaagaaacagtttctggtctttgaatcatcatgtccttttccagcataatatcctgtggggttttcatcagggaagaaaggcagcacaccggagtaagattttgctatgattatctcatcatctcttttcatttgcagtgccactggcaaaactcttttttaaagaagggttcagcaaaatgattggcactcggtaagtggctgatattgaataggaaaagccaagagctaatttgaagtctttatataatgttctttgtttaaaaaattgaagagaaaaaatccaaaattagaagactaagaactagagcagtcttgcaccatactgttttaattggctgttgctcatgagaagaatcaataatttcttttgaagtttcgcatcaactgcttaattttgatcaagtcttataattaatcaggtgtgaataaaatgaatcagctataattttaaccatgttttcttaaaaaataactacaatgatataagtaatgggttatctaaccttattcaaggttttataaatgatttgagcagtattttagaggaactacaacttatcaattaactcatgagttttggcaatcacattttcaatatcttttaagaacaaatttattgaaatgttaatgtaattttgtgttcttcaggtattatacctgttttattttaaccatcaagtagtaatataattcctgctgaatttccaacactgtgtcagccctcatggaggcagaacaatgagtgaacaatgagcagcccaggttacggacttcatcctcaaagatcttataatataaatggaggaacagata

SEQ ID NO: 74024 - DNA, 1031 bp, Homo sapiens
attcttctccattttctgcccatttaaatccctatcatgtttaaaggctccagagctacctctttggaaagctcttctgtcagaaagaattaatccctccctttggatttccccatattatttatgcctcgatttagcactcatttcattttgtcttagacaattctcatttacgtatcttaggtcatgcagttcttttccacttaccttcaatggtgtcttccctcttcttgcccattttcctaaatgctgtagattcatcccaagtctactacaaatgtaatgtcccccatgatagcctcagatattctgttcctcactgatgtgtttcatttctgaattcctattatcttcttagcttaagtcactgaaatagcacctctgattcataagcttgccttgttctctaattttatgatggtccaagatagaaaccagaaagaagttagtatattcttgttctgacccgcacaggtgtctgtgtgagtctccttgactctttaattgtagacgagattgacttgattgaccactgcacactgagcatttgcctaaaatcctccccaaggccgtaagtggtagttcatgcctgtaatcccagcaccttgggaaaccaaggcgggtggaacacctgaggtcaagagttcaagaccagcctgggcaacatgacaaaaccccatctctaccaaaaatacaaaaatcagctgggaatgatggtgcatgtctgtagtcccaggtacttgggaggccaaggcaggagaattgcttgaacccaggaggcggaggtctcagtgagtcaggatcactccactgcactccagcctgggtgagagtgagactccatctaaaacaaataataataaaataaaatccttcccaagctctttggcttttcccaggctggagtacaagtgtggttctcaagttcacccagatatgaaatccattatcttacttagtttcgacaaagatactcacacacataaggcagttatctatacgctttactaagatattgggaaatttttatt

SEQ ID NO: 74025 - DNA, 1103 bp, Homo sapiens
tttcagatattttcttaaaaagttactcatctatcccatcatcagaaagaaaacgaaagagaaattcttcatgcctttgaagtctttggatgtaactcagcattgccagactaatgcttattctattcccaatagataaagcagtctatatgtctttggagagggtagatattttatgttaaaaaaatagaccaacattgtgaataattgttgcactcatcaacatggatgaatttcaaaaacatattgtggaatgaaagaatctcagaggagaataaattcagaattattcaattcaaataaagtataagaacaagtaaaactaaactatttattgtttgaggttatgtacaaaggtaataaaaataatttgggggcatctgggaatcctctatttattggccagggagtcagatgcaaatatttcattttattactgattcttaaattgtgcatatacatgtatacattttcatatacttcatataatttcaaaatataataaataatagattaggcaacaaaagcaaaaacaaataaaatataccaatatcaacaaagcagaatgtgtcagaaactattaaatttcccaagtctaacactagatctgcagatgaacagaccttacctaaatgtttttgaccttgggaaaaaataaagtacaattgttactaaacagaaagtctttcttcatgctgaatatatcagctgtagaggagaaaatcagtgactcataacatactacacccagtgtctgcacaaaggatttagattaattattcttggttggttcagacatatttctctaagatcttgacaactgatattggttggttatgacccaagccattacaaagaaaccgaagaaagggactgtaatcatttctgtgaaaacagaaaagtttaaacatagccaattattattaatatttgcagaataaacaaaaataaatgtaacacattgtttaagctgataactagggatctttactcagagtgtaagaatatgcttttaaacattttatttatatttagaacaataactctggtacaagtttgcatttaggtttttagattaatacaggatcctctttcagagacta

SEQ ID NO: 74026 - DNA, 1136 bp, Homo sapiens
agatgccagcattatacctcctgtacagccttcagaaccatgagccaattaaacctcttttctttatgaattactgcattcgtcagttctcacactgctcataaagacctacctgagactaggtaatttataaagaaaaagagatttaatgaactcacaattccatatggctggggaggccccacaatgatggtggaagtcaaggaggagcaattcatatcttacacagtggcggggaagagagtatgagagccaagaaggagggttttccccttataaaaccatcagatcttgtgagacttattcactaccacaaaaacagtatgggggaaaccgcccccatgattcaattatctcccaccgggtccctcccacaacacttgagaattatgggagctacaattcaagatgagacttgggtggagacacagccaaaccgttatcaactacccagcctcaggtatttctttataacaacacaagaatggactaacacataggtataagttctttatagtcattcttcaagtacctagttgatgcttcttcttagctctcccatcagttggttagtggcaaaggaggataggtgttcagagaacttaatgagcttagaaaacatcttccaaaacttgtgtacaaattgggctgggggctggtgggcatcttgacctcccatggaggctgaggatcttgttgacatgaggagggtgtttgttgttactaactgggggtggctggtgcaggaggtgtcatgtgtgccatgtgcccatcaaagtccatccccagaagctggagagcctgggaccacaccaagggagaaggtagaaacgacatccaatgtgaggtgtcccaggaactcttgcaggttaaaagaagttgaaaagtttctagagtcacccagacctgcttttgaccaaggtaggcattccaagtgatggtatatttactgacaacaccatattcgtcattcagtggtttgaactgaccttggtgatgaacagggtggtttgggggcccctgtgacgtgcttgactgctggctttgcccacggagcagcacagtatcttgtcttaagaaagctggcctccctttctcatccctgtggctctggttatttggtacctctgtaaata

SEQ ID NO: 74027 - DNA, 1067 bp, Homo sapiens
ctggagtgcaatagtgcgatcttggctcactgcaacctccgcctcctgggttcacgtgattctcctgcctcagtctcccgaggagctgggattataggcgcgtgccactacgcctggttaattttttgtatttttagtagagatggggtttcaccgtgttagccaggatggtctcaatctcctgaccttgtgatccgcctgcctcagccttccaaagtgctgggattacaggcatgaaccactgcactgggcctcgttattacagtatctttacttgtctctttatcttatttattttaaccttatttaacatatacctatatggtgtatattatataggtgtgtatacgtaggtgtcagaataagctcttaaaaatgttaacactttaatattcctaagaactctataaggttgccctatgaaaggatctacttctaggtcccagagaaaatagtaatttgtctaattattcaataatcaatacaatcctttcttattcataaatttcacttatgactgaaataaactaatacaactatagaaataacatgtgaggaaggggatgcttgtatatcttctgtgagataagtatagttgtcttcatttccaagattgagtctcaaaatgtagacttgcccaaggccagacagtttgtagctgatggtcaaaacgccaaacttacaatctttgtatcatatgatagtatcttgaccttatatttataggtttgattatgcattgctgctgctctttctctttgctactgattggtcattttttgaacctagtgagtgggcatattgcattttggtgtgtgtttattaaatttatcctctctcctgtggtggttagtggtacacactgaccctgaactgtcctctattacaaagaagcgtttggtttgtatttcacttccttcatttgatgttcctttcatgctggctgtttctgtttaatgaaggtcattgcttgtgaacaatgttgttgttcaggaatactatcctaggaatcactgtgatgaacctgctgattgaggtattatacgaatgcctgttttgctcataga

SEQ ID NO: 74028 - DNA, 1037 bp, Homo sapiens
agagaatatttaaattaaaaaaattagagggacctaaaaacagaatgcagtgtgtggagttcggatagtgggttaaaaataaaaagaaaagagagaaaactataaatgatatttgggggctttgggaacaactggaacaatttgaatataaattgtatatcagtttatatattgaatttcttagttgtgattatggttttgtagttatttaggaaaatatttttatcttcaaagacgcatgctgaaatatttaggggtattatgctgtctgcaaccaaccttcaaatgattaagaaaggaagtatatatataatctatctatctatctatctatctatctatctatctatctatctatctagagagagatgacacagagagcaaatgtggcaaaataataattgattaatctgggtaaatgtacacagatatttactgtaatattctctgggtttgaaactttgcaaaaatgaaaagaaaaatataaaatatgtgttaatggcttacactctttccagtggatgctttagaaggtacttggtgctgacttcatctttacttttgggggcaattacaatgtttaggggagggtgcttgggaaaggcctaactcggcaagatgagtggggttctcattcttactagaaacaaatacattatgattgataatgtaaatgaatatacttacagcagcctcagctatgatcacttttttcatcctaaaactttttgtatctttaatgagattgtttgtactccacagttgactgactgtcagagtattgaacagctcatcataaaagatgtttgcttttaaaattattgaactggatttctatgtaagaatgtggaaaactgtctacttatgtaggttgattaatcagtacacttttagaaaaccttcttttctttcattttaaccattaacagcctaacaaagtgtgattctcatatgagcagctcggtatcacctgggacatttattatggtttcaaattaatcagaacattggggatggggcccagaaacctggtttta

SEQ ID NO: 74029 - DNA, 1054 bp, Homo sapiens
aagaatggtatattagttagataaaagggttaagattactaattgggctattaatagctaacaagttgattctcttgatttagagagtcttttgatacatattatttgattaagtatgatttgttatacctgtgagtaacacgggcacacttttatccccatattgcaaatgaagtccaggctaacagtaactgacatggctcatccatagaagaccatgatttcaatccagtctctgactccttactttatcacagtgctctgttgagcctatataaaaaacccttttggctctttttaaatgactttctttattttatcttattctgaataatgtgtaatagaaaaaatataagaagttttaaaagactaatttaaaaggctgttagggaaggctaagatagtttcatcttctcatgtctcagtttgtatcctaattcacatcatttaaaagtaacacttaactagattcttcccatctgacagactcaactatttgaaaacaacaaaagggtgagttatccatccctggaagtgctaaaacagagagcgggctgcttgcttattttgggattagataatctttaagatctgagtgccaagactccatcagaagctggaagcaagtgaaaaaccagtggtaaaaaacctaccaaccagccaaagaacagcaaaacccagtttctccaacaaaactcagtttctccatagttaaagtagatgttacagtgtctggctatctaattcaacttatttggttcattagagatgccttcatgtaggcttcagagtcctgcttctcttgtttgaaaaacattacaatcttattttttatgattttctagatcagtggttctcaatgtgtgactctcagaccagcagatttgggatcacctgggaaactggttaaaatgcaaatcaatcagaaactctggtaatgggacccagcaacctgattgtaacaagccctccccgtgatcctgatgcagctcaagtttgagaactgcagtgctaggtaataggtgagcggaagttgcaagttaaattcagtgga

SEQ ID NO: 74030 - DNA, 1075 bp, Homo sapiens
atatttgaatgtttggcctgtgccagagggctgcccatcatagaatatcactgaccattgccagatctgaggtggggctggagatgtccaagggtctcccatgtacactggctggtgccattggtcatgctgtctctcttcttacgggctttcaacagatgagttctgacttacaactgaaagacataagtttaataagtttatttgtgtatttactgtaggatgcaatattagttgtcaccaactcataatgcctacattataagtaaaaactatactccttgctattgaagtcttttcctcagtgatctggtctaatttactacgtcagtcctgggaccctctgctccagaacccaaagtttttttttcaggggagattggtcttatcattttcacttctaggttttgttcacacaactcactaaaagtttgagtcctgtttttcattcagagagggaagctcaggtctttcaccttttcagtgggagccacctctgcttatctcagtatactggaaatgctcccttcaattcagtagtgctgaaatcacacacacacacacacacacacacacacagacacatatatgcagacacacatatacacacagacacagactcacatgcagacacacacagatacacacacatacacacagacatacacagacacacatatagacacacacagacacacagatacacacacacacacacacacacacacacacatacaaattcttgactcctgaataggctgggaattccttcagagtagggaagagtgtcacataccaatttttgtaccccataatatctagtaaagtgtcctgataggtattaatttgaggtttgttaactgattaatgaattaattggttagtgtggataaggaagtggtaatggatataattagagaggtgataacaggaacttatcactgttgatgggcactggggagttggtaatggctgtaattagagacctttgaacaggagcatatcagaagagggatattgatgggaagatgaagccacaggagaggagtgacaagagagaaggtattgggactga

SEQ ID NO: 74031 - DNA, 1163 bp, Homo sapiens
aaacgccccgataaatgccttcttgattgattaactgtcttgaggctttttacagattctaagtcagactttttttctagtgtcaattgaataggcggatgcctaaaatgcctttattgtggagaagagcctttcattctgtaattatagaggcaaggaaaagatcataaaaatattcagatgtaacaatttagtgtgaatgcttttcagttaaaatgtaattagtcaacaaatgtaaatcactaattatgagttccttttccgttttaatgtgaaaccatccttcaagactctgccacaggaagagaccttaatactgaagctgcataaaagtgtaggggggaagtagaatggccttttatagaacaaaacaaaagagaaaatgtgaccattttgcatctgattgagcctagacagagaaaagatgggttatgatatgtggtatttgcaaaggcatcaggtctgtttggcatgatgttttgatgatagatagataaatggaggtagatagatggatggatagatagagaggtaggcagataaatttgtataaaagagtatatttgttttgttttcaagggctgccataacaaagtaccacaaactgggtggcctaaaacaacagtttattgtctatagttctggaggctagaagtccaaagtcaaggtgtcataggccatgctccctctaaaacatgtagtgagaagctttcctttactcttctagcttctggtgttttgctggcagtctttggccttctttggctgtggatgcatcactccagtctctgcctccatcacgcatagtcgtcttctcctcgtgtttgtgtccacatggcatttccctcttcctataaggacaccagttttgttgctttagggcccactccaatgatctcatcttaaattgattgcacctgcaaagactctatttccaaataaggccatattcacaagtactaagggatagggcttcctcatgtcttttgaggggacacaatttaaccccataatgaaagagttatgctatcattcataaaaatcctgtatataagtttggggtacaacctcatagttatagcttaggtttcctttggactgcttcccttcctgctgcaggttttccttaagttttccagtcaacagcagcaaacaactcactt

SEQ ID NO: 74032 - DNA, 1032 bp, Homo sapiens
ttctttgttcttagatctccaccttctgtgcttcattaactccaaaaataaaagaataaaaagggagaaaaatcccttactattgctgaaagtttcagcaaaatgctctcttgtctttctccatgcttatcctcaggtatgttattcacagtgtctcacacactggatgccttacaaatattcttattaataataacccagagagttacctgtttctacaccagcaatgatatttactagttacctatgacactgatcttcggggttctttctcctggggcaaatgcatgctcattatttaggtctgtcaatctgctttctttgccatagatcccagtggaggctgaatgagagactggttgtgatacagagatcattagctttcaaatctgcctccttgaaaccaaatagaatgtattttctgctcatatgacaataattttttcatctctttaggttcacagttcttgttttatttttcttttttttttttttccgtaaagcctagcttagaggtagccttgtctgtcctatagggactaactttttatctggtctcctctgcagtgttgttagaagcccataatgatcaaacgacttgattaaggtcatttcctgggctgaggcagctgaatctttctaggccctgaccagctttcaaaatgactttccatcaattccatccagcaattgtccttcgtcacctcaagttcagtcaaacattaaatataaagaagtggataagatagaaatctacggaagggtgcaaaactaaaaaggcagattaatctgcatgagtatgtttcacttttagttgttcctagcagagcctaggaaatattgttaaatggaaaaagttttaaaggtatgcccatgcctttaagtgattaatttttctgacttctttgatgcatccccacaaatgtgcattttcttcctaatgttacttttagcatgtcatacactaaaagtagttcttaatccaccagctgatttgatagtaagtggtgtttattgagtacttaccttgtg

SEQ ID NO: 74033 - DNA, 1133 bp, Homo sapiens
tgtcctcaaaatactcttagtaggtaagaatgagacagtctcaggttcctcattttacagatgaaaacatgaaacaggatgctggaatgagtactgattttcaaaaacagaatttctgattccaggaatatttcctgattttaaaatgggaaaagtattttcaccatgtactatatacaagtggggaaacttcccatgaaggctgcctctgcaagttgcagctgccattaattcatctcttaaataggataggaaaccatcttttgtagctatcgcttattttcctattgaatgctgcctttccatttagatggtgattactgtttcagtgctcaatgcaatcagtgaatggagagagagatccatgttatttctgctcctgtgaaactgattacattggtatagtcctggataagcacttataaggtacgtacaaatatcattatgctgccatacaggttatccatatgctggcattatggttttcagatgacttccacctgtagcagtgtgtaactgaaaaccaatcactcctctcctgagaacatcacaattcctgctgctgaaatggaaattgacaggagttagatacagctgtacctgatcgtcaagggataaattattttgtgtaattgttagagccttgctaagacctaatggaatgaacatgttgttttccacacccgtgggtatggatagttcttacaaatattgtgtgcttggatttaaagtagtgtgagactgtcagtctgttgacaatgagaaaaattaatttgaactgctgatgaggaagggaaacatacacaatgaattaaatttaatagactgaaaaaaattggtttcttcttactatttccgtgtgggaatatgtcagacttcatttaactcaaataactacagatatgaaggacagccacactgcagcctctgttggagaattctgctggcaatttggtgcatccactatagacactgttttggtcaaacttaccttttaatgtgaaatggaatgatgtatgtcctgagcagaaaacagagtgtttggctgtcaaggacaaatcagacattgtttcttttcactatcctttgtggttttgccttttcagtaatgaacaatggagtaaggccagacc

SEQ ID NO: 74034 - DNA, 1091 bp, Homo sapiens
tcatttatgatttttgcttatttaacatttagatgattttttaaatattagggctaaatcacattgtatttatctgcatttgtaatggctttcttctatcaaattattttcttagcataaatttagataggatcacccttatcttttattatacaagagcaaactgtctattttaaacaatactcatttctcctctccattattctagaggttgctggtaataaggccaagtgtgtccaaattttatttgtctcaatacctcaaggaataacatgaatccaagaacatggagggtaacagaccagaaattagacttggggctgatcttcaagttctatgattagattggagatagtctctgatgagcactgaatgatgctctgaaaatgaggcatttataggcagaaaaagagtgaccaaaatcattgctacttagaatatggtcagtggaccaactgcataggatttcattaagaaaatatgatggacttgtttttgtttgttttgcaaatgaagtttgggagtaaggacttggagcactgcccatctgacttcctcttttcagctcccaaagtacctcttaagattcctagggattaatggaacataatttgaaatcccatgatctggatagtgaatgcagtcactcagctcacatgtagtgcctaccttctctgtaccagatttgcagtaggttctggaaagataagataaataaccccttacttgaaagttgacccaaatagaagcctcagaacttcatcttaattcttcctttacacagatattctttaactgatcagtttcttttttctttcccttttttttttttttggaaacaggtactcactttgtcgcccaggcttgagtgtggtagatcaatcatagctcactacagcctggacctcctgggctcaagtgatcctcccacctcaaactgagattataggcatgagccaccatgtctggcctaactcatcagtttctaaaaccattctttctacttctgatacgtctttgaaatctattccctccattctatttccagcaacagtttggtctttgtcatcaatcacttggactactactgg

SEQ ID NO: 74035 - DNA, 1086 bp, Homo sapiens
ttgtggactttttttttttttgccaattcacttgtccttacttcatactccattcctcccgaatattctgaatcaataaatctttaatgaactagttcatctaatgcttgaaacaacttttaactctaaagcctaaactgttggtgctgcctgggtctctgcctgcaatgagctattgcattcaagacacaagggcaatattctaacacagtgactgttcaacttccaagatgcatattggaaaagtgtcccagtgaactataccttatccattctaattccaagaagcaatgataggcacattgtgtaacactgaataatccccaaatcattcatgtacgtcagacttcagagtatggtgtttgcatttatatttcatatgatagttatcctattcaatgaacaattcattttcagtgttataatgaatcctcaccctaactcaaggacatggtgcagagaaaagaacttagactaagtggattctaatcccatttctactaacgactagatgtgtaacattgagcaagctgcctcacctctccggacctacttggctggtagacattaagttcaggttaaaaattagaatgtcttagagttcttttcttatttctatttcctgtgcgatatctccctgtctactcttaatgaaaatagtgttttatgttcctgactaaagtaccttttatttttttcttttaacttttattttaggtaaagaggtacatatgcctttttatgctctctcaaaacttttgggcctatgggcctgcttttctcaggagcccacagccagatgcatgactccatgaagcagaaagcggaggcagagcacgagaggtcctgtccctgcaagagcatctgggccaagagaaaagatacaggaagaaggaatggaattggaaggaagaagtctcatttcagaaataaaatagctcccctcctctgttgtagctgttcctctggcaatacaaactttctgatttcagggtctgcagaattctagaactcgagcacccaatcaggataggaaaaatacatcctccactggagtccaagttggcagcaggctgttgtgagagc

SEQ ID NO: 74036 - DNA, 1946 bp, Homo sapiens
tggtgagataagtacccaacaacacctacagaatgtatgcatgttagctttcaaaaagcaaaacaaggtaatgaacaatgttgatacaaaagcaattttagaaagtaagtcaaaataatctggattgagaaagaggaaatatggattcatgtactcatggctactggaggtgtaggaagaaagaccaagccaaggggagcagggaaaaaaaggagcatgttgaggatatagacttcactgagagtttgtactgaagtggggaacaggaaagttctggagatctccagtgctggctgggaaggcatttgagtggaatccaattctagtcataataccagattccagccaagacacctaagcaagtgaggacttgtacaatctgtctaaagagaacattttctattcaactccagctgttgcagccatgagcaaatgcagatctggtgtctagatcttcagatttttcaaggcatccagacacaaagattttaaagaaaatgctcttcattttaaacattgactcctttttaaaaaccactgcaggagccaaattaaagatgtctgctgtcatgatacagcctaagaaggacaggtttgcaattctgcacaatcttgagaaccaccagaagatttaaacgtgagaatgacataatgctaacagggaattagagagaggatcttggtaatcatgtgagaaattagcaggaatcagatctacacaaaagtggatctgtggaaactagatctgagggtctaatttaaaagaaatttccaaagaagtgacagaatttgcaaagtttattagttcacatatgaaaataaaattcatggaaagaagcctatcccaagatcttgtacttgagattccaggatgatggggacagaaaatggaaagttgaggacttacgggacaatgagaaccatttcttaaatatgttccagttttcatggagatactggagggatatcctgaagcaagttggagattttgaactaatgagtaggagatgtaaatttcagaattgattaggtacttatctgatctcctgtataaataatatatatttgtacatatttcctctcctacatatagaaatcatttatctttcatttttgaacttgggcaatgtagcagatcggctcattttccaaatatgttccatcctctatttacatatgcatatatttgtccattcatgcatgcatagtgttgccagattttgtagataaaatgcaggaagcccagttaaattttgattttagataaactacaaataatttttttgtataagtatgttccaaatactgcatgggatattttataccaaaaattattcgttgttcatctgaaatcaaaatttaactaggattctatgttttatctggccactccatgcatgaacgcttccaggtcatcatcctatttctctagaaccccagccatagtcttcttacttgcccctttgttttcacctttgcccctctaactgccattttgcatccaacaggcagggtgatttttaaaactctatttatgtcatttccttgcttaaaacgttttaatggcttcaatttctttttcttttctttttttttttttttttttttttttttgagacggagtcttgctctgtcacccaggctggtgtgcaatggtgccatctcggctcactgcaacctccacctcccaagttcgagcaattctcctgcttcagcctcctgaatagctgagattacgggtgcgtgccaccacacctgactagcttttgtatttttagtagaggcagggtttcaccatgttgatcaggctggactcaagctcctgacctcatgatccgcccacctcgacctcccaaagtgccgcgattacagatgtgagcacccgcccaatggcttcactttctactaagaataaaattccaacatcttaccatgactttgatcat

SEQ ID NO: 74037 - DNA, 1027 bp, Homo sapiens
atatacctaaaagtggaattgctgggccatagggtatgtgtatgtttagttgcaatagattctgctgaacagttttccagaatgattgattcagttggcttgcatgagaagtaaattgctctatatagaagagaatatttttaatgcaataatttatacgatcatgttatgatgaaaacaagaaatgtgttggcttaagagagactgggcctagtttgtaataatttaatgtatgcttggcatacttcacagtttataacaaagctgatcactttattttgtgaaattttacccatgtgtctacttgaacctacttcagatcggatcatggtggcaaggatctactgaggctaggaaatttaaattatctacagaatactggggatataggaataacttggtctgtaagtgtatagtgctcctttaactaaatcataaaaatcattgctgttttatatgaaaagtttatgaggtcacatgaatgcttgcttactgtgcatatggtaagagctgtgcatttcaagttaaatataggagcagttctggctgtaaagaagtagtttgagaaatcaagagaactataaacggccatctgctcttttctccatttttatttgctgaattaacccagtgcaatattttaatgaataatgggttggtattccatctgctcattaattttttcacactgtagaataatccatcatttttactgagtggaaacaattttctactttgtaaaaatattttttaaaatagagtcagtgggtataattcaaatttccattaatttcaagtgtattttggaaatggaggtgctgagaatatctttagggtcctagtgctagaaaaagaatttcagttctttgagatgacaatgcatattggttgatgtatatctttattttatcagatacatttgttttggcttattttgaaataaccagaaaagaacctttctctgtatgatcaaaggttgcagagatgtaaatggcatcaatgataatataacactttgttaagagta

SEQ ID NO: 74038 - DNA, 1047 bp, Homo sapiens
catttttctatgacttcttttcagttaattttgttctggaatgtagagttatctgacttttttctggtttaatgatagtagtgcttgcatttttagtatttatcaagtgctgactggatctttttggttaaaaagttggttagggaaattactatcaagctcactcaccaccatagtaaccaaattttaataccttctggggatacaggcatttatataatctaactctgtggcactgaggtgcagtgtatgtagtgtatttatgattgaacagaaagtttcaaacagcagcctgtgaaattggattttagatgtaatgtaccataaataagtgctataaagattgcctttaatgctataaatcagattttattggtttcagctatctcattctggttattgtattacccacaaaatcagaggaaatcaaagagctggaatattttttattttaatatcccatattctacagtaatggcacatgcacccttacagcttcctttttgggtaggttggacaaggttgacagttggcaggccccagcaacatatcagtggcagtattggtgtaaacaatgaaactttggggcttggaacagtttaagatttcctgtctgtgaaacctacaaggtaggtgaattggcagatcccttccccgtctgagaagctggttgtcatgttcttcatgctaagctgacacctgtgagattggcaggtgatgtatgctttgcatcttctggaaagtttatagactttggtgatgaggctatctatccattggggatggggatgcccatgcatgacttacctgagtgatttaaagcacccaaaactattgctataaaagaaagttgtctgcttaaacaatctcccaatatttgatttacaaccaatgcttctgcacccctccctaacactttgatggttttctattaagtatggtttagtcaagaaaattgactgttttttaaaaatgcttgggaaagcttacaaatggactgttagagcccaagaggctacggtaatctaaaaatgaactagttaggtc

SEQ ID NO: 74039 - DNA, 1031 bp, Homo sapiens
gagtaaaaaaagcagtagtcactgataaaggggatttttatgacactttttagctgtggtaactacttgggagaaatatcatttcctgttaaattgtcagctggctttatttgcatctattattccagtttgttgaatggccaggtgtatttttttactttctcagtctgactaatttttacttttttactctccatatcacttagaacagttagtttgtaaagaaaaatacttgacataaatgggattaaatggttaagaatatgtgtgggctaacaacagaaagtcaaggaatagaaagggtttcaggcaagatttgatcaaacagcttttaaaacaattactataaaatatcttatttctgtctcttcccatggctttctgtactatctacttttcccacatcttaaatatggcttcttttgaaagtcacaatgattaagtttttgcctttttgttgttttcatcctaatgctattctttcattaattcacatttttctcagtcctacttaataattttcttaagaaaatatcaaccttttagttctttcattctgtcttcatatggttgttatttagctgtttaatgtgtctcttgtattttatattttaattgctctatttctagacattccaggtggttattttcaagtctgcctggctttataatatcactcatgctttttacacaatttcaatctccctttttatgtcctcaatcattttaagtatgtgtagtttttattctacatctcatagttctattatctgaaatccttaggatctattattttttatttatctgctgactctcacatagtgaacttttttcattttatttggtaattttgcatcataaacttattttctttttacttaggtgtaagcattagggtggaggtacaggtggaaggcaggaatcccaggagtattaccagccaagaatcagggtaaagattcagaccatgagtctatgtgacagcatatctgtaagtatatattctcgaggaaacgttgatttacccagac

SEQ ID NO: 74040 - DNA, 1033 bp, Homo sapiens
agttcatatgctgagcactttccactttcttttttttttttttattttattttaacttccaggatacatgtacaggatgtgcaggtttgttacctaggtaaacgtgtgccatggtggtttgctgtacctatcaacccatcacctaggtattaagcactgcatgcattagctatttatcctgatgcactccctccctctcccatgcccccacaacaggccccagtctgtgttgttcccctccctgtgtccatgtgttctcattgttcagctcccacttatgagtgagaccatgcggtgtttggttttctgttcctgtgttagtttgctgaggataatgacttccagctccatccatgtccctgcaaaggacataatctcattcctttttatggctgcatagtacttcctagtgtatatgtaccatattttctttatccagtctatcattgatgagcatttgggttgattccatgtctttgctatagtgaatcagagcactttctactatctatattgatctcagacctctctgcagacccctatatttgatctcttatttaatattgacacttggacatcttgagctcaaaatgtgatgatctggactcctgattttccccacagatttgccccacccacaatcttttctatctcactttatggcaattccatctataatagtctgctctcacagtgctaataaagacataactgagactgggtaatttatcaaggaaagagattcagttgactcacagttcaccatggcttaggaggtctcaggaaacctacaatcatggcagaaggggaagcaaacatgttcttcttaacatggtggcagcaaggagaagtacagagtgaagagtggggaagcccattataaaaccatcagatctcgtgaaaactaactcactatcatgagaataccatgattcaattatctccacctggtccctcccatgacacatggggtttatgggaactacaattcaagatgatatttgggtagggacacagccagaccatatcacca

SEQ ID NO: 74041 - DNA, 1021 bp, Homo sapiens
ttctgtcacaaatcaaaagttcagatctagaagttattagatagtaaactcatgttccaagagatatgacagaaatccattgttggaactaattctgaccacatttcaaacttctgctcactctgaaagtagaataaaggccaggaaacaaaagagatgatgaaaacaaaatatgttgatgtggaagaaatgtgtttagggccaaggctttgggctcaaggtcagggtcactgtgaacttttctgcctctggacaatgtgcggctctgagctcttctgtagtagaatggaggaaggagtcgcaaaaacgatggcataggaatcctggtggaatccttcaatgaattggctattctgagaaaccaaggctgatgctcttgagctccaagctttaggcaagttctaaaccttacatttcatagcaaactgactggattgacggaattatatacaaaataatcttatgcttgctctaaagccatgtttggaatgtgtcacggccagatgcagtttgtcaaaacctgaatgtgttatggccagatggattactctggcttttcttttgtgtgtgtgtgtgtgtgtgtgtgtgtgtgtgtgtgtgtgtgtgagagagagagagagagagagagagaaagaatgagaatttacatgtgcacatgtgtcttaccctgccacacctgggatgtgcctcaaatggcaaagcaggaaataatcaaaggtagaacccaaccatccctaatatttattcagcaccaacagagatgtattctttcctaatttttgtttattgcaaagcaaaattatcaaaataatgaggagaaattttaaaaagaaaaaagatattgtcttaccaacctagaactcattcacttttacgatgctttaaggccaggcacagtggctcacacctataatctcagcactttaggagactgcagtgggaagatcacttgagcccaagagtttgagaccagcctgggcaatatagggaggtggcacatacctatggtcctagctacttg

SEQ ID NO: 74042 - DNA, 1121 bp, Homo sapiens
acaatgtgactaacttagtcactgtggaattatacaccaatacacaagcacatatgtgtacatacacccacatatacacatgcaccccacccttcaggtttaagaaaaggaaggtcatctatgtctcaatcaaagctctcctaccttgttctcattaccactggtttggaaaagtgtgtgatattgaagttatgaaaaaatggctttggtatgtatgtgttgtgtagggtagtgagaattgcaaaagcataaaaaatcttcctcatttgtaacctgttatacatcttgtacacagcttccatggtaatttcataaactcttgaattgcaaccctgaaataaaactggtttgtggatgctgtggcaaatacagaatttgacaacatttctgttcattggaggcctgagcattgtttggtgataaatagtagctgatgccatgtggaagggataaggatgaagaaattagactggggactgaagaatgcggactgtggtgcaaagcctgcatagtacatatgtagtccaaatgtgcatcagcccagaaattaattattaagtgggtaagaaattgtactcagagctgaaagtgaaaaagacaggtgtcgagacaactctgtcaaatagatcctcctcaatcaagcctagctaagaacctgggtctttggaaggagctaatattacaatcaggtaacttccttgttctgcctcctttggaagccgttatacttttgctctcccatgtaagctagaaatgggtcaggaactggaaagaaaagcatccctaaggtcataccaccttgttttcttttctgtcttctcattcaggcagacacagtagagtcttaagactcaagctcttttcaagggcctgaaaagaagaatgctttcattatttttccgatcactagctccaacctcctcctctctttgtttaccttgatgatgcttggaaggtaggtcacacttgcttagcatgcagacaccacttttaactgcctttgaagcaacagattaaggaaaaaggaaatggatattatatatgcaaaagggagaatgcttagcgtcattccctcagctagttgaccgtgcagaaaagtaattgccgacagtgatttgggg

SEQ ID NO: 74043 - DNA, 1025 bp, Homo sapiens
cttttttgacatggaaaatgccaaagacactggtcaagtttactctcagctccctacctccagtgagggggcctcttattaggaatgaaatatccaagagatgggcggtgctgcaggggagaccaaaactcagaggaggcattcaaacacttctagcaggttgtctactccatccaactcaaaacctattcaatatgaaggccgagggaatgtgctcacaactccctattaagggaaatcaatataaacccgcccccaccaaccaaaaaaaaaaaaagaaagaaaactctccctttttaatgtcttcttccccaggctcctggtactttgtcagcaacatactgctttcattcttaaaggtttcattggctgttaaatgagtccctttgcatactcactggagagaggaaatgctttaagttgtcctaagataacatctgcacacagagagtttatctgattccttatcaaccatgatctctatctgaggtcctgtatagtgggatcatttagagatgggggttagggagagtaggagtaactctagagaaaattgtggctcctaaaggaggcagatctttccaaggtggaaaggtaatgaattaaatatatgacatgtaatactgaaaaaatagaaaaatgactaagatacagtctctgtcctctagaactagggcagcctggaaacatatggactataattattttagctatttaaaagaaatgaatgaagaggatcttgagacaggaccagagcattggaatggttgtagggactgaaagctgagttggaaggatcagatcaaagagaaagctgggttggacttacacaagaataccctgatctgatcgcagctgtgactccaaggttttcctttcccatagttgctgtgaccccattggtcaccagagcaactgcatgtcttcaggctgggtattagggctggctgggtctgatgattctacccattttgtgccatctgaggagcatgcgagggttctttctccaaggcactttcggcctt

SEQ ID NO: 74044 - DNA, 1044 bp, Homo sapiens
ttttgttggctttttccccctaaaaatggcagcaaaaatgaataaaattgtgaagctctgcacagtaatacaatgttaccatgaagaaacatgtagagttgctaatcccatgcatttagttgtttaattgattgtttttatattttttaatgcaagaagagtgacatcaacttgaagaccccattagatactaacttcatacaggaacattttttgcttcttttgatttttagggttgaccttactttttcagagccacacatttaataataatgcattaatagtaatgcatttaactgtagtgaacacaaatgttaagtgtatggtttcagcggtaaacctaagatacaacccagtttctatctagacatcttccgttagcctttgctctgactggtttaagagagatcctactttcaacttaaacagaataaggacatcaacttgcattccctgtgctcttaattagtgtttcctacaaaacaataaggtaaagcaaataaacagaaaaaaagcacaaggggcgtgaaattcaattcctggaagaggaaggttgacggtcaataagctcatgagggcatgttcaacctcccttataaaagagagaaaggaagattaaagaaacaatatgatgccatttctcacctgcttagcagatcagccaaaaattagaagtctgactacctgagactgggtaaggacatggtgttatgggaaccccactcgctgcttgtgaggttacacatctatatattttgaaggaaaatttggcatcatctagaaaagctgtacattttttttattgtgaaatatttttagtatacaaaaaaggtagagaaaatataataaacctctatgtaccttccatctagcatgaaaaatatacactgaaaatgctctgtttatctttcctcattccccttttcctcatctcaagtgaaaccactgtcttgaacttggcatttgtcatttttcatgcttatttcactacttatgtatgtatccatacaccacatttttgacctttacataaatggtattata

SEQ ID NO: 74045 - DNA, 1039 bp, Homo sapiens
actaagctgaaaagattgaatcaggcagttaggaaatcactggtgacataaaaaccatttcagtggtggtaggggccaaagcttgtttgtgcaatgggttgaacagtaaaataggaagttacaaattgctggaaatgatggaaagaaagaaataatgatgtagcttaaagggtgacatacttaaaagaaggggttttaaatttattccttctttaggatagaggaaacctaaggtttagtgtagagtgagggaaataaaaaagtcagtggaaagattgaagagagatgattgaaggacaatggacataaaatactggtctcgaactcctgacctccagcgatctgcccgccttggcttcccaaagtgctgggatcacaggggtgaaccaccatgcctggctaagtactgatatttttaacagtcactaggttatcataatatgcagctgaaggtgaaaaagattagaatgaattttgattctcaaacttgatggcacattgtaaatacttcaaaatttttaaataataatgataccaaatgtgaatgcatctcaaaagcattatgtttagcaaaagaagtcagcagcaaaggaaaccacttccatgattccatcctgattccattaaaatcaggcaaaaagtaatctaagaggttaaatactagaatagtagttactttttggaggagagggaggttgaccagaaagggcaagaggaaacattctaggttgatataagtgtcctatatcttgattacagcattggttactcagatgaatacaagtgtcaaaactcgttgaactatatgcttagtatctgtgcatttactgtatgtaattataccttgattaaaaaataactccaaaaaacatttgactcaattagtatgagaagtgggttgtgtattgggatatctatgagcctcccaggttgttgtaacataaaggaaccactttatggtttgagaaccaccgagctcagtcatctgctgacattgagatgaggttaaagaaggaaccacgagaaaactgataaagac

SEQ ID NO: 74046 - DNA, 1034 bp, Homo sapiens
gttgaattatttttcctttaaaaaacatatacatatgctttgtcagatagtccaaggacttcagtttcatgtacaacctggatttctttggaatctgcggagtttcacattttcccaagtgttcacggtgaagctcctggcttcgagctggctgtcttcaagggtgttttcttgagctacccctctctctgctctgccaattatgtgccactttgtcttggtgctatgattgctttcttctgagagggaaattcctctttcatcagtatggatgcactgtttttacacactgcaagtgctgtgttactgtgtcagtcatcctattagggccagtttcagacgagtagggctgacgagctggctggggattggctggccccggctgggagggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtaggagaatcgccccccttttttgaatgtttaaagagtttgctgcagtatgctgcattccatgtgtgctgcttacgggagccagggaaactggattccactaattcaattgtaatacttgcgggggaccctggagttttacgtaacattttgatttgagaaaaagaaatggcaaagcttgaatctatgccgcctgtttggggtgaggcaagaaatcgagtttttatgcaaagaatcgattcatttattatattattttttaaaaaccatttgaattctttggagcaatcttattttcttgctgtgaaaaattgttatattgccatagctagttcccaaatagataaagtttacatggatcctattatttgaaaacagacttgcaattaaggattaaaaaaa

SEQ ID NO: 74047 - DNA, 1050 bp, Homo sapiens
acgatcagcttagaaaacagaaaaaccagtgatgccaatggcataaacacacaggaggatgggggaagacaataaaattggctctgatcattaagagtttgaagtcggaatgtcctctgagaagtatgggtctaggcttctgtagcgtgtggagcccaatgtatatttggaattcatccacagaagactgatgtttgaaatcatagaggaattgagatagcaaagaaaacaagtgcaatctagaaaatggtagacgacacaggcttgggtagatgacacaggcttgggaaagccttacattgaagggaatttcctaggcacacttccactggcacaaaaatccaaagtgaagagcatttcatccaaggtgagggcaccttggaacaggtgtatgggcctcataacctctctcattgcctttggatctgtgacaaaggatcatgctattcactgtgtcatagattaaggcttcctgaaaccaggtgagaatgggaaatggtggcagatcctaaagaaagttcaataaagatgaagaccgggcccagtcctatgaggtgcagaagccaagacaacgcctctgacctttgggaaagtccctttttggaagagtgctgcgtgggctgctgaactgcaaggcaccagggaagtggaaagtgaaaacgattaggtagggagtgggagacaggtagcacagccaaaggggagatggcggtgagcagagaagaggcagggataaagtaagcaagtttaggttggagggcaaggtgtgctgggctgcctggtggcacctggggcaacttttggctcattggaggctgcctgctggggattcatgagctgaggccactgggaaaaaatggtttttgaaaattgataggcttaagtatgattctgctctaccaggaaaggtgaaaaacattagataaatgtgaaggaaggtggtgaggtgaggtctaaaggcgtctccaaggaggcttccagaggcctttgccttgaaatgaattctgctctactcaaaataaccgtttcggagagggctcaagatgctac

SEQ ID NO: 74048 - DNA, 1143 bp, Homo sapiens
aaggttctttctgcaagggtggtaggcatttcactatcttaattgatttagaccctaagtaaagaaattgaatttactaaaggtagccatgtacaatgcatttttatttctactaagttggaggaataaaattatttaacaactcttctttctcctgaatttgatatttaggcaggaggaagggctgttacattggattgagtccatcgaaatggtattttaatatttcattttaattttgcttgtaattattattgcactttttgaaagaaaatacttagttccttccactgaaacaaatctgaaattcagagccaagtccatgcagcagcacaattttccattattttgaagttaagtaacagatgatgagtaggacaaaggaagggaactagtgcctttaaagcacctactatgtttcaggcactttgatttactttcagaatgtttttctccctaatttaatgctcccagctacctaagagatatatggtattactacattttatagataagaaatgtgaggtttagaaagggactgtttgttcattgtggaacttaaattggaactagcctccaaagttggctgaaatttctgtttggaattcagaatttgaatgcataccacttgtcccaacttataaacaggactcttgtagtgaagttttttggattgactaatataaatttaagaactttagcatttttgaaagccgttaataactgttggctactgttatttcacacacacacacacacacacacacacacacacacctatttatgtgggtgaatccctattgaacttcaaacatttattgcaaaccactttgcctttttatttcaaaaagaaaatgtgaatgactactccttatgttagaaaattatttaaaacctaaaaaagtgaaaattttacatgaggataaagactgttaacgtatacaataaagtcagcagtgcgtgtaagaaatctgaatatcgtcctgacattttatatgtgtgtaaattgaacttctaatccagagagaagtctgcttttagttaactactgcgaataaacttctgtttctaaaattctcagtctctgtctttgggtaggaggaggcagcgggatttgtggcagagagatccccttccacccca

SEQ ID NO: 74049 - DNA, 1135 bp, Homo sapiens
aaactagtaattgaaattctttcttattgtgcaggctgacagtctcgaaaccaattctttgagtacctattgtctatctctgaaatttaatgagataatgcatgctagaaacactttattcaccatacacaattctatgtaaatgccagctgataatattaaagataataattgtattaaaaattttaactaacacatgaagagagcttcgagattgtctagtatgtttctttacaaagttgattgattaaaaactgcaatatgttttatttgtttccttattttcaagaatatttggaagaaaaagcacttgaagcctggctttatggtaataatataaaaaccaacagggcactgggtttttttcctttaaaatggtatgccaccctgatttttaaaattccaagttaccctttgattccccttaaaagtgagataggagaagagatatgctgtaagttctaggacaggagatggctaaacatgaaccccgacataggtcttctttgtgctcttagggttggcttcatttctctcatacctgtttctcttgtttattgattgaagttaatgatataacttggagcattagaatattccaatgtaaaatgtcatggttattgaggcagtggtgttacttataaaaaaattgtttagaactctaatattttctttagtgcgttcattaaacagctaaaagaaagcagaatggttaattagcaatatcatttattccatattttaaatcacattctagttcattcatcattttacttcaaatagcttcataagcagttaatatttgaatctgcagccaattaattgctctacctgtgaattttaccccaaaatataggtttacccaaatctagaaaacatttactactcaacactttctccccaattaccttttcagtctcaaagcgtatacgacaaacccttcatcacatgttctaaacttttcatcagaaaaccttgttctggtttagtgttttaatgctacattagaaatgatatttcttggcaaatactcctttccatatttattatctggatttagcatgtaattatttattatttgcatagcaattcacttttcattatatatacgtatgtgtgtgtatacacacacata

SEQ ID NO: 74050 - DNA, 1019 bp, Homo sapiens
aacatgtgctatgggtctccaaagggacaaagccctagcgtaatatctctaaccatttaaagcacaaaaagaaagaaatcttgtgtttatgattactgtaaagaataataaaatcaagataactttttttttagaatcctctctttcttctaaaatcctataaaatcagataaagaaaaggtgggacaaaatcctaaatgtaatgttcaaactgtcatatgtggtgccttaatggttaattttctattagttatgttttattattagaagcaataatgagcagttataatttaacatttttatgccaagtctatggaaaatgttatgcaaattttactattattagaaagctacaatttgcaagccattgtcactccattcttttatttaatctcttttcttaaaagtggccacccccaaccccactcattgtgagttgaaattattcaaattaatgtcaagttgtttatatattaaactatattttaccttgatacttagtttttaaaaacacataatttctgctacacaatttggacagcagactgtgatatatgatatgcctactatatcgtcgtaatgggcaaggttcattataacaaaaatgtgtccagacttagtgagataatgtgaattccctatttctcaacttgcttgcattttaagatgttcagtctggaaagtgtttccactgtttgtgaatgattgtccctagatggtggtgacatttgacctattgttcagttttgaagatggaaatgacatgttcgcaagcataaaagcccagggggcatttttagaatttttgtcttagaatgtttttagttttattttattttctgatgataaaatacttgcttcctcaaggaaaaatatataacatttaatatcttctggtaaacactggagcctgacagtctccattgctagaacacatggtttttaagagctgcttaatgtctgatgaaatgaagatatcattatttattttagcatttcctgttgcttaacatttacat

SEQ ID NO: 74051 - DNA, 1027 bp, Homo sapiens
cctttgcatatctgagaaggtttttcattttcatgttggaaataaaatgcaattgggtgtactgttttgagtattaggtttcccccctcaaagttctatagacatatttctattggcttttgctgttttatgctgcaaaagagaagttggaagccaattgatttgtttgtagttaacttttttgggcaggaggctaagtaactttagaaatcttcctttgtctttgtgattgctacgaggttccagcttggcaaagctttttgctggcttagcccaggacacggaagtctggttggttcttctttctcagctttttttggaactttccaagattctctaagctacagcttttaattattgcttctatttcatttgttctttatttcttttttctctccaggaacaccaataattcttaggttgaatctttgttttctgacttccatatctgccaatagttctctgagcagtttaatctcttttccatgtttctctatattgtgtaaaaaaaagtttcaggtatattctccagctcattggttctattttatttgctgacagtgcactttactgcatcaaattcaggttttaattctgctgttgagatgttggtttcctctcattcctttcttatgtcaaccaactgccacttttatttcgggctgtctcttggtcccttttcagctcagtctgccttttccccatctttactgttctgttgtataagttctttaacaggcattgagcttactcaagaatgaagttcttgaacttcattaaaaacataaaccaaaatgctctcttcaattttttttttaatgataaaccttgagctccctttctgaccctccttttagtatgcagaatctttccatcagtcattttggatttttgttgcatgttgagctattcatttgtttgctttttattcattcaatgatcttgaaagaaaagaagtctgtccaggcttggcttgtttttatttaagacagagctgagaaatcattttagacagcctcacttcctg

SEQ ID NO: 74052 - DNA, 1049 bp, Homo sapiens
gtctgactcagaaataggcttgttttgcaaagatcctttaatcagctccctaggaggccgatgtctggcaggcagctaaaatatcatagatgacccgaaagtaaactggaggaactgtgtgctgcagaattatttcccttaaggtggtctgaaattttgatcaatctcagtctcaacattggacatgactgatgtttttcccttaaaaaatgtacaaactatctagaaagcaatggcacggaggagacacctggggtccacagccccagcttgtctgagaggcgtggaatggagggaggtcgcctccttgcagagtgaaaagccaggctttccagactcaccctgcataacttagcagctgcaaaagaatgtgagcggcaagttcttttatacagtcaaaagtgaatgctttctgaaaatctaacacttagaagagttcttaaatacattttgaaaaatgaagtgtcatgtaagtaaagaccctaaaaatagcttgggattattttgtacagttgaacggcacatcctttggcatttcaggaaatactacagaacctcgtttctttcttctcgaacttcagtcttgccttttctttaaagatgagtcaagcagtgaacctggatattccttaaatcacacgccttctggagaggatggggcactacaaagcagctccttctgatggctgagctgctggtcatcaggccactagtccctttaaagtggtcctctctcaggcaagtgtccgtaaaacaaggccgcacccaccccctctagaaggctatgggtcattgtctttcctaattctcacagaaggaagtcttagctgaaacaaatctctcaggtgttttctgtgagtctggctgttttgttgttttgtttttattgatcagaaacagccgctgggggcagcccggccagcactcttacaattgtttctagggaaatcagtgaactcaaaagcctgcaggtaactccaggtggacatctttgttcttttcagcaagcagcaggatgcctggcacacagaaggcaaggaatgcttccg

SEQ ID NO: 74053 - DNA, 1118 bp, Homo sapiens
tctttcgctgtgcagaagctctttagtttaattagatcccatttatcaattttggcttttgttgcaattgcttttggtcatgaagtctttctgcatgcctatgtcctgaatggtattgcctaggttttcttctagggttttttatggtttgggttttaaatttaagtctttaatccatcttgagttaatttttgtataaggtgtaaggcaggccatccctgcttttaaaagcaagtttatcttaaagacaaatagggtgtgatctcacttagaggttctaagtgttctcacaactaaaaaatgctaagtatgcatatgttaattagctcaatttagctattctacaatgcatacgtatttcaaaatatcatttgtatataataatcctatacagtttttgtcaattcaaataaatacttaattttaagcaagtgtatcttggtagagtctgatcatctgaattctggtgggattttcatagtaagttgaaatggaaattctcccagggggaaaaaatatatatttcttccagggggaatgaaaaaggcttcttacctataagtatgaataaaaatgtacagcattcactgaactgcattggaagcatagctcctggagaacttttaggaacatctgagtaattattcttgccatctatgcaacagtacctatgtttacctctttcttttcctccatgggagcccttgggagagactctgctgcctttgaggttgagcatctaccttgggtcctggtactgaggacttggggactctacgtaatatttttcaaacactaagtgtgttcagcccatcatttgaaatatccttgtcattggtgcctcatctcccttgatgcaggcagaaatatgtccttgtcctttgctttcctcatcctttgttctccatgggagctagaggtgcaggttgaggtaataaagatacaagtccaggctggtctatgaaacccaacccatattaaatttggttattaaactcatcttcttaagctccctagcttaggctagctgatattagcttctgtgaatgcagcgttgccaaacagacatgcaggagcctgcctggacccctcaaatattttataattgaagtttgcta

SEQ ID NO: 74054 - DNA, 2188 bp, Homo sapiens
actgttttggcgattaagcacattagatgggattgtttcagaaggcctaattattgtgtctgccacactcatctgtttgagtcattcctaacttttggactgctgcctagacaattctgcaatacggtttccgttgcatattcttttttttatttaatgcataacttttctcactatactcaaagctcaaagctctaaactgtgcttttgcaaattctagataagagttcaatagttcgttgaagtggtgattccattgagtttgtgtaaaggttaatatttcatttctgttttgcaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaaggtaagagaatgcgttttatgtgtcatttcaataccacattggaattgcaaacagaaggcttttcattgcatttttacagaagtttaaaaattgcttttagattctattttcttgtttgtggtgactgttgggagatttttcactcaaattttttcatatcaggcatatataaattttttacatacccatgtttaaattaaaaatacatgatgatgtatttctggtctggcatgacattcatgtacccaagagttttaaatcaaagtctggcttgtgacaactgaagataaatattttatcaacatttgatcttctggaggttatataaaggtgaagaaattgaatgtgtcacttttaagtgccagttattctggcttagctcttgaagagttttctattcttatggcttttttttttttcctttgaccgagtacttcctaaaacgcttttctgaaaatgtgtcatggctaacagaaattattaagtacacgctcaatactcaatacttgagaatctacttcatgtgagttatatgacaaaagaaactaaagtgattcagatggcacctttgatgagcttactgtctggcagggacaattcagcatatcagcaagtatctacaatgcaagaaggggacacatgccttgtgggaggaacagacagcaaaaacatttctatggagtccatagaagaaagctggtttccaacagactgtttcaagaaatgtttttggagattcaaggcatctgagtcatatactgagttgggtggagttaggaggatggagagaatttaatgaaagatctagaagtggcatgagttaaccgctaatgctggggggtgtattcagccctaacattatgaatctgagattgtctagggcgttcctacaggcataataatattgttttcaggagcaataagtaaggcacataggttaaaagagctcagtgtttacatctctgcaagacttcagcaaggttaccaaacagttaagaaaattgtttatcaatgctcttgacatatgacttgagaaattatagagctgttagtttacaaaatagtgaccctagcctattcttgggtgttaaagagactgagttgtcctttgg

SEQ ID NO: 74055 - DNA, 1659 bp, Homo sapiens
acaagttaggacctggcaatattagtttctttcccttcataataaagtatcccaggatagtcactgattttgatgaccaactttaaaggcaagatcttgtgcccaattcttaacaagtccaaactttcaagaattaactgtgtgaatgatagtacctcaattatacaaattagtcatgacaagaaaaaagatttgggggacacaatatttttgttatttattacaagatattttgtgcaaacactgtggacaatttatttataactgcgaaaggaatctatgttggcctatcagtatggggacaagtcaatctgagtctttttttattgttgttatatgttatttacaaatatgagtaaacttttccgtaagtatgtactaaatttgttggtggaaagtgatttgctgagttctttggcatgagaattatacatatataaatgcatttgtagaagacattttggaaaatatagtacagttcttactgtgaaatttgtgcattattcacatacctcgttgcattttatgtaaaacactgaacatacaagtggctgtgatttttttggaagtttcagtattattatgaacagtagacattgtttaatgatttttctggaaggccaggtcacattccagaatgctgtgttccacgagttaggttaacttgacaaaatgcaaactgttttatgagcaatcatttcccttggagcagaggccttgaccacattaaccgtgtctctgatgcttttacgatccatgaaacgctttccctcacagctaaaatgtttgagatttttgtttccagattctttttcctgtgattgataggaattaatctgaaccatttggcaaattgaacatcaagaagggggtgcataaattaactttaatgcttattaagactaaaagtgtcagtatttaccactttcgggaagtatttatttgcttaaacatttgaattcacactcagctttaaaaagggacacaattttaaaaatagtattgctaattttggttgaaaacactcagagtatgggggaaaattgtttagacaatttttagaaatttagacataatcttttgtaataaaaattcatttcaagtacagcgagatcctttttaacacctgcatcagatgatgtcactgctctgttcaggatcttccagtggcttctcaccacactcagagtaaagagcaacactgcaaaggctgcctaggccctgtgagatctgcttccccctcccgccacctgacttcatttctatcgccaccactccctccaacccactccagccacgcatctttgctctcccctgaatatgccaagcaggctttgccttagggcatctgcacttgctctttcctctgtttggaatactcttgcctcagccacacaaagagcatgtttcctggtttccttaaggtttctgattaaaaatgtcagcttgtgaatgaaccctttctgccaacttatttcaaatagtaatgctgccattgctgggatcccatttccttctcacctggctttactgctccccctaacacgagcatttgatatgagagatgcttacttgtttattggttgattatctgtctccctcctccactctgctagaacataagctctatgtggatagggactatgtctgttgtgatca

SEQ ID NO: 74056 - DNA, 1063 bp, Homo sapiens
aaggcattgttggtgtgtgtgtgtgcccatgtgattttgaaatgcttaagtcagttttataatgcaacggagtacaggcaggttcatgcttaaagattcttggacccaccagttgtacttcctgaaagcaagcccatctctctttcatttggcttcagctgttctgggtatatcaaccacttcccctgtgcaccctctctggacactattcagacttcatgtcatagtttactcctggaaatccatgcccagtgagagcccagaaatcccatctgaaagatgggattgtgtcttacttattgtgccccagcacctagcgtggcatctggcacagagcagaagtgcagtcatccccagagaatgcagacatgaacaaagaaacccttacaacttttccagttgaacctagtgctgctccatcagtgatctccagaccaaaaccttccttttatgtcgttcaccatttcctttaacatctccgtttcattttgcagatttggtcattcgaggaggattctctcctgctactttttgcctgtgttgttttcctagttctttcaccacgctcaccgcccttcctactttccctctaatgccacctcttcctccccttgctccctcagtgtggatgctctccaagacttaggatcagcctttcctagttcaggttcagtcatcagctctgaaagcttatctgctttcatgcattcatttcccacctctgtgccaatgaattccaaatctgggtgtgtgcccttgcttgccaccaccatggctgcaactacctactgaacatccccatctgaatggcccattgtcacctccagtgccacatctctaaatccaaactcttgccttcctactacaatccacccccacccctgggtgccttgttccctgggcacaaaacctgaccactatggcccaaactcttggtcctttcttttttgttgttgtttttcaggttgtaaggaagtataatacctttaagaattaatcaaaactaagaaatctttacccaggaaagtatccatactcacagactatttcaaacaatctgcag

SEQ ID NO: 74057 - DNA, 1048 bp, Homo sapiens
agaaatgtatgaatgaacaacaaagtggttactttggaagccgacataccgttatattggatttcagaaaagtcaagtaatcccatatttcatgtgattccaggtaaaagaaaaaatatttagtccacaacaggaagggaaaaataaattcaaaagctcccttgtgcagatttgtgatataaacactgaaaaatttaatgtagcagcagtatgacaaattatattagtaaatatgaattgctttttagacaaaaggatattcatgacatttttgctgtttaaagataaaatgatctctttcttcttcattgaatcataaaatcttggacctggaaaagactttagagaattaaattattttccacccaagtgccaagatagtgactcctcgagggcacggatcgtattttctgctccctcttcaaaatgtccacagtgctgagtcaaacgctgtgcactcagttcccttaaataacagtcaatgatgagaatgctgttcacagatacaggggataaaaacaaaaatcttatcctcactttctggaattgtgtttctctttgataacaacccattttgagccatagagctattataataaaagggattacatctttgggattttccttgtatcactcattaaaatgtcatgcaaagaaccacactggtccttttgttgctggacgaacactggctggctgccacatgcctgcaggccccagttcacagaggccccacacattgacctgctcattcaaaactgttgcgagggctttacctttatatcaccacagtacagtgacttacaatgattccagatcaatactcctctcagagtttgtctaggaagtcctaccagctgtcatgtaagggtaattaacacatctctctcaattatgcatgctggtggaagaatttcaaacatttggctggataacaaatccatcccctctgttagagaaaggtcatccctctggccatctgggtatttacttttctttagaaatgagcttcatggaattttctgttggaaggggaaaatgatgagga

SEQ ID NO: 74058 - DNA, 1063 bp, Homo sapiens
tgtaaagagccagaatgggaggtagagttaattgtggtgcactcattcaagcaaacacaatgccggcattgtaaacagtgaggttctccagcagcacagagaagcaaggtgcgtgatcggctccataagaacaatcaggagataaaattatttgttcaccaaggttctaactatataaaaatatgaaactgtcaaaaatgagtcttcaaacatggtggtaattatggtagagtgatgcttttaagcgtgaatcccctctcaccatgtttcccaatgtttaatgatgtttacaattaaatttaagcaaacaagccagctcacacacttaagcttttcattctagctatgctttatgggattacattttttaattaaaagaaaagagatttcataaatacaaaaatagcaaactgaaattgtattccttagaaaaatcaatttcttgagatagcgttggatttttagaggggattttttttcttttttttttaaaaaaaaaccatgtgtagatgtgtggtgctcatgcagaagtcctccttgtttgctttgaggtcatggaagctgcctgaattaaacatgtgaggaaataccgttaaggggctacaggtgggttaacgtccaacagtcctctctccttagcagcctcctaagcctcctcttcggttaaatctctttaagtgaatgtccaaacaccaatattcctccttttgtataacctgccccacattccattacagatagtccttttttgtgttattcttgatcttattttttctttgaatgaaggaaaagagcttctactcttggtgttaacttgaatgaaaccaactgatgactaaaaactagctcttagtgttgagttcaaacattgtaaagttttaaaacttcaaatccccatggcatgtgagaacattctggaaacgatccagcatagacaataacttgaaaaacagattcatataagaaaagtatagctgcacatgtcaacagttgctccagcctttggcaaagtgcttccgagtgcatgaaaatcaatcaatggaatacattctgttaatggaat

SEQ ID NO: 74059 - DNA, 1069 bp, Homo sapiens
cctgtctctctcagttctgtttttctctctagcacttatcaccatcatcatattcactacatgttgtatttattgatcttgttgagtgtctgcattcacccattaaaatgtaagctctatgaaggcagggacttttgcctgttgtgctcattgtcttgtctctagtgctgagatcagtgctacacagagtaccatacattaaatatgcaccgaataaatgaacacttatttatcactcaatcatgcaatgaatggatgaatgattgaaaactggtagtcaatgctgtccaagaacatgactcttgggagactcttgccatgctattttttcttctttgagataatccgcagctcaggcactgaggtcaacaactctaatgttcaagatcttccaagtaggagggaggaggttggataaacagagtttgagtaaatttgcccttggcttttgagagagctaagtgagaatcctggctttcccacctcctagctctgtgaccactgataaactattcaacttaggtcaagctgttcaactctggccttagctcactcaatatgtaaaatagaatgatatgaaattcagggatttataagaatcagggttgaaaacattgggcatatagtaatatactcttattaaaatgaaatgtattttcatatatataaataatttgtattaatttgtagaagtttgcttattgataaagcagacagtcatatatttattgacattttcattttaggggacacaccatatctatatttaaaatagtattttttgtcttactggaaaaaaagcctcctatgtatactttgattaaattatcacatgtatttctgttatttaaggatcctaaaatgaaaacaaatagcttctaaagcagttaaaataattatcaaggtatatttgttcactccagatctcatcccacaaggtttacaagagtcttggcttttgaaatctgtgtcttccaaaaattcatttgttaagcaagcactgagcacttgctctcttccaggcaccgggctctacattactggctattcccaatggcaggaaagagct

SEQ ID NO: 74060 - DNA, 1429 bp, Homo sapiens
tctaaattgttttcacctggaaggctgagcaattcttgctgccgcacttgcttctcatggatttgagaagattaaagaagacaagtgtgagaatgccttgagaactaccagaacctttcacagatgtaaagcattattatccacaataatattaacacggagtgagcctctctgcaaatcaccgtaactgtattttttaactaatcaacttcaatgaaaaacatgctacatcaaaaaggaacatatccaactgcgtctgtcttcgtaaggcctatgaacttgcaactttcagtttcacgtgacagaaaatatttttttcagtccacatttcaaaaggaaagggaaatttgttgctatatttttactcacttttatacccttactatactgctatgctcattacatccctgttgcagaactgttagataatttgaggccaaaaaaaccttgatggacattgatttttacagtattaatgagagctgctttttactgagttctgaccatgggaaatgggagtgcaatagcgccttgttctgcccaaccctttcagctaagtagtttcacttactcattgcagataagaaaattaaagcccagggaggttaatttcctccccaggttaatgagtagtaagtgtcagagtgctaggtttgaattcaggcctctctgagtctaaaatctatggttttactttaaaatattactatttctctgtgaactgtgttattgccatcatcaataaaacatactgggacattgattttagactatgaaatcagatgaacaagtgacatatatttttgaagacaaaagttacctaattggaatagatttgtcgatatccaaaatggttttgggaaatgagttttgaggttctcaatcctatcgacaaagcaaagtacaacccgtatttatggtaccacactaaccctagcttcaaatgatctagcatcaaatgatctgtgggctgggagggttgagaatttgcttccagagaaaataaaaatggcagtatgggggagggctcttttatctaaatgtttacgttgatagtctctgggttaaattacacatttagtgcaagttttttaatactatttttactcctcacatatgacaatgctccccaaatttggccatgcatcagatcatttagtaaaatttctaaaattcaagtatcaaggtctcagcctagatctactgggtcagaatttaatcactatttgtaaaatctcccccaggcatttctgacagagctagtccactgaatcactgatgtgctgtgatttatgacctttcagaattgattctttttaaaaatcctaacattacatagtccgtaaaccatttaaatcacttggctttttctccagtagtactaaattataaaagctacagttactgaaaatcataactttctataatt

SEQ ID NO: 74061 - DNA, 1526 bp, Homo sapiens
aaaacctttcaggaagggaagactgactggatctagatgtagttgaactacagcaaaaaatcgtaggtttatttgaaaactacatttgaattttgggaatatacatgctagtgatggaatacggaaacatactggtgagtctggacaaaataaaattccaagtaaccccactgtttgagaatgcatagacttggccaacttgaaaatcaggctgtaatcaaagggttttgtgactcctctccctttgagaaacatgtagaataaatcaaagattattagtcagtattctatagcttttactaccttagtgttataacatttaatagtttggaatgttgagtaattagagttgaaattattttcttttgttgagaacactttcatagggacaaaagcttaatctagttcctgtaactagaggttttttatgatgttctctcatatttctgtatggtttggggaagagagggtctacatggatgtcatttttattataggtcagcattgagctatacaattaacacagagtatatgatgaatacattttgctcaaatgacatttgctggtaattttttaaagttttattctaaataactctttctcctgtgttgtcttcctttaacagcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtacttcaattctacttgtgttttgacatgcatttgtggtagaaatatacttctgtgtaagtgattgcttgtaagatattaattcagtcttgcaaaacagccatgtaaacacacacacacaaactcacctaaaacccatgtattcataactctgtggtttgaagttaaggccaagtataaaggaaattagtctatggaaaagactagttttaacacaaaaatcagctgcatggaatatgcgtttaagggaaaaatattaaacaatcaatggaacagtgactcaatcatgatgcagcccatagagatggctccaggtcctgaaggcctcctcatgtcaaggtgtaatccttgcaagaccctggaaagttctggaaactggtggatcaggagcccagcaaccagggcagccgaggacactcagggacactggtgggagtaagtgggactacaactatttaccaattggtatgatcatatttcaatgtctcaagaacaagcatggctgctctagtgtgttctggcatattagttctgattgtgttgttgctaaacaggggaaattggaggatgagtaaatttagttttttgttttgtttggtttggttttgagacgtagtttcgctcttgttgcccaggctggagtgcaatggtgcaatcttggctcaccacaacctcctctgcccgggttcaagtgattct

SEQ ID NO: 74062 - DNA, 1087 bp, Homo sapiens
ttgaagatatagagagaggtagatagattataggtgattgacagattaaatagatagattataggtaggtaagcaggtatatagataggtaggtaactagattagatagatgattaattaattgatagattttagatagatcagtagatgatagatgatggatggctggatggatagatgatagatggatgaatgaatggctggctggatggacggatagatagatggtaggtaggtagatagatgatagataatattaggttggtgcaaaagtaattgcagtttttaccattaaaaataatgatagattaacagataatagatggatggatggatggatggatggatggatagatggatgggtggatggatagatagatggataatagataatagagggatagattgatagatgatagataatagatgatggatgaatgaacaggtggatagatgattggatagattgattgatggtagatgatagatgaaggaatggatgcatggataaatagatagatgatagatatatggatggatggatagacagacagacagatcgatagacagctgcataatatgctacccagggacaatggaggccttgttgcttttcctttgttattttagctgaactgcagatttcgtattattttctcaatatagattttcaccctagaaaaggcggtaaaacaaaactcaaatgactgtgtcagagattgtggttacctgggctccgcataatcaatcttttcttgtcagtggtacatgagccaccattgaaagcgaggcagcctccgctcctcccgcggtggccggggccgcaggggcgcctgggctcaggcttgcctctgcagcgcggctcttcttccctgtcttaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagca

SEQ ID NO: 74063 - DNA, 1160 bp, Homo sapiens
tgttgttttccccctttttgttttgttttgttttcccctcctgccccccttcagcacaataagtaaatccctcaggtgcagggaaagtcctggggtccctgagctccgttccccctcctagggtggcggagattgagtgtgctcacttagggtctttttaagagaggctcaggggccttgtaatgaacatgaaggtgggcaccgcttcggagaggggaaagaaaggtgcatttctgcacctgagcacgaggaggcacccagctccttggagcagccacggaggacatctgtggcctaagagaagcccagagagtgatttggcttttcgctactcccattttctcctcttctttcacttattacaagggcaatgctggtcagattccccatctcaatgaggttttatgcagaatagcaatgcatgaaacagatgaaagtggagccatcctggctggtgcagaaagaaaaaaagacctgtgacctaggcttgcttccctgagtcaccctactgtcattagagaccagcagtacatcatcattatcatcgcctgggagcctgctcagaatctcggagagcctaactgtcccttagagaccagatgcaccattattaggatcacctagaagcctgtggagcctccagaatcctcagcctcaccccagacctcagggaatcagaatttaagttgtaaaacatctcccaggtgttttgtatgcacattaacatttgagaagcacctgcctagacattgcttatcaaacttggctacattttggaacaacctgaagggtctgacctgacatctgtccctttccctgaagtttcttattttcttatttagttggtctggtgtggtctgggcagtgggattttttttttttttttttttttaagacaaggtctctgtcacccaggctggagtgcagtggaatgatcatgggtcactgtagctttaaactcctgggctcaagtgatcctcccacctcagcctcctgagtagctgggaacatgcccatctaagttctaattttttttgtagagacagggtctcaccatgttgtccaggctagtctcaaaactcctgggatcaagcaattctcacacctttacctcccaatgtgttgggattacaggtgcgagctaccatacctggcgacag

SEQ ID NO: 74064 - DNA, 1606 bp, Homo sapiens
ccctccaagacctcagtgtttactttaaaaggagagatctgcctctaataaagaaaactcccaccacagagtggtagaaagagatacacgtcactgtcctgctcactctagagatctcagtttttttacattcctagattattctaaattctatggaaattaagtttcatcacactaagacaggaagaagaagaatattaaccttccaggtgacaatcctaaagggaaatatttattatttttcattgtacttggagatttcattaaatgattctttgttaagtcaaaattttgttcatgaatatcagcctttagagacataatcgctcatctagttaacatgtcagaaaagatcaacccattagtggattcattctgtaaatacttaggactgcaaatgggaaggggaaaaattgagtccagaaagttaaggccaaaatgattttgagtttaacgatccagttcatgttctcaatgtgctctatgagaataggctttgtaaccttctttagctgatgcagattaattgaagctcaaaaaacaaaacaaaagaaaaccctgcactacttaacaatgcaaagctgtgcaaggatggaagattcgaaacaaaaatggcattatggaagttacatgatgtcaaagttacatgcaaggaaagaatatccagtacacagatgttttgtcagctcattgtttttaacgttcacaattgtactttcacaacattgatttcatgttattcgatgactccgatcaaaactaccttcccaaacattttcttctccattggccgttctaaatctcttctctgcctgtagtcctttctacttgatttctagtctcttcccctccatagctctccccttatcccctattatctccatactttttatcctgaattataaaacaataataaacatcctttatttatccaggaaaatgtcattaactgtttcccattttaaaggtttagtactgtctcatgtcaaatgacaaagttctatttcagaactttagaatataatatttgtatttattagagaaaccttagggacttacctattgtgctaagcatagaaaagggtatttcattttttatttgcattggagcaattcctttgaattattttatttgcaaagaattccatcatagaatttttagttttttttttacaacaattaacaaagaataggaaaatttttcattgtggtctaaatcaatccatatttgtttttatttcagttgtttaaatgaaactgtcttcccaaaattatggttcaaagttaaagatagtattttacttctaatctttcaagcagttctttgctattatttttagctgtttgctatttttagctgttgtatttgttctttccaagagttccacttttcattaatggggttgctcactgattgtagctaaaagtacaaatagaattactaaatagaaattattttgatagctggggacactacataccttttaaaggttattttcttagtataatccggtaagttttttgagataaatgaaatgaacatttcaaatgtagtagaaaacagaatggatgataagttggttgttagaaacaagatgatggaata

SEQ ID NO: 74065 - DNA, 1048 bp, Homo sapiens
aaattatttttatgaaaaatttcaacttgggtcatatccttactcgatggactcattatttcatatttgaaaactaacttatcagaagttcttcgatcctatggcccttacaaattttgcatttttttttctgaagcaatataaaaaatgcttatggtgtgtatgcaagctgctgttttaattaactttcctgaatttcaaacatctatattttactctcttatatgcttttaactaaggtatagtagatgcatttttgcttcaatactaatttaaggtgtaatattcatttctttagagaacatttttgttgttgtgcatgcctagtgttttgtacgttgtatattgcattcagaatatttttttccttctcacctatccacaatgcaatgccgttcccatgatgcacctctgcttgctgtttacctgtatgttaattcgcttgaatcccattggcccactgccatcatgtgctcgctgcctgttattaaaagactcagtcgactgccaaagcaatgaagcgacctctcgaagcaactgtagacctggtactttgacctttcacctttcgctttgcatgtagcttttcagagaaccatctgagatttgtattacttgtaaaatactggttgcaaacaatcattattattaatttatggaaaaaatccaataaggtgtttagccatctcattctcatatgtaatctgtgaaataaattaatcctaacaaattttaataccttttccaaaagagtgaagcaaatttaaattatttgactcagaaaatgttcattataattcgtattaacctttaaattcaagaaattgccatttagttaaagaaaagaataggtattaataataacaccaatgcttcgtccccccttagaatagtttaactcattttaaaagctgaagccattttttttgttgttgttgcttgatagtttttcttttccttagttgagatgctaccgttttgggttacagaaatcatgctttcgctctcaataacaaattctcactcattcgacattgccgctgtttaa

SEQ ID NO: 74066 - DNA, 1041 bp, Homo sapiens
tttccttaaatcccatagcttatcagagttaacatcagagggaggtaaaatatttctgtgatattctttgtataaaatctacactttgaaatggattagtaacctgtgaacaatacatattttagttaacatataaattatgtgagcaaagtggttttcagtgtttttttcttattttagttttgaacctgtcttaaactcacagacttgtagaagaaatctctaattcagtatttattaggagttcacttttgccctattacagccttaattagtgacatcccagtgctgttacagcatagcagtgtcttaatatgtaatctaattgaaataacacatttgtaaaataattactagaaggtaaacttacgttaatgtcctgtgtggtttctacaaagtgtgtcattgtagacctcttggccactagatattttaagataaaaaaaaaaaaattaaggaagaatatactgaggggaaaaacgtaaaaggagaagcctgtttctgaagaatggatgttactgccattaccatgtcctgggaatacctatgaagctctggtgctaagcctgccaaaagaatctgaagccctccagcacatgtttaactctcaaacccaacaatgactgatttgttaaatcactgaaagaatcatcactttaaaatgtttcaccttttaaacattttaaagcaaggataaacatttccaaagcaaggataaacaacatcccttacgcaacgacctgatttttgttgatgaaatgtatctcatgaaggacccatacggctacattggctgctgtggttgtgtacttccgccctctggtggattctttaagaacagcttaagtgtgtctggcaaccctcaatacagtgggctttggaagccaaaaagtgggtcctagcgcaccaatacagtgactagaagggtttccatttcttacatgacatgaatatcagagtgaacaagcatgtggatctagtgttctgaaatggtatttcaactgctaagaattttcacatttctcttaaatgaggaaagag

SEQ ID NO: 74067 - DNA, 1041 bp, Homo sapiens
gagttgccagaaagaaaaactgtgtgtgtgtgtgtgtgtgtgtgtgtgtgtgtgtgtgtgtgtgtgatcaaaaatctaagggaagaaagtggcttccgatggagggaagggcggagtgctgaatgctgctgagaattaggaacagtgagatgaggacaggagagttcctgctggctgcagcaatatgggatttttctgtggattggcattcacaatttaagtgcaaaggtcaaatgaaagccaaattgaagaggaatgaagactcagtagggatagggaagtaaacatttatgtgtaggtagatttccagaagtttgattgtgaagatgagagaatagggctggagaaaggtttaagttggatgtattggcacacatttgttgaagaatctggcagtagcccagttaaatagccccctcctgactaggtcatgttagcttgatcgaaatgtagttcaggcaaaaagtcgccctccagcgtgaacagctccacagagagaataaagacctacacatctcaaattctccaactaatatctcagaagtcagttctgaaactctaagagggcactcctacatttacgagaaactacttctcaggcacctacatgacacccagtcttcagtgatctaaatccatgtattaccttgtttttcatggaactgaaccagtagcagataattcctcaaagctttcaatacagctttctttcagttctccacaacatgcctgaatataatattcatggtcagagtcatgatgcgtgtatgttattatgaccaccacaagtaagacagctatttctaagaaagggttgaaattgcccctcccacctcctacctccccactcagatgccaacttgagatttcctaggagttttgccagaaatccccctcagggatcactttgtagtagtcatgaccaaattccttagccctggtcctaactcagccccaactctgcactattttgctctacagtgtttaagctttattgccaggcactactcctttatcataatgaatcttacaacagagaga

SEQ ID NO: 74068 - DNA, 1169 bp, Homo sapiens
tgtaagaacctcagtcttcttaggttattgggctttcaagcagcaatctaaaattcacccatcctgccctgcaagcttctgatttggagaatatcttaaatcttaaacactgttattttcataccgttggtgacacaaaacatttacagtcaaacaaacaagtaaacgtttaatgcagtaagttcagtgtattctagtgaatataaaagttgacctggatttacgaagagaattctatttctagccttccccttgacccacaccatgcatggccttggaggagttactatgcctcagatttttcatctgtaaaatacctacttcctaccttggaggattaacttgataatgtctgtaaaatactttgaggtcttagaggaaggacaccacggcattatcacatgtcattcttattagaatcatgtcgatgcatatgaatagaaagtgtgaacagtggtctaaggagtgagcttggaataatactggcttaaaataagtcagatatatttgtgtctgtactgacaatgtgaatggccctaaaagactgtgttaactaaccctacttatttctggttgtgcttcaatctcactttgaatgttaactctaaaccgctaacctgtttctttccctttattcactttttccacccaccattgcatgacatcagggtcagttttgtgcatgacacccgctaccagtattggtaggtttcaaccttttttatttgtcttttatatgatgtacaataccttcacttgcttgaaatttatttcagagatggtagaaatgctataggaaatagtagatttgaaggcttatttggctttagagttaacatataggtttttaaaaatgtacttgtatatttaagaaaatgacggttttaatgtgacctcttgtgctagaacaatcactacaaaaacataaagccacaagtacgagtctgctttttaatgatttgtgttttgtttctctttatagtttatatggtatagcgtaaggaacagagcttactctatcagcgaggcaggctaatttcatcaatgtttgaaagtttcatagtggtgtgcctttatctcctctttgctgtgtgttagagcgatcagagtttcccagaagtattcattttttacaaattataaatggatgtattttgaaaccgcatgtc

SEQ ID NO: 74069 - DNA, 1130 bp, Homo sapiens
cagccagctgctatttcctactctgtggtcacaagctgattgtatccgtgaccctagcctcccaacttgcaaacatgtgctcctagccacaaggagacagcgtgagggtgagtgagcagaaactctcacctcgcctggaagaatacttcattgcgcatgccctcccttcacagaagaacaattttggtttggtttttagtttcatgggtttttaaaaataaaatcagctctgctaataaaagatgacaagggataaaagaaattaggggaaatcgtgttgggggatcacggcagtcccaacccgcattctgcaggctgggagggctgagtcatgctgctttccacattcaagtgaatccacgattccagctctgcagatttcatccctacaaagagaggcgtgagtggacaggaatgcaggaataaaagttaaaccccgtgacagtgctgactgtggcctcagcattgtgacagagcaggagagagcagagagtgggggagggaggggaggccgaacagcagtgcagaggcaggtgtcaatcaactgaggacgattcttcagcaattcactcccacctctaaaatgccaaccggtcctctaaggaaaaccaacccagcttcgaaacaaacagaacaaagaacaggcaaggattagttccttagctgggaagatgatgatgatgattattatttaatgtgggatgggagaagggagtgagactgtttgcatctttccattattaggtccaaagctcttctcaatcactcattcttaatagggaagctggatacctgtttctttcaagtctgaagtcctgcctccttgaactatgtttatgtgatttttgacccaatttttattacaaagtccttttataagaaaacaagtttggactgagtgcagtgcctcatgcttgtaatcccagcattttgggaagccgagggaggagcatcacttgagcccaggagttggagaccagcctgagcaacatggtaaaatctggtctctacaaaaatatgaaaaaaattagccaggcacggggtgccatacactgtagtcccagctacttgggaggctgaggtgggaggatcgcctgagcctggggaggtcgaggctgcagtgagccatg

SEQ ID NO: 74070 - DNA, 2369 bp, Homo sapiens
ctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaaggattgtatagtcttccttctttttgtgttgagacagattgataattcaccaaacaaaatagttttcaccttcacacatacagtatttgttaacttcaaagaagaccaaactcgggtcttcgaatggaaaactgatagtttttgcttttggctttggctttttagcagcaagaaaaacaattaaaaatggtaatttgagaagtatttttagtattctttaaaattagaagtgaaaataaagcccaccactcagccctcttcttcacatctcagactgataatgaaaagatatgggatcaatggcatcagtaactaaatgggaaacaaaatgtcagtttcatgaatagattagattttaaaaaggacccattaaggtataatagaggcttctgtaagagcttgatgggataacatgaatcagacctgaggctgcagaaagagatagaatggtgagttctattctatgcagaggtcctagctaggtggctcaagaatagaacaggaattcagcaaagagagggtgatgagggtccctgctattctgtcagtaagcagtctcctcctaagaggtggtgtgtgggcagaaggagcaacagaagctccttcttcagccttttgagacccaccatatttgtcaaggaaggtgctattggccttttgggtgggaacactccttgtcacactgagattagcagaaattgccttctctgtgggccaaggcagaaacatgagttttctccatggcagatttaaagcttcaggcctcctgagtggtt

SEQ ID NO: 74071 - DNA, 1107 bp, Homo sapiens
cattttactcactagtctcagttcttgatataaaaagatcattgatcagctgaagtagagttcataaattctcttcaccagaattcaaccgttgtatacataagaacctcttggaccctcacttgtgtgtctttgtaatatggtagtagtaaggtattttacacctcatcctaaccccagcgtctggcttcccatcattgatggagaggacatgtgaatgcaggtggcctcttctttaccagtctttcagtatttgatatctactgtcaaattcagtattcagctttaggtctaggtcagcacttttcaatagagatataacgtgagccacatatgtaattttaacattcctagtagctgattttttaaaaataacataaatatatggaattaattttaatgtattttatttaacccaccatatttaaaatagaatcattttgacatgtcagtattcaaaaattattaataaggtactttacttctttatactgtgtcttcaaagtttggtatgtgtttgacctaccacatctcaattcaaacaagtcacatttcaagtgctcagtagccgtatgtggccacaggctgccatattggacaacagaggtctaaggtgtatatgatttggggaaatgcttgcttatttctctaagcttcagtttccttatctgtgaaatagagattagcatgcaccttccagagtccttgttagaattaaatgagataatgtattttaacattcccaaaacaataccagtacacagaaattgctcaaaaaattctagctgtcattcttactttaataactttgtcatttatcttccttaaatgttacccttgatataaatgtaattttagaagaaataaatttgtaattgcattttggaattcattacttagtatattcaagatgagactaaaaagcaatgaggttaaaataatccttggaagaattgtgttggtattctcttgaaattatttccccttatgaaggatctgatggaaaagggcatgagaatgaacatttaacttcaagtacagtatagcaataatgcatagcactaatgcatagccaaacaacgaatggagcttttcatttttcatttt

SEQ ID NO: 74072 - DNA, 1103 bp, Homo sapiens
agataaggactgatggtgaaacctctatccacttaaatacaaaactaagataaaagaattgtgagaattatggctgccaaacagaatattaaagttaaaaagactgacaatatgaaacaaacaatataactagtaagtcaggatgagaggagggaaatagttatgagtgctcacttcatctttcatgagagggatttaaatggtcaaaaaattgaaatttgttttgaaaatgactcgaagagctcagtgtttttcatgatctttttttctttaaaaaccactttattgaggtatgattgatgtacaaaaagccagacatatttaatgtgtacaactcagtgagtttagagataagcatacacttgtgaaatcaccacaatcaatgctgtaaaactatccatcacctccaaaagtttccccctgctttatttatctatccattcattcattcattcattcattttttttgtagtaagaacacaacataagttctgtcttcttagcaaatgtttatacaatacagtattgttaactagaagtactattaccatacagatgtctgggacttacttatcttgcataactgaacttcatacagtgaatcactttatgtggcccagaagtttttcctgaaaaggaaacttttgttttggctgcattgtaaaattacaggttacagtatatagttttctttttgccactccaggattgtaatttttaaagctcaatttggagttggaggagatgatgtctcttcctctctaacattctgtgagagcacttttgtctggccggggtgatgagggaaggggtcaagtttaatatgaaccttaaagaatcagcagcctgtgacccacaattttgtctagttaagatttgataattgtatcaataaaatctacaataaggaataattatactaatacttattttttaatggagggcaaaaataatttaaattattaaacattaaggaagaggtagaggaactaagaaaaatcactggatttcacagccaacaggaagagccaacaaagttggaatctatttgctaaagtttcagtagcaatatacttgagtgatttaatttctgtgtgtgaagt

SEQ ID NO: 74073 - DNA, 1036 bp, Homo sapiens
ctgtagggcaggaggttgtaaaacaggctgattgcccaagttgatgaaattcctataaaccctggaaacctccttgtctgcttacagataggcttttagctagtcgctgtagatctgctacatatttttatgggatagttggttgggggaatcactgaaaaagcaatgttttaaggtaattattacggaagtagcataggatagagtagaagagtgagaaattggaggcaagaccagttaggagactgttgcagtgtcttaggtatgagttactttggaaatgaaagcgtttttgtagtgggagtgaaaatgatgggacagatttcctcacatccagtaattcctgttctgtccatccctgtaatcactactggactagacctgttgttgcggcctctcattacacctgatcatgcttagagactattggacactctgttgcttaccatccactctcccttgccccacagtgaattcttaaaactatctttctgacttctttcatttcagtgttggcttgaaccctgtcaaaatgtaactcttcattctccattggctgctgttgagggccataacctctgccaacaatgatagttttcagctcctttcttcattgtgcatttgttttattttttttttccatgtcatctgttacttctcctggttcaagtgaaaagacctttttaataggcatcgccaataaatctcatgccagttgaaccaaccagttacaacaagccatgaataatgaaggtactcctcttcctcttctgagttgtttattgctgggcagaagaaatgctaattctgttggcctcataacctgagttttctagaaagctgtattatagagattcagtgtttggggttttttttttttaagttttatttagtgttatgtgtactgagtgatttagaaatgataaatattctaagatcttactacaacaatagaaaaatcttgcaggataaatactcttctgttcataatttaaaagttcctaaaaatcttagctcttcatagctttcaagcttc

SEQ ID NO: 74074 - DNA, 1642 bp, Homo sapiens
gctactaaatataatacatcttcatatacgctaatggaggacagataattaaattatggcacagttatagattctataaaatggagtactacctagccattaatatgatacatattatttattaaaatggaaagctctgtaatagtggaaattgaagctaccaaatataattggtataatctctttttataaaagctataggtatacttatattgatatatggaggaaaataatttggaaggatagatatcaaaatagttatagtgatcattctcacagagccaagattaagaattaaaaaaatgtttttttgtttcctattaagtattgccaggtatttttttaaaatcatgacttatttaatttgagcaagagtaggagggacctatatcatgttggagaaaagatttctacattctaaagggtaaaagaactagaatctatgagaagaaggggcagggtgttacagatcacagttccttatatacaagtaaacttttaaactgtgactttttaacactaacatttaacagacctgacagtacaaaatgggttgcctgtaggtatgagttccacgtcactaaaaatgttcagacgtaagctccaaagccatttggtaagtttatcatggaagtaattgaagcatcagtttttttgacgttttgccttgggactctcttggtagatgattttaactgtgtgaaaagatgaatgaggggacttagaaaagcctttctgattctcatttccaaattcaaagagaattatatttcaacctgcttatcactaagaagataccagcatgttaaaattcacatgaagtatgaccttctttaaatacgctacgatgcagcaccctcaaaagtaaagtacagaaactgacagtagtggtatctgtctacagtttatcattggtgaataaatgaagggaagaaggaattgagtctggacttgccgcatatggaaccatgaactatacacatagaatgttgtttggggtcacaaagtagtagattaggccagtgattcctaaaccctgctgaacttcagaatccatcttcagagcttatagatatagacatattacatattttaatagactcttgggtcctgatcccacagatttagattaactagctctggaatagggcccagaaatcactatctttaaaagaattctcaagttgtgttgatgatcagccaagttcagacacgaccagaataaaatatatatacgtatacatacctacatatcaggacagttacaagaaaggagaaagcaaaataaagtattttgataaacacatcaagttcttttgagttactgatattttaaaaagctgtctcggtgagaagcccattaacattctacagctaagtgatgctacagccagtatttctgatgtttcattcagtccattaagcagagctgcttaaaagaactagttttatttatttatacatttataatcaggttcatgaatacagtcaacactatggaaattcttgtcaataaaaaagtgtttgtccacagactacacacagaaataaaattattagacctgcatcagtcaccgtctgagctggtcatgcccttaaaggaaatttcaaggaagatgggctgaagttggtgagatatctg

SEQ ID NO: 74075 - DNA, 1052 bp, Homo sapiens
taatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaat

SEQ ID NO: 74076 - DNA, 2470 bp, Homo sapiens
atgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctttagctcttgtgataagattttcttttttttacttttatacaaaggcagcatctttgaatttttttttcttttgatgttgcaacttttgggttcttttaaactgtgatagtgatggtaactgatgcctttcattttgttcaacttatacaaaacaagccagcatctgatcaaaagtattacataaaatattttcttaaactattgaaaggtgctttgatgattttctcctttggtttgtagaattaggactgaacttttgactcaaattgctacagttgccatcacctttctgtggtaatactactgatatttgcttttctatataaagaaatgttgcctaaggctgtctggtatttcttttcaagggttttccagtatgaatgttaatgttgtcagtgtatgtatgaatatgaaagtgctttgttttgtttgttgctgttttttgtttatgtgtgtgtttttaatttttttgttcttatcagcagtcttgtgttagcactgggtaagctttaattgtcccttagccaatcaaacattaaggactatggaggtctttttttttttatttaacatgtcattgttcatctattaaatcttgatcagggtttcaagaatgactgcagtgggttttggaaacagacttatcattattgatttgaggtttcccagagatatagttcacagttaattgttgcgctctaatacaactgaccatttaaaattgaacaagtttattgttttgtaacaatgtcagttgttaaaccttgacatttcaattaaaacatgaattgtagttataactcaatgcaaattcaacagttgtatttggagttaaattattttaacaaataaatttatttaatgaaactctggatttgctttgttttgtacatgctcatgagagaaatgtattatatacaaaaacaattaaaaattgccatataatgaatttagtactcttcatacaaaaatattttagctgatttgagagttcatcatataaaaaggcaggtaggtagataattttcatagtctttaaaaataaaaataacatgtaagagactgtaaaatcagttattataaatataaacttatctctacaaatgattttatattttgaatggtagctggttaatttaaagcctgatgctaaggttaacagaattgttcaaataattaacattaattagcaatatcactaaaatgattcagaggccttctagtgatggcttgaagccgtctttctgttttcaggtcatgtggatccgaaggtgccagaagctgaaggttgccgccaggctgtagggcctgcttgttctatatggggccctatgaaagttgacagatgctgttaattgtatacagccttcagctgctctgataaggagcccattcatttcctaagccaatttaaactatgccttttggttatgttgccttcaaactctgttgaaatcctctggcagcattccaccagttgagaagcttcattgttttagattataagaataatttgaatgaatataacagaggcactgtagatagaatcccagatatttaaaggaaaacatgcctatattttaggaatatcttctgaagaacttcataattttatttgaagtgtttgtaaattttttaataaattatttaaatgtatcaatagtggatagttggaagaacgtctttgaggctaaaaagtagtactctgaaattctctcaagttatattatttgtctgttagaggtccacgaatgaaaatatatgtagctaaaggagtaaggtgctgcccaatttggaacccaactgacctctaggatctatgaagcagagaatattaccacaaacttctgaaagaagctgttgacctcgtttcttaatttaaaatatgttgccacataaatactaataaaacatagttgctcttcatctcttaaatggatcattccaactggttttacatcgttgaatattatctagtatttttaataaatattttcataaatagtttttgtggtttttttgtttgtttttgagacagtctcg

SEQ ID NO: 74077 - DNA, 1056 bp, Homo sapiens
gtactgatttctatttttactccattgtggtccaagagaatggttggtataatttctatattttttaatttattgagacttgctttacggctgagagtgggattgatcttgaattaggttctgtgtgcaaatgagaagaatgtatattctgtggttgacgggtggggcattctgtagatatcttttaggtccagctggtctagtgttaaatttaagtccagagtttcttttgttagttttctgccttgatgacctaacactgtcagtggggtgttgaagtcccccactcttattgtgtgattgtctaagttgtttcataagtctggaagtacttgttttatgaatcttggtgttctaatgttgggtgcatatatatttaggatagttaagtcttcctgttgaattgaaccctttatcattatgtaataccttcctttgtccttttgtgtggaggtaatttttctgattctgtccccagattattgaaagcatatctcatttgagacttgcttttacttttcctagagtagctatttctgtctcccattctcagtaactattccagtctcgtgaccaaccaccactcctcatatcttagtagacagcctcatcttggttgagaaaataaaggctgttattactctattcctaaaacttgtctgtgtttgagagtatatcttataagttatatataaagtttaatatatacagtcatgtgctacataatgacattttggtgaacagtgaattatgtagatggtggtgaggccataagattataattgagctgaaaaattcctatggcccactgatattgtagccattgtaacttgttagcacaatgcattactcatgtgtttatggtgatgttgatgtaacctactgtactaccagttgtataaaagtctagcacatatgattatgtatagtgtataatactgataataaatgactatgttactgatgtatgtatttactatacttttacatcagtattttataacattactcttctacttattttatgaataagttactgtaaaacagcctcaggca

SEQ ID NO: 74078 - DNA, 1032 bp, Homo sapiens
ttcattagactggaatactctggtcagatttttcccatggctcgctccattatttcaggtattatctaaaacattttcctagtatggctcttttcttggaccaccctacctaaaacacctacctttccttccagagtgattctaccattcagcatcctccttactgcattttattttttatttatagcacttctcactatctgaccttatattatgtattttttttattgcccccttcactaaaacatgactcctgtgaaggcagacaccttacctcttttgttcattgctgtgtttactatcctggcagtaccagaatagtgccaggatagtaagtgcttaataaatgttgaatgaataaacataattctggaaaagcagggatggaggggtgacttgtaggtattagagggatgttaaacattttttatgcattcactcctccagcctcatacccttgttttggaatatgcttttccacatgatggaagcaggcaatattcagaaggaactggagaagatattgaaatactggaaacaaaaatctgcatgaacatcttttaaaagtcaagtttaaatcagaacactgtctgcccaggatagtgcagtggattctatgtgtccttaaactatccaaaatttgtgtgtcacactggtctctatttttaagttatgcacaaaagttgaccaatgacaagaaggccatggaagatgtattagttaccaattgctctgtaacgaatcaccccacagtgtagtagtttaagaagcatacatttattatctcatagcttctgcagttcaggaatctggaaggcttagccatgtactcagcttctggatttctcacaggctgtaagcaaggtgttggccagggctgtagctatctcagggcttgactggggaagcacacacttttaagctcactcatgtggctgttggcaggatcagtttcttgtgggctgttggctagagacataagttcatgctggctgttggtcagcagccacccccagttctttgacacatggg

SEQ ID NO: 74079 - DNA, 1466 bp, Homo sapiens
cgcaggctgggcccggcgggcggcggccgcgcagcccacgtgtgaggcggcccgcggctcccggtcgtgcccccgggcttttccggccattgctgccgcggcgcctggcaccagttacctccccgccgccgctcgcacccacgtgcggccgctcccgacgcgcccccgtccaggtgtggggtgccgggcgggcccggggccccaacttcgctggccaccccgcttcccagctccccgcttgcccctttcccgctttctcccagtgggagcccccactgcccttccagccgctgtctccacccagcctagcgctgtgggtctcccaaaccctggctgctacctgacccgtcacgcctgcttctacccctgctcatctcccacaccgtctgtccctctctttttaaatatgtgccctgccttgtccctactgcctttttccatttagttctttctcattctagttcctaacatcagaagccagatttccctaccccctcccacctccagttttgtgaagttgcctttagggtttctttctatgcagtttccaccttactctgggcttataatacacttactctgctcttcagacaaattttctttgctctctagagaatcgtgggataaatgggatgtagtgggacttccgttgtttaactgggccagtaccatatgtttaagtcttcaacttcattaaatctaaccgtaatctctttttttcaaaccacctcttgttcctggcctccaaaatgtggagagactttcaagtgacagtattttaaatatatctgtaagctcatttaccaagttcactagaagactgatgttacattttcagcgttgagaccacgattcttgtgggatacttccaggggagggagaaactttccagtttcttagctgaccgccaaacttggttatatatggggtttttgcaaccatgcgattgtagagtttcataagattaagtgaaggatgttcagccagatatttttaaataacaaaaattaattttacatatagccaatgaaattgactgcaagtcctcttctgaactcaggcctgaagacttttccaggtgtctttgaaacgacggtggtaatcgttgttttgaatagatggtggatatgctggttacacttaggggttttatattaagtgaagtaaacacacccaaaattcggttctatgtgaaaaagcattttctactattcacttcattaagtttttatttattatacatgtaatacatgttcagggtaaaaattcaaacagtgaatcgtttcttatcccgtttcccaaaggtgaccgcttgtgtcgtgaatcttcgctgaaaatttaacatacacattcattttttacttaatgggcttataatactatttacactattttgcaacttgaatttttcactctatatttcacattgcctcataagtgaggttttggtcagctatagattatac

SEQ ID NO: 74080 - DNA, 1029 bp, Homo sapiens
atggattttattttcttactaaggttctccatacagaatttgttcctcattgactctaatagagaatttcattgagtgttttttgtagagacagggtcttgctgtgttgcccaggctggtcttgaactcctggcctcaagtgatcctcccatctcccaaagtgttggaattacaggcatgagccaccacacccagcccattgttgagatttcaatagacagaggataacattgaaaaatatacctgattgttgaggaaccagggtgttaatagataaaagtcatgtgtcccctcttttacttttcctcatacaaggtaggctcactataaatatttatggaatgagatgagtacatatgagcatttcttcttcgtgggcagggaagaggcggaggagaagtctttgcattgtgtaaattgtataaggtggaatcaaatcaaattgaaattttgtttgccacaactgataacattcactgaacctaactggactagtgctaggaatagtattagaaacagtctttataattcttatacactaatatgctacgtacttagatacaaagataaaaagttaccatccctgtctgtgtggaacttagactgtttaaccattatccttgaccattgtgatggtattgatgtaatactatatttggattaccacagtggaacatatcacatggagagaaccctctctcaacagacatcatctgtcactcgtactaaactctcccaccattggcttctaattcattatggagtagagtttaatatttggcccaatgttaagttgggtcaattgttaagtctactagagttagcatagtcacaccaacagttccgcctgggcaagagtagggagcctcaggatttatattaggttttctgacagtgatagcctagtagagaagtttatggctgggcgcggtggctcatgactgtaatcccagcactttgggaggccgaggcaggtggatcacgaggtcgggagttcaagaccagcctggccaagatggtgaaatccca

SEQ ID NO: 74081 - DNA, 1016 bp, Homo sapiens
ggttctaagcagtggtaatttgaaccagttgtacatcatccagtctaaaaatgttaacgaaacagtttctcatgatgtaaggtgattttaagtgagccctaaagtttgcagcacaatggcttaagtcacatttggcaattttttggccctcttaggccttgagttttgttaaccagggagcataagttgggaaaacatgcacacacattagaaacatttgtttaagagatatatgtagaaaggaacttgataagtaaccctttggacatctcttccctaacatatctgaagtgtatttcatgtcacagaaggtgttaacaccagacctagattaaataatttctcatgcatccttcccactgtttatttctttcactggtttactcatgaagtttcctaacattctttcctaaccatttttttttttccatgcaggaaacctatgagaatatcccaggccagtcaaagatcacattcctcttacaagccatcagaaatacaacagctgctgaagaggtactaccttaatatttgtgactattacattcttagaaaataagttattagatgatgatcatagtagaaattagagaaatgagaattgtgattaaccacatagactttactagaactttgtacttattatttgctaaaagctacttaggagttataatgtaattttttgaagtactttgtattaagaatgagagttgccttttttccgcataagataatgtgtccagggtagatgaagattaatggttttataagtaattgcataagaattattaaattaaagtgatttgatttgattgattgattttgagatggagtttcactctgcccaggcttgagtgcactggcaccatctcggcccactgcaacctctgcctcctgggttcaagcagttctcctgcctcagcttcccgagtaactgggattacaggcgtgcgccaccacacctggctaatttttgtatttttagtagagatggggttttgccatgttggccaggc

SEQ ID NO: 74082 - DNA, 4676 bp, Homo sapiens
gcactttttaggtatcgggaactcgtaatgtttgtttgcatgaaagaagcattttatctaagatgctaatgaaagggcggttatgtaacaagttaggtcaggctgggagcctaaggttgggtgggaaaggcgcttgatattctagaatgagaccagacagagaggtaggaaaagagcattcattatagggtttacaatttaagatttgtttttctcccaaataatgtgttaaaaacagggattaaagacaggtttatcattgctaaaatatgtgttcctaattgaattgtaatgtgattagaagttctcctcaccttaagtacaaatggcttattttgtggcactaacaaaataagtctgtataatagactaatgtaattagaaagagttatatatttacttctttagaaaattaggcgcttttgaaatataaaaatacaacagtgaaatacatcaatggcagagtgaatctagttattaacaatgttatctgtttataggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaataggtgtgtatgcaggtgcactcatgttaccaagaacatgggtatatccttccttttttttttttttaatggaatcttttagagtaagattcataagtacctgagtaccatttattctgtttaaaatgaatgtgcttatggattttgcatttagagccagaaattacagatagatgtttgtgaaatccagtcataggactcacctattggtattcaaaatacccatgtgaggctaggcacagtggctcacacctgtaatctcagcactttaggaggccgaggtgggcacatcgcttgagtctagcagttcaggacgaacctgggcaacatggcaaaaccccgtttctacaaaaaattagtgggcgtgatggtgtgcacctgtagtcccagttacttgggaggctgaaatgggagaatcacctgagccccagaagctggagactacagtaagcggtgatcacgctactgcactccagcctgggcaacaaagcaagactatgtctcaaaaaaaggaaaaaaaaaatccatgtggaaaaataattttgtaatttgcttgaaaattggcagttacattttctcctaaatctataatgttttagaagcacaggctaattaatggtatgacctactttgtacattaaacttgccagttgaactaaaaatcagagactccagtgcttttgctgttgtatatgtgtggtgacaaatatatacatatactgttacgtagctatactatgtatatatatattttttttttttgagacggagtttcgctcttattgcctaggctggagtgcagtggtgcaatcttggctcaccgcaacctccgcctcccaggttcaagtgattttcctgcctcagcctaccaagtatctggaattacaggcatgcgccaccacacccagctaattttttttgtatttttagggtttctccatgttggtcaggctggtctggaactcctggcctcaggtgatctgcccatctcggcctcccaaagtgatgggattacaggcatgagccactgcgcctggcctactatgtacatttttaatgcccaaaaaatatttttttaagtgaggtaaaaggcaaacatcataaaaaaatgcattttactaaaggtaaaaatcctttttagtcaactaaaaataatagtaatgtaattgaacatgctacttttttatcttgctgcaaaaagctttatttccatttggtctagtgcctgggagagggctccagcttggttaaaaagctacctaatggctggagggagagggtcaggcagaagctctgatacattgagggggaccctcagaggtcactgggcttttagtgttgtttgatgatgagccttttgaagagacacttgcccagctcaacataggagccaactagcctgcggaggttggtcacgtggtcacccatcttaatgagtttcacttcctcatctaggaagtggctctccaagaagtcacagagatggggatctgtgcaggcagaacccagggcatgaagatccaacagggcctggttcctggtacaagttcttctccagggccatgacagcttccatggtgtcttgggttttgtcccactcatcttcatacttcctgctcgtagaagagagtgtagccaccactttttttttttttttagacagggatttataagtgtggttgtaagcgcagcttgtttagatggcatttttaatagttgaaatgaagatcaaggttacatgggagattactattgattgagcttactacattatgacactaattttaaaatctcatcaaccagtaatacagtaagtccttgttcaattcagctagcagattgtatcctttcttatgtcaaccatttcttagaaactaatggggaatgtgtcaattctttatattttagatgagttcaaattaatttttttagacagttttgttctgttgcccaggcttgagtacagtggtgtgatcatggcttaccgcagcctccacctcccaagtttaggtgattctcctgcctcagcctcccacacgcccagctaatttttgtatttttttagtagagatggagccaactgggtttcaccctgtttgccagcctggtctcaaatgcctgacctcaaatggtctgcccaccttggcctcccaaagtgctgagattagaggcatgagccacagcgcccagccctaattttgaatatttttaaattgtttagaaaattctactttccagttttaagtatgcagataggaattgttataggtgacatcatttctcattcagaaacacttaacaatgcaaacctttccaaagtattcaaagtgctctcatagattttttttttttaagctgctattttatttcccctcaaagcatcatctttaggttgaagaaacatttaatgtcagcttagcagcacaattgtcatttcacaaaagttcaaatatcgggggacgtttaaaaagaaaacatctgtaattcatctgtaagttgtataactcttaaggtctttgtgacaatataaccagagtcttataagtggcacagtagatttttgtggtcactcatttttattataaagtattatttaaaatctcttaatcttgttaaatagtaaacatattaataacatcctctggcactatttgaaccaaactgcaaagtgtgagcaccctgtatgggtcctgagattctaaccctgatgtcttctcaagttccaaagtagttgttactttggtttcaagaccttgccaccaaatactagctttgcctactttttcaactctttaatagcaatggtatatataaaggagtcagtcaatcagatatttgtacagttaaaagtgctgccttctcttcaaattccactccttagaaataacctctgccagccaggtgcggtggctcacgcctgtaatcctagtactttggaaggccaaggcaagtggatcacccaaggtcaggagtttgagaccagcctggccatcatggccaaacctcgtctctactaaaaatacaaaaattagtcaggcatggtggcaggcgcctgtaatcccagctactcgggaggctgaggcaggagaattgcttgaaccctggaggcagaggttgcagtcaaccgagatcgcgccattgcactccagcctgggtaaaaaagtgaaactccatctaaaaaaaagaagaacctctgttaatatctgattatctaacccaaatacagagttgtttggtttgttggtttgtttggtctttttttttttttaacatgattgtgatgccatttttatggctaaaggacagaattttgtggagtttttaaaaatagcaaaagtgacatttttcactactccaggtttgaatgaggcttatgaaatgaaaggatttactcctagtatattgaagttctgacttacacaactttatgtctggatttctttactttcagatgaggatggcaataaccagtggcccgaaggtttgaagttcctttttgattcagtcagctctcaaaatgtgggactgcgggaagctgcccttcacattttctggtatatacattaatctagttttttgagacatttgatttaatgaatgccctaaacaccttttaactgattattttagcctaatttaaccttatacttaaaatgataataatgcctttacataagttttgtttgtatttgtattggaagcaattttttttaaaagggccttttatttcacattatgatcttttttgtacacaaaggttctctacagcttgcttgctttctctttgtcttttatgattctgaaagttttattgaacagtttcctctcctttatttggagattaacacaatactggatgtagcttttcaaaagccacattaataatggtgtcttgaagaggagaaggagaatgcaggtgaatccccattatgttttctgggtcttgtgtgacccaattttataatatgttaagaaacctgtatatt

SEQ ID NO: 74083 - DNA, 1026 bp, Homo sapiens
tcacttaacccaaaaacaggattgcttagagaatgggtagatgatgttcaacctatggattaatgcgtactgagtcaggtaaacaaacagttcattagagattctagctcatactttaccaagatattaatataatgtagtttttaaagaatgtttggattatcttttaggaactttcctggaatttttgggaaccagcaacaacactatttagatgtcatcaaacgaatgttagttcagtgtatgcaagatcaggaacacccgtcggtaaataatttcaatcctattaatataaccatctattttaatctaatttgcgaaagaaattagtatattaggaggttgttttcacttttatactttaaaatacaaacaccagttttactgataaagaataatttgatcttgagtaagaaaacttgaatttgcgtttatcaaaaatttctcatgtttgacattttttcctcttgattttagatcaggacgttatctgctagagctacagctgcatttatacttgcaaatgagcataatgttgctctgttcaaacattttgcagacttgctaccgggattcctacaggtatgaaagcaatatagaataaatcataattatatcttatttggttctttaatgcattcaatcatttatgcaataaattcatattgcctattatgttctggcgctaggcatacagcagtgaacaaaacatgcaaatctcagtctccattaagcttatgtttactgcctttgaaagacatttttagtctcttacaatatttatagttataaaatttttctgtaatgtaaatgttgtaagcaattatatgcttattgttgaatttatggtcatgtagattatttccattaaatcaaccaaataacctgtgagatttaatgcccattttacataaggagaaactactcttaattacagggtgtgtaatagtttgtattataatgtaagtttatggttaattcacattatcgttaaggatgttaatttttaagaatactttctgcttt

SEQ ID NO: 74084 - DNA, 1050 bp, Homo sapiens
atagtttcactgattttcattttgacttagatgtaaatctgttttgaatgtttctagttaacatccatcagaaggaaggtatacatgtgcctgcaggtagaacatttgcataatatagattgctaaattatttagtgaaaaatagtttagtaatatttctctattgtcagcatcttaggaatcttttggctaatgaggcattataaagtgaatcttcagcaccgactttctgtttcatcttttctaggcggtaaatgactcgtgctaccagaatgatgattctgtcctaaaatccctcgttgagattgcagatactgttccaaagtatttgcgtcctcacttggaagcaactctacagctaagtctaaaggtaaattaagtacgttagtaaacgttctgtttgttattttcagggactaatctaaattattaaatgtatacaaatatgtcttctttgtagttgtgtggagacactagcctcaacaatatgcaacgccagcttgcccttgaagtgatcgtcaccctctctgagactgcagctgctatgttaagaaaacataccaatattgttgcacagactagtaagtcaatggtcttcagatagtttatgtgtattgtggccaaatttttggataaatttgctgagggttgtgtgatttctcagattgttgagaatataatgaatatccttttagaatcagatgaatttgggaaaatgcatctcaatacatgcaagcgtggacccccacattgtggttatgcctttaagactttgcagacaccctgaaatctggtgttaaaaataacatttctagagtggagtgtgacagactctatcatttatatgttaatattgggcacagttaatagagtcaaaaacaattcagcggggatatatagatgcacagtagcgaactacaaaccaaaatagcatgtcttgcttaccagtgaagccaagattagaagaacaaggtctaacactagtcatggctctgttcactatattacattgcttttgttttatagaccctcgttgcagcagaaacttaa

SEQ ID NO: 74085 - DNA, 1037 bp, Homo sapiens
aagtaatgcttaatagtagataattttctaagactgaatcacaaaccattgatgtaaacattgccaaattggcaaatgcgaaaacaattttttgaccaatcagatacaccataaatgaactgaaaaaataagccacaaactggaagaaaataattacagtgcacacaatcaacagttttgttatctagagaatacacaaaggctgagaagaggaaattcattgcttttttcttctttaagatggggtcttgctctgtcatccaggctagagtgcagtgacatgatctcagctcactgcagcctcccaagtagctgggactacaggcacgcactaccacacctggctaatttttgtgttttttggtagagatagggttttaccatgttgcccaggctggtcttgaactcctgggctcaagggatcctcccacctaagcctcccgaagtgctgggataacaggtgtgcaccagcaggcccagtcaggaaattcgtaaaagagggatctgaaatagctaatgaaccctgctaagtctcaataaaaacaagtgtaattgtggaatacaagttgtccagaagtttgacagtatcaattgttaataaaagatgtggaactgagaggacgcttattccacccccagggcacttcacacatttttgtgaaataacggagacctccacttaaacttcacatagtttatgcaacagctgtgcagagcgcagcttgtttggtaattttctttttttctttttttagacagagtctcgctctgtcgtccaggctggagtgcagtggtgtgatcttggctcacagcgagctccacctcccaggttcacgccattctcctgcctaagcctcctgagtagctaggactacaggtgctcgccaccacacccggctaatttttttgtttttggggtttcaccatgttagccaggatggtctcgatcttctgacctcgtgatccgcctgcctcagcctcccaaagtgctgggattacaggcataagccaccgcgcctagacttgtttgataattt

SEQ ID NO: 74086 - DNA, 1035 bp, Homo sapiens
atcagctagacagtgggtagtatgtttatataatggaatgctattaaataaactgaaatccttatgtgttgagaaaaaagcaaattgccgaggtacatatattatgaaaccatttattatataaaaaatcaaatcttgaaatagtactataattttgtatagagatatggaaatctgtagttcaagtgtgaaaaaacaattgcggaatgagaaacatttgtgatgttgcttcttacctctggtgatggggagaatgtaatcggatttgggaatttcataggagggtttgacttaatgaatgttgctttttaaagaaacgataaaagcaaatataacaaggttaaaatttaacaaaccaggttttgggggcacagacaaataattgttttgtcttgttctcttacaggcaaagtaaaatcttaaaattcttgtttataaatagtgatatggataagataaagtcacagtcttcgggtatgaaataattgtttactttagttcctcagatgttagcaatgatggttgatttggaagaagatgaggactgggcaaatgcagatgaactagaagatgatgattttgacaggtaatcaaacattgtgtccagggtggcagtgaaagccctagggctccacggtccatctcttcactattgcaccctgtaacctgaaggtaaacttttaagcctggaatatggggcactttgccttgctgttgtatttattgctgtgtcacatgttataagtagtattttctttagttttcatgtataatttatattaataaaatttatgtttcttggaagttcataaaaatattttaatagttaatacataaagttgtattttataatcaggaactgaaagatacctacaacaacaaacaaggaagtttttcttttttaaaaaaaagtatgacatgaaaacagcaaataaagtagctatgttttttgtttggttttgagacggagtctcgctgtgtcgcccaggctggagtgcagtggcgcgatctcggctcaccgcaagctccgcctcc

SEQ ID NO: 74087 - DNA, 2934 bp, Homo sapiens
catcacaaagtcaggagatcaagacaatcctggctaacatggtgaaaccccgtctctactaaaactacaaaaaaattagccaggcgtggtggcgggcacctgtagtcccagctactcgggaggctgaggtaggagaatagcatgaagctgggaggcggagcttgcagtgagccgagatcgtgccactgcgctccagcctgggtgacagagcgagactctgtctcaaaaaaaaaaaagaaaaataagaatcaggcatgactttctaaactatggtggatcatgataaaaacatttactcttttttcttttctaagctgcagagtttttaacccctaatttcaattccacatttaaagacagcttgaattctttctcagtcttagtttaataataatatggttagaagtatgtctgtagagtatactatttcttttgtgtttcagatatattgagtacataattctgtttatgtgtttagcaatgcagttgcaggcgagagtgctctagatcgaatggcttgcggacttggtggaaagctcgttctgccgatgatcaaggaacacattatgcaaatgcttcaaaatcgtaagctgtgtccttcaaatgctagaagagtgaagttgtgccctttctaaagcttaaattctaagatatgtttagactgttaaaaattaatctttgtctttttatcatccatatttaacccaattcatttattttaccgataaaattgtcaatcccaaagaaaatgtacagatttacttcctagccaaaagtatttagatttgaatttgaaaatgatgttattatttgaatttttatggaatattagaatgtttgaatcatatactcttctttcacccaatatcttttatttttaaaagaagaaactctatctaatgttatcaaaagagaaaccacttctttctttctgtttttgcccctgacggaggtgatggtggaagcccacctgccctggagggcagctgttgttgttgacacaggatttcgccatgttgcccaggctggtctcaaactcctggcctcaagcagtcctcctgcttcagcctcccagagtgcttagattataggcatgagctaccacacctggccatccttcctttttatttctatgaatatttcagttacctttgtacctgtaatatatatatcaatcccaaagtttattgttgtatgtgttttattttcatttgtgttttttaattataaagttaatgtgttcttttgttaaattaaaattcagaagtattaagttagaaatttgtttgttttttggtggaatctcgctctgttgcccagggtaatgtgatctcagctcaccgcagcctccacccactggattcaagcgattctcctgccctagcctcctgagtagctgggactacaggcacatgccaccacgcccagctatttcgagacagaatcccactctgtcaaacaggctggagtgcagtggtgcaatcttggctcactacaatgttcacctcccagtttcaagcaattctcctgtctctgcctcccaagtagctgggattacaggcatacaccaccacacccagctaatttttgtacttttagtggagatggagtttctccatgttggccaggctggtctcaaactcctaacctcaagtgatccgcccaccctggcctcccaaaatgctgggattacaggcatgagccactgcacccggcctaatttttgtatttttagtagagacggggtttcgccatgttggccaggctggtcttgaactcctgactttaagtgatccacccgcctcaacctcccaaagtgctgggattacaggtgtgagccaccgcgcctggcctgatacatacttttagaatcaagtagtcacgcactttttctgttcatttttctaaaaagtaaatatacaaatgttttgttttttgttttttttgtttgtttgtttctgttttttttttgagacagagtctcgctctttcgcccagaccagagtgcagtggcgcgatctcggctcactgcaagctccgcccccccgggttcacaccattctcctgcctcagcctcccgagtagctgggaatacaggcgcctgccaccgtgcccggctaattttttgtatttttaagtagagacggggtttcaccacgttaaccaggatggtctcgatctcctgaccttgtgatccgcccgcctcagactcccaaagtgctgggattacaggcgcgagccaccgcgcccggcctatacaaatgtttttatattatatatacatatacccttttcaaaaaagttttgttactcttttccaaataagaacttttatacatctccctctaccagaatgacatgtttatagtgtgtaattgctattccatctgtaatttttttcggtagctgactggaaataccggcatgcaggattgatggccttatctgccattggtgaagggtgccaccagcaaatggaaggaattctaaatgagatcgtaaattttgttttactttttctccaggatcctgtaagtaccagtaaatatttgattcaaaatgattagtgtagcttcatgtggaaaccttcttgcttttactaatgaaagggaacattttccagcatccaagagtaaggtatgcagcctgtaatgccgtgggacagatggctacagattttgcacctggtttccaaaagaaatttcatgagaaggtaagtaacaagtcctcaaacacttaaatcagactttaggaagaagggtggacatttcaacatgtgtgcccatttggtttcatttcacaggtgattgcagctctgctgcagaccatggaagaccaaggcaatcaacgtgtgcaggcccatgcagctgctgccctcattaactttactgaagactgtcccaagtcactacttattccatacttggataattt

SEQ ID NO: 74088 - DNA, 1371 bp, Homo sapiens
tcaacccagctgggatgtagtggcgcaatctcggctcactgcaacctctgcctccccagttcaagcaattctccttcctctgcttccggagtaatgggattacaggggtgtgccaccacacctggctaatttttatttatttatttatttatttatttatttatttatttatttagtagagacagggtttcaccatgttggccaggctggttttgaactcctgactcaggtgatccgcctgcctcagcctcccagagtcctgggattacagaagaattattttaaaatattgctggtgacaggacgggcccagcagcaaatagttagtaagcatttgttactagctgggtcagagaacaccagatctttggtgcagagaaaaaggtcatctcatctgtttcagcaagacagatgcaagagaaggcagcagggttccttcgtgcgatcttctggggagagggggttagaagataaaggaaggggccaaagagggaattttctttatgacgtagtaagacagcacaaaatataatcataagtagaggaaatcagtgaagaaaaaaatgaggatgaagtgtaggcattaaagttgatgaacacaaaaattttgattccgtatctgtactcaagaattagctgtgctttgagatgagactaacatgagttagaggtgttgtgttaatagaagagagaaaaaaaaaatctcacataaatagttcaacatagattctttttatagaaatttcctccaaaacctacagtctctgcttctggagaggtggtctcattctgctgtttcagaaaagcattcaagaacttgaagggagtagtaattgtaaatttaaatacttcttccagttttcctttgaggtaataatttgtgtcttccttctagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaagtaagtaattttttttttttttttttttttttttttttttttttgagacagagtctcgctctgtcacccaggctggagtgcagtggcacgatctcggctcactgcaaactctgcctcccaggttcatgccattctcctgcctcagcctcccgagtagctgggactacagacgcccgccaccacgcccggctaattttttgtatttttagtagagacaaggtttcactgtgttagccaggatggtctcaatctcctga

SEQ ID NO: 74089 - DNA, 1458 bp, Homo sapiens
ctggtctttgtgttttgcctcacctgctgtccatatcccagtgtagtgagttcacagggatttcattattgattctgaaccttttaagtacataacctttagaaatgctcttactgcttaaagtactgtgaacatatcaataaaacattgtttctatgaaataaggaaatggctttctttatcacgtttacccattgttttttaatctattttaattttaaaatttttccccagatctcttacatgatctcagcatgggccagaatgtgcaaaatccttggaaaagaatttcagcaataccttccagtggttatggggcctttaatgaagacggcttcaattaagcccgaagtagcccttttagatagtaggtgtctttagaaggagctatcggttataatagttctctctttgttattatttttcatatgcatttgttttcttctccgttaatagcccaagacatggagaatatgagtgatgatgatggttgggaatttgtgaaccttggagatcagcaaagctttggtattaaaactgcaggactagaagaaaaatcaactgcttgccagatgttggtaagagagcactgtttttactaaacttttattttacatcttatatacatttcatatgagtgcttttaatagctgctaaagaaattactttggagagccagtaatatgttccttaaaaagtaaagttttctttccattttaaagaaatcgtatggataaacctttcattatcagtgctgttttaaatagcaaaaaacaacaaatagcccaaattcctgttagtgggaagatgaattactgtgccttggagtaatatacagccattacaaaaagtttataagctacatgagggaaggatttttgttggttttgttcttagtctatagtaggtggccatggaatgttttttaaacaaatgaacagaagtgtgttcatgctatttaatgtgaaacaaaacttgtatgatttcaattgtgtaaaaaaacagatatggcaggaaaatcaaaatgttcggttattatcccttatggtgtttgtggtgtgcatatgcatgtttagttcctagttttctttttgttttctttatgagcatgcgttttaaagtgaaggataatccttttttttttttttttttgaggtggagtctctctttttcacccaggctggagtgcagtggcacgatctcgactcactgcaacctccacctctggcgttcagttgattctcctgcctcagcctcccgagtagctgggattacaggcgcctgccaccacagctggctactttttgtatttttagtagagatgaggtttcaccattttggccaggctggtttccaactcctgacctcaggtgatccgcctgccatgacctgggattacaggcatgagccactgcacctggccaatacttacttttaaagttagattttagaaattaa

SEQ ID NO: 74090 - DNA, 1035 bp, Homo sapiens
tgcccagccatgattttttaaaaatacaaaataacagaagcgttttctacagatttacaaagtaaatgcttcaattaactgatggtttcagggttttttgtatcttttagaatgatttttcctcaattaagtgatacattttgtttgatgtattgctgaaacttgctgaatggaatacgaatgattccagcctttgaagggacaatatatacgacaataatttcctttttttttttctttttgtcactcaccaatactacaatcatttcatgacccttcttttaagactctttttagttggaagactaatttgacagttctacatgcaactttaaatgtagttctagtcaaaatacaacctcctgtggtccttatgattttgctgtttgttaatattaatgcttgaagactaacatgaatctttatttcctcccaatactttggttacaggtttgctatgctaaggagttaaaggaaggctttgtggagtacaccgaacaggttgtcaaactgatggtccctttactgaaattttatttccacgatgatatcctacaacttctgaatacaaaacatgtctagatttagtaaacttgtagtttcttggagtattagacagtgttgactgaagtagacttcaccatgattgtttgtatttgcactaagtgtactcttaggtgataaactcggttctctgcatgtgcctttgtttccacttgtgccaaaacatgaaaaagaaaacgtgacctatcctatgtttgtcagctttctgtggcccacttaaggatttaaggataattagcaaatgattacaattatatatagttgctactttccccaaatatcttttggtaaacgttaagaaaataagacttttattttaagagatggtgtctcactctgtcacctaggctggagtgcagtggcgtgatcaggacgcactgaaaccacaacttcccaagtagctgggacccaggtgcacaacaccaagcccagctagatttgattttttttttttttttttttttttttaag

SEQ ID NO: 74091 - DNA, 1598 bp, Homo sapiens
tgcatggcacgatcttagctcactgcaacctccacctcccaagttcaagcgattcttctgcctcagcctcctgagcagctgggatcacagacatgcgctaccatgcccagctaattttttgtattttttgtttgtttgtttttgtttttaagtagagacgggctttcaccacgttggccaggcaggtctcgaactcctgacctcaggtgatccacccacatctgcgttccaatatctttctcaacataatgatagccgtaattaatattttccagtacatttttatgcctttacacacgagagtggtagacagacacaaacccagatctgtctgactccaaagcccgtttgtcatcattccttttacggtatcctatagtggtatcctttacagaagacagcttttacccaacaaagacttaacttcccaggatgccagaggacaaagcgggattgcttttaagaggaagttatcaagaccttattttataaatgagattagatagggaaaggcaatttaatctttattaaaaactgaaaaggccagcataggaagaggtcctcggtggtctttttcagggaaatacttcagttgcttttattagaaacagatagtacctaaggttttgaggtaggtacagcttaaggcatgctaatggtcatgggtccttccatagtcatttttgtattttggtttacatttgagcaataggcagcccttcactgctgctggactcattcctgccactattacaggtgacagaggagacaggaggtatgtcttttctatttttatacatgctttatatttaacacaagctcttgggtatcttagataaacagaagttgcctagcactccttttagtgcattgaaccctttaacatttaagcaaaataataaacagtcttttgaggttccttaacaatgaaacgtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaaggtgaatatttttctcttaaaaaatatgtataaggttgtatgttcatttattagtcttgctaaaagtaaaaaaaaaaaatttgagacagggtattgctctgtcacccaggctggagtgcagtggcgcaatcgcagctcactgcaacctccacctcctgggttcaagcaattctcatgcctcatccttccaagtagttgggattataggcatgcaccaccacacctggctactttttgtatttttagtagatgttcctcaggtctcaaactcctggcctcaggtgatccacctcggcctcccagagtgctgggattgcagatgtaaggcagctaaataaatttttatatgctatagtgtatgatttgttaaaaaataaaaatgttaaattttttgttttaatattttggtattattatgtttgttttaaagagggtaaatttgccttggaagggcagtataggtagagggaatgatatgggcagcagcatggaa

SEQ ID NO: 74092 - DNA, 1188 bp, Homo sapiens
atgtccttatttacactcctgtaattcagaattgcttctgattttccaaagacagcatgcttccatacctttgcctatattttatttcttctacctctaatgcccttccttcagtgttcttgtatgttgtgtgtacggagtatggatatagcaattgtgttccttaggagctggttgtgtgtgtgtgtgtgtgtgtgtgtgtgttttccatctttgaatcctcagtaccaagcatgatgcctggcacctaggtatgctcagtagtgttcaaaagaaaatatttttttctaactccaatctctaaaatgctgtcattctaacaaatacaagctaagcatatgtaaataatcttccaggatactgaactgtgttcatttttccatatgattcttagtggagtttaactttggactccaaacaccccaaatcttatggattgctttctttcctcaacctcattagtgcattgaagtaatgggagatggatgccttaataatgaacactttgaagaactgggaggtatattgaaagcaaagcttgaagaacattttaaaaatcaagaattacgacaaggtaagttttccatgcttttatttctgaatataatccttgaccatcttggcaatcatttaaaacatttatttgggtgtgttttagttaaaagacaagatgaagactatgatgaacaggtcgaagagtcactacaagatgaggtaagttattccctttggaacttacttacgtgaccacttgcatctgaaagacttgtaaatgcctcaatttctgatttatgtgacttgtcattctgatgtaattatcagtctttagcagaggagtcagatatatttcctctcttaatttatgaataagtaatttgaaattaaactgatatgtctttcggtgctatgtgcattttgttgtaatacctcactcaacaaaacaccttgaggtttacctagttcatttacatactgctcacaacaaccatttgtattttgtggtgctttcactatattaaagatgagtaacctaaaattccagtgttaaatgattgcctagagtcacactgttgacggtctggggcctttttcaccatgttacttagttctctcatcaaaccacctaggactgtcaagcatacttcattgtgtgtttagagtccagcatctcatatgtggccacttggt

SEQ ID NO: 74093 - DNA, 1020 bp, Homo sapiens
ttttattgtattaagtagtgcagtacattttttaaaagattcgggcacacatgacttagcctgttgaataaatgctataagttaagatctttgcagcttttattattattgtatttttttaatgtagcattaccattgtcttttttacaaagtaaatttatatacaatgcttccactgtcagttcttctgtgtgatagtgtcagattgtagagttctgtaacaaatcatacaagtctttgaaacctaaattttattaaatctgtgtatttgattgaatatcgttggtcacaagaagtggttgttactatgttttcttttttcttttgcctgtatgaggaatatcaatgtaagcagatagtctatagtgaatatttctttacattctttgtgtacaccagtatttgaagcttaaaagagaatttcttttgtagtgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacaggtacgtttgcttattccgttacgtgcatttcattccagacatcctgtgaatccctactttactctctttaccacactcccaaacattatttgcctatttctgctgtagtctgttttcagacatctcatctgtagcatttaggattttagatgataaaaagatgatttattctcatagaaatagaatcaaagacatcccctgcccccagccttccagggtgcatttctctttgcgttttggcaatatacaacagccttagaataggacttttttttttttctttaattgaggcccaggctggagtgcagtggcatgatctcggctcactgcaacctccgcctcccgggttcgagcaattctgcttcagc

SEQ ID NO: 74094 - DNA, 1114 bp, Homo sapiens
atcggcccacctcagcctcccaaagtgctgagattacaggcgtgagccaccacacctggcagaataggacttttaaaacttactggggaatatagttaggcagcttttaaagtttaaggaccctcgggtgatgtgatgagtactgtaaatctggaggccactaatctctctgggtctctaagttagtagagggctagtgctcctgtccatgctggggcagtcccccctctgttgccattctgtaatgacatagccaagaagacaacacttcccatacactttaacatttctttaccataatcaatatctgaaccaaatacaaaaatacatatattcatttgcatgaaaatgtgaggttttagctgaacttctttcaaatgcttattttagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaaggtaggaaagcagactgtgaccttatttccttctcctccacagtgcttcctggtttttcttgcctaacatcagtcttttaaggtttaaccacatgatctctgcacagtcctcagttgtataggtttataatagtgctgtctttataaatcatattaagaaaccatatcacagttaacattgcccttataataaggtctaattttgagttattctttatgaaattagattcaacagatgaggcactttaattatttatttctttgtttttaaatttttttggtagcgacaaggtcttaactgttttgcacaggcaggtcgcaaactcttggcctcaagagatcctcccacctcagcctcccaaagtgctgggattacaggcatgagccaccaaacccagcctaagggaatgttgtttagtgtctgttttctaagtccaagttccccccaaatatcagtcagatctaagctctgtcgctattattatttttaggttat

SEQ ID NO: 74095 - DNA, 2360 bp, Homo sapiens
agtgaacacataatcatatttctccttataaatttcacttactaaggttttcttctcatttgtcagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacaggtaagctgatttggttgaattggggagggggagataaaacctttttttctttgtagtcctctatgagaagaaactagaaatctaatgagctaaggaattttatttttatattttcatagtctcttgtctccaagcctcaaatggattatacttaatgtaatccatccgtatgtacttattatttattagaattaaaaccttcatcttaggacattttgagcttaccagttggtgcttaacacaagcttatgtgtagtttttctgcctatcttaagaaaaaaaaacaagatttaataataacttgtcatctgccaaaaaactttatatgatttttacttcctatattcatgtggtatatgggttactttaagatgttacctgcttagtgtagctttttcagtgcaaaaatgaagaaaacttactggaaatgaaatgaactttaaaaaaatgaacagatttcttgcttttacaatgatactcatcaaaataatgtacctagggagaaggtattttgccatgattacagtttacctatgatgatgattaaaatccttccaaatgagcatttcgtcctaagtctgtgaaaatgtttctttccctagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatac

SEQ ID NO: 74096 - DNA, 1113 bp, Homo sapiens
catcctcaccccgaacacattgatcaaaatcccaccaactgccaggcctctcccaggcttgtgctccaggccagccttctctcctgacagtgctgatagctcacctccaatcagaccttgaatcatggtctctaatcttgcccctcgcactcattattcctggtgcagtgactcagttttttaatctgcaaaattaggcactggggcctgatgatgttaaaggctacccccaacccctttccttctttggaagtgaggaccctgtgttgacatgctccttgacaaattaactttttgtgactgtatttgtgaattctccagacagatggtaaaatctttgaggaaagaggtttttaatcttagagcaaaccttgaggcccccaaagcctgattagacacagtgggtaccgtgtgtctactgttaaagaaagctatgtgatgagagtgaagaagcatgccacgatttatatgtcccatgccagttgcgggccgcaggaaatgttgtgattggccttatgtgcgtgtggggtggctgttttcataaaactcactgcactccatgctgcactccaggctgaactctatgctgtttgaccatgggaaatggaagacggaaagaaatattttcttgataatacattattagtagaaaattcaagtttaagttgaaatcagagaagacctaaagtttttgagaaaagtaatgagtttgtatgtcataaaagaccacgtaggttcttttctggtgtcagaatcgcctgtgctatcttggagacctaattaggagtgttacaaattcagtcccatacatgattaaacattgatttcatttcattattataccttttgaaatgtaacagttctttcattcctttaattttcactgaaacctaggtttgagatcaatagggagcttattctctgagagctctggttcagagtaaggtgtccactggtgacagattctagagctggctccataagctccatctcagaaaaagggacggagccgaagtttgtcttttcagaaagctcagggtttcctctttgtggccctgcagttgacatcaggagctgggcttgtgctcattggtagcaactgtgcctttatgg

SEQ ID NO: 74097 - DNA, 1443 bp, Homo sapiens
ggatcaatgggagaaaagaaagcgaatgaaagcacttaagaataaaaaatcatgtgcttctgtcagatggagtcattcctcttagaccacagctgcctgtgtagtctcacatcaaactggggctttctttggaggggaatcattacctaagccaaagctgtgtcccaaggggccttttggaaggtctataagaaccaagcaccacttggacaattgccgtgaaacctccatttctgccaagctcgtttactgcgtttttgtggacttacgtgcagcttctgtgagcttcagtttaatcaacttgaaaattgagggggttgcactttgcgctcagaaattttacgtgcatttttgctttcctgatttcttgatctcctctattttcttagcttcaaaacttttccattttcctagagtcaggatgttcctgggtgaatcatgtgtccctctaccatggactggatgaatggttttaaggtagacataggatttcaagatcctctagggtaggtcttctcaatatgggctctgtgggttcatttgaaggaagtgctcagtcagctggatgctcttgtgttagaatgtaaatataaaaacattgcacatattaaatggactgattttaaaaaactatctgccatgtttgaatgttcaattatttgctgtcttctatcactttgagcatttgagctggaggtaatgattttaactcataagacagacacagaatgacttagtttgggatttctcttctgtagatagaatgatcatgtaaaagagcagttctcaaagctgttagcactttgtaactttgaaggagagcctcataggtctctgtttcctcatttatacaaacaggaagttggaccagatacccacagtggaattctgtggctctggttttattttatggaatgtggtcttggaaacatgatacgggtttcacaaatgtgtatcaacatggaaggcaaggtgctactggtgataagaaaatgaataaaaacaataactaccctctgaaaaatcccttgctgtgtgccagacattgtgccaagtctgcccgtacattatctcatttgttgctaagtgaacctgtgaggcaggtgagaataacaccgattagtctcacagggcataagtgacttggcgcgggtcagagtgctggagagaaggagctggagtcccagcccaggaccacatacacctaagcctgtgtgtcactcactttgttaatggtctggggccataaagagccgttaggataatacaacatgttggctgtgctagtgcctgtgacaggtgccagtggagggtgctttttttttttgttttttgagacggagtcttgctctgttgctaggctggagtgcagtggaatgatctccgctcactgcaacctccgcctcccgggttcaagtgattctcctgcctcagcctccccag

SEQ ID NO: 74098 - DNA, 1474 bp, Homo sapiens
agttttgctcttgtggcccaggcttgagtgcaatggcacaatcttggcttactgcaacctctgcctcccaggttcaagtgattttcctgcctcagcctcccaagtagctgggattacaggtactcgtcaccacgcccagctaatttctttgtatttttagtaaagatggggtttcgccatgttagccaggctggtcttgaacttctgacctcaggcgatctgcccactttggcctcccaaagtgctgggattacaggcatgagccaccgtgcccggctttttttgtttggttggtttttttttttttttttttttgcttaactaatgaatctttaggggcctgttgtttttaattcacttagtctcactttaccaccatgtaaactacagtttggtatacagtcacttcagattttatttacttttgttttgaaggagaactgctggtatttataggaaaagatttctgtcagaagtagttttcagattttcatgctaggagtgtagatttcataaatgggcaccaatgtgcctagttaataatgtatgcaaagatcatctccttacagattccaggcatgcctcatcttattgctctttgctttatttgcctttgcagatattgcgttttttacaagttgaaggttggtggcaattctgcatttcgcatgtctattggccccatttttccaacagcatgtgcttatttcatgtctctgtgttagcattttttagcaataaagtatttttaaggtatgcacactgtttttaaagacatgctgttgcacacttactagactacagtatggtgtaaacattttttttatgcactgggaaaccaaaaaatttgtgtgactcattttattgaaatatttgctttattgcggtggtctggaaccaaactcatagtatctccaaggtatgcctagatatctgttctgagaaagctgcggtttgaaacttcatattgagtgaatgatgatttcaatactactgtctgatttttcccagaaatcaatctctaatggtttccctattgacagaagatcaagtgaggaccctgtgaaggcctttcatggtatctgttgtcatttaggaggctcagaagttcaagggcctttgtctgcaggctggtgtgttcttctgggccccaggccctcaggctttgaggctgtaagcgagcacttgcctgggggtaactatccagctcagtgggtaggtttttccaaggcatggatggttgacagcttggcagagcatctcatccagaccatctcactttttccatttgtatagaattctctgttaaaacaaaggtgttgtctaatgttaagagggagtggtgttaataaataacatcttcctctcctgagttcagaactaattaagaaagaggcatgatatccatggctagtcacagtgtccaccctgttactgatgaatgctggaccttgatgcctgtcagccaggctgg

SEQ ID NO: 74099 - DNA, 1086 bp, Homo sapiens
caagcttctatgcatgtgaagaaatttgaattctcagggggaaactgaaaagctctggaaatcacgtactgctcaattcaattcagaaggtgtgagttcctaaggagcattttcacttcctttcaaacttaaaaaattgtggtccaaggaatgacatgggattctgactttttatgacccatgctaactgatttggtgacttctgccagtgcaggaggctcggattttcccctgaaagagcgccctgctcatctcagaaaggttcaggctgtcgggtccattccgcaaggactcgcttcatgtatttcctttacaagtcagaaatggaaaaagaggaaattaccatcccacatcttttcttgatgtgtatgaatgcgtctgcctccaactctgagggtttcttctccaatcaggaaaaagttgacatttgccaccaagtcagtacgcttctaagctttcattttatttcatcaggactgactgagcgtcagcattctggccgagtcctgcagttttacccactgtgcaggtcagcgttttcttcaaggactctggccctggcttgctggcatcctcagagtgtctggatgttacccaggggcttcctctcacctcaccttcattcttgttccttgttcttagatggatgggaggttcagttgttggaaactaccagttagactaagaaagctggacttctttcatactccttaaggcaagtagggtataagtaagtggcctgttggctgatctcaaacatgagagagcattaggttcattaataatattctgactttttcttatctaagccagtttactgattaagaaatcatctggtgaaattaatctcaaatatttttaaatgctcaaagaacatattgcttcagcttcattaaatacttgtctaaacacctggaaaaaatttccacctccgtttcacaatactttgtgtagtgaaacctgatggagtgatagtgtgttagttattatggaaatattgtggacaattcacaagcagagtgtttgttccataaaattaaacctgaaatatgtttgcttgctcttaagttagaagtattgacaagc

SEQ ID NO: 74100 - DNA, 1010 bp, Homo sapiens
aagttcaattcactgttgactttttcaagaggagtattaaatttttactccctgctgtacatgtggaatttcagtgtaattttaagccaaattctttaaaatatgtgaaactcatagtgctattacaaaataattacaaaggaagcaagttttctcccctgagcatcttatttctagatttttttttttcctaagcaatctcttgaaaaggaatatcagtgagcagatttctctggggccatttgaacttcattaaaatttcagagagggcttttcaatgagaatatattcatgtaagcactggagagttttgcataattttaaagttgaacagaattgggtacaattagtgatgaaaatacagtccatcccagattcctagctgattgccattttggttttcccagcaaacaccctttctaccccacttcctagctttattgagatatatctggtatataaaaaattgtacataactaatgtatacaatttggtgagtttggatataagtataggctggtgttaccatcacccagtcaaggtaataaacatatccatcacttccaaaactttgctgtgtctctttattgttactgttttttaaaaaacaacaacaaaaagcgccttttcaagggagtagcatttgctctcctctcttcccagatggtgtcctcatcctccttcctcaaagccaccggctcctcctggacgggttgggtactgagatgctccatgaagcccaagcaccattcacatctaattgagaagtttggagaggacagaattctcactcatcttacaggctctatttcttacacaaactgggctggaagtagaagcttagcggtcacagtcactgaagagcttcttaatcttttttgagtcaggacttgaagtcctgtttcattatttcattcaaagaaattgattggcaatggccagagttaaattcaaaggtgacattaacacatttcagtgcccaataagtgatttttctgctgggtaggagt

SEQ ID NO: 74101 - DNA, 1080 bp, Homo sapiens
acggagtctcgctgtcacccaggctggagtgcagtggcgcaatctcggctcactgcaggctccgccccctggggttcacgccattctcctgcctcagcctcccgagtagctaggactacaggcgcccgccacctcgcccggctaattttttgtatttttagtagagacggggtttcaccgtgttagccaggatggtctcgatctcctgacctcgtgatccccgcctcggcctcccaaagtgctgggattacaggcgtgagccaccgcgcccagccccgagataaattcttaattctcatctgtagatcagcaaaaataagcttagtcttctgattcttgtaacttaaaaaaaaattagagtctatagtttttgtctaggaaacatggttgtcagttttcattgttagagtctcaaaataagtggtgtgtgtgtgcttgcttgtgtgcctgtgtgtttgtgagtgttgtgtgtgtgtgtttacatactatactccctccttctcctctggggataatctaaaaagctcaaagttcttagtcctgggtactgaaacaatgctataagggaggcatttagaaaagcttaattttaaccaggtacttacaccacaaacagaatgacatcactaagcacacagcacgttagtgaacagtggctttgtcagagctttctacccagagccctgaaatggaacattgttaattagctttaaaaaatccagctgttccttgagcccatggattctgcctgtgcacttcctgcatacaaccgtctacacagaaccgagggctggaactcctgtgtttaagaaggcagctgttccttggcggggcacagttgctcacgcctgtaatcccagcactttgggaggccaaggtggacggatcacctgaggtcaggggttcaagacccagcctggccaacatggtgaaaccacgtctctactaaaaatacaaaagttaactgggcgtgatggcgcatgcctgtaacccgcatgcctgtaatcccagctattcgggaggctgaggcagaagaatcactggaacccaggaggcggaggttgcagtgagctgagatcg

SEQ ID NO: 74102 - DNA, 1107 bp, Homo sapiens
cagaaggaggcctcttcacaaagtgaatgccaccaagccacggatgtggtcatcagcttccagcgatccttgtgaagagctgtgtattgaatgctggacacttgatcagcagtcgtatgataagaataaaccagttctcagaagagtcgcagattcctgacactaagaccagaaacacatctctgccaagggtccaagaaggaaacaaattttatgaacaaaaaccttcgcagcctctctcagcatcagagaggcgggtacctcggacctgtcttcccaaacaggccaatgggtgcaatcccgtccagcccagcaaacagcaactctaatgagagaaatgggccaatgacacctctgtctaatatctggcatgagtaaaggatagattttgcagtacctagaaaaatagtgaaccagttctctctgaaatattctgtgatttttgaactcttttctactgtatttgggtggaatgagatttaatagtggactcagggacactgagggtagagggaggggtaaggagatacctcctagcagtgatgtgagctgtttctccccgggtagagggcttccccaaggtattttcctgtggccatagacataatacagtatccttttataggatgggatagtgtcaggaaacaaaatgtctcatgttttaagaaatcatgagaagcttcagaaatacttttggatattaatgttaaatctaggatatgctgagtccttaccacactggataacacattcttcatggattccgtatttgtgaatccacctactccctaaaatttgtagtccccaaatcaagcttgtggtgctttcctggtcatttgtggacctgcccaggattacagaaaaatgtgagttgcccaatgtgcacattctcagctgaactcaaatgagggtctgccttcttgtctcagctctcgcgctggaaacaggtgcctttttgatgatctagttagtgccgtgatttgtttgcgttttcgtgctttttgttggtgatttcactgtttaaaatggctctgaagtgtagtgctagaagcactgtccagggttcctgagcgcaagaaggctgagaatgtgccttacagagaaaac

SEQ ID NO: 74103 - DNA, 1108 bp, Homo sapiens
tataatgaaggactttatgtgcacttgagcgaatttgtctacaccttaaagaggatcattttgacttgattgaacaggataactctgcataaatgctataatctatatgctttgaaagtggctttcctgtcatttgacttagttaggaattttcataaggaaaatcaggacatcttcattctaaggagaaaaccaaagggaagttttagaggaagccgttcatgcaaatttaaggtcaagaaagactaaaattacttgggttttgtcttcaaattttttagaacagtagaatgcaagaggctatcctggaaaatgccatgtacagcaattaaaagcttagtcttctccccagaagcctaaggatgcagcagagtttaccgaagcccttgcagagaggcaggataataaacagaggctaccaaacaggacagaatccaagtgttgggtgttctggcgttctaagaagctggttttgtttctgtttttttcatctgagaaaaatctttggataataaaccttccgattttatcagcctattcactaatatttttaagatatttgttcttgctttaggagaaagcaccctgaaggttgtgctcttctataattagcatatacctttaagtgaaattttcctcagcctataatgtggttagtttatatatctctgcagatgaagataattacttagcttgtttatagaatacactgccacaaatatgggtatttgctgactataattaaggatgtacaagttactgggtaaaataaatcccaaaatgttcaaagttagaattttctgtttggaagggcagctaacaaagaaggtaggttgtgtcctttaaatctatgctgtgcagtgtggaagggctccagcaacatatagtgatttcagtttaaatgaaatacaattaaaatgtttgctcctcagttgcactggtcatgtttgaagttctcaatagcctcatgtggctggtggctgccatattggacagtgcagatatatctagaacaagtttgtccaacgcccatggcccaggatggctttgaatgaggcccaacacaagtttgtaagtgttcttaaaacattatgagactttttgtgtg

SEQ ID NO: 74104 - DNA, 1169 bp, Homo sapiens
gacattaaaacatgctcattatccttcctgtaatctgctgccttgtctcacagaaatttgaaacctaagtggatcctggttgtaatgaaaagaatcatcatcagccctttttacatctgacattggggtaattttgttttgcgtatttggtctcaactgctttttaatccaacaggcagcattcaaacgactctcttcctttatggagatgatcttgttcaactgcttccgctgttattagtcttaagagttgaaaataaaatgcttatagtaggaagcttactaagaagacaagttgttgcttttcaaccatcgtttgggagtaacagtgaacttgacaggagtcagtatttgccagaaaaatgatcccaagccttgctccaggctactgtcttctcacccactgttccacggccccttcctggcccgtttgggggtcccctgtgtctatttcaggccacgtctccctctgcatgcagacctatgtatgccgcttcctctttgctgccccttaggtaccctgagatcagtatatctaacactgaattgactctctcactgctcataataccttattctttcctcgcttagaacccctggcctcactgtcccttccacccagtctgcaaaccagaaacctgcgtggcccatgggtttctcctgcccactcgtctcttgtagccaagcagtcaccagatcttgtgatcctgcgtctcgttatctgcccctctctcctgcatctgctccttcctgagcacaagcctcattatttcatagagccctcctgtgaccagctggtctttctgcctcccttagtatctgtccccttgatatggtttggctgtgtccccacctaaatctcaacttgaattatagctcccatagttcccacgtgttgtgcaagggaccccatgggagataattgaatcacaggagtggtctctcccatactgttctcatggtagtgagtaagtctcacacgttctgatggttttataagggggttctgcttttgcttctctctcttctcttgtctgccgccatgtgagacatacctttcaccttctgccataattttgaggcctccccagccatgtggaactgtgagtcctttaaacctctttcttttgtaaattgttctgtcttgggtttccctttatcagcagcgt

SEQ ID NO: 74105 - DNA, 1077 bp, Homo sapiens
ttcccaggtgcgacaccagctaactgcatcagagctttggggatgagacccgagcatcgatacattattttaaagagcttccacatggagcatgtcctggtttgagagcagctactctagcagatctgtgtcttcagtttcctcatctataaactcccattatcaatcaactgggaagaccttcgtggattaggctcgtcaccttctccagcctcaccgccatcattccttcctgtcccgtggccccccgattgcaggtacaccttgccgccagcacatgcgcacactctcctttctgccttgaatgctatttccccagtttcttcccattccagttctctggatgaaatgactttccctgtaaaaatccgaatcagtgcttctccccttgtagaaacccccgttctcgccagagtggacatgggcatccttctcctatgtttccatgatctgtgaagacagggaccccccgctcttcatgcacatcctccactcctagcacaggagatgttcaggaagcctttgctaatgggagccttttttgcgtagaatgtctgttttcccttctgaagttctgagccacattagagtacttgtaaactgtaaaggattttacaaatataaagtgacttaatggccttttttttttttttttttcctgagacagaatctccctctgtctgccaggctagagtgcagtgacatagctcactgcagcctctgcttcccaactcaggtgatcctctcacctctgcctcttgagtagctgggaccacaggtgctagccaccatgcctggctaatttttgtattttttgtggggacaaagtgtcactacattgcccaggctggtttcaaactcctgagctcaagtgatcctcctaccttggcctcccaaagctgggattacacggccctaaatgactttttaaatgacactgatttaaatgatttcaaatgatggttttttaataacagcaaatgaatattcatatatcacctttctgtaatctctgcttttcttcaagtgagaatatggggcatagggctttctttattgtgcacagcacagtctggt

SEQ ID NO: 74106 - DNA, 1050 bp, Homo sapiens
ttgtcatagaactttacagcacacggagtgagccttgtgtgagctatggagtgtgagtgatgatgctgtgtcaatattggctccacaactgtagcaaatctctaccaccaaggttaataacgggacactgtgtagcgcgaagaagtttttgctcaactttttgtaaacctaaaactactctaaaaaaatagtcgattaattgaataaggtgggaggagtgatgcctggcgttggagtgggaagaaaatgctaagagatttgcatccaattttgggaacagcaggtgctgggatacggaggtgtagatggggctggcgttcagggtgtcacggaggtgggcggtggcaagctctgaaggacctgcagacttaggaatccagaggtttcctgcagcgaggagctgtggtttgttttcatccgtgcctgcctcagggataacccctgttgtttctgctcacagcaaagagctcctgggaaggtgctgctggatgcagtttgcaaccacctcaacctcgtggaaggtgactattttggcctcgagtttcctgatcacaaaaagatcacggtaggtgatgtcaacttaatgttactattttactgtctgttcatcttggtggggggctgggcaggggccagtctaaatgattgtgagtgagatattttcatgctgtctgttttgtctgtgaagtcttcaaatctggtgtgtatttgacacctcagtacctcttggtttagactagccatgtttcaagtgctcagtcatcacatgtggccaagggctatgtatcggccctcacagttctatacccaaactaatatgtttgagaagctgttaatgcatttaaaagagagtgtgatatgatctgatttctggtttagaaagagaactgtaggcagattggaataggaccagactggagtcaagaaagccatcaggatctagcgatgagtctggttggagatggtgctggctagaactaagggagagtagaggggctggcaggagctggatggattccagaggtggggttgggggcagtaggagaggat

SEQ ID NO: 74107 - DNA, 1033 bp, Homo sapiens
tatattgtagcttacacatcaaaacaaaaaaactccaatgcaaatcacagatgatgatgatgatgatgatgatgatgatgatgatgattgagatggagtcttgctctctcacaccaggctggagtgcagtggcacgatctctgctcactgccatctccacttcctgggttcaaatgagtctcatgcctcagcctcctgagtagctgggattataggcgcccgccaccacgcctgactaatttttagtacagacagggttttgccatcttggccaggctggtttcaaactcctggccacagatgatccgcccacctcagcctcccaaattgctggcatgacaggtgtgagccaccgcgcctggccacagattattattttataatctgtctgtcctgttttctttctttttttttttttaaattctgaaaagttgttcatcttattcaatctctccctcccctcactccctatctacttcctgattttgtctaaactcattggtaagagggtttataagatactgataaaggccttggctggctgagacaaagccagggccacatctggtgtatgttttccccagagctcagaagagcacctagaggctgaaaacatatttgatgaacatattagcaactgtaccttataaatagttaaatataatgaattgcataactgatgtatgttttcattatttgggtaaaaccagccaattagatacatttttgaagacaaatgactttattttaaaaaacctagataaaatttaagtctgcagagaaaaaatttaatagctctatgtagtacttttgtcacagtattttttaaaaatggatctctctttccccacaatatggaagtgtgaattagtagctgaacttggccagttgttaagtgacttggaaaatggcagatgtgcacttggcagcttggaatgagatgcattatttgtatttgtaaagtctttttctttaatggcatttgaaacacaaatcagtaaatgctttacttctttttttcttcttctttagg

SEQ ID NO: 74108 - DNA, 1084 bp, Homo sapiens
cagccgccacgccctgaaggaaccttctggatcatgcccagatgtgcctccgtgattgctgctaggccagagagctccggggcagttctcccgccgcagaggcctcgggtgttcttgcctggctctccttttctgttttcagccttggaataacagtctccctcttctctatctctccgcacctttttccccaccccacccagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggtccagcatcccgggctgccagaggcagcagtacttccattcctttcattgactgcagtgacgtagatagcgaatacgaccttcttagagaacaagcgtcccgatcccggtcccgatcccggtcccggtcccaaacaaatgacaattatgagggtgatctgaccagcggtgtctatctgctgtccagggaggaggggcgaagagaggctgggcgtagggcttccccgcactctgcgaagtcctcccggcctccttccggagaattccttgatgacgattcagcagacatcacctttgatatgagcgggagccctcgactcccaaggcatagctctctcatagatgaaatgttcaagggctcggctggtcacagccccctggccaccccattgtctcccagcagcagcagttcaagtccaaatatgagttgggacagaactgggtctcaaggctatgtttcggaaaatggacatgaccatagagaggggagtatgggagaagacactctcccggaccagggtcctccttatgaacgctggtcccccacctcgccaaggccatacatgcggaatcttcctggtagatgtaataagtcagagacagatccactcatccttagccaggtagcatt

SEQ ID NO: 74109 - DNA, 1067 bp, Homo sapiens
aagataaacagcaagtcctaatgacaagttctcaggagcttgtttattttgctggttgaaggctaggaagaaacactttattatgaatccgatcatgtgtatagtgtgttatatttatatggcaattttctgtgtatgttcaattatgcagctcaccctcctgttggttgagagtttgaactgaagcatccttgagattacagaaaagggtttcccattctccccttctttaaaaggagggctgctttgtccatgcctcatgaagtgaggaattggcactattcaaggccaaatgtaaattgatagctagttgagattatgttggtgaaatctttcgtcaagaataatgaatattttaatgggaagaatttggggttatttctgcttcccaggcttcctgtgaaatactagaaaagttgtcaaatcttcatgaattgtgatctactagggattgctggtttggtttaggtttgcattggtggatcatattgttatgttttaagaagtacaattctgcctctcagaatctcttggtgaaactgaaatcctattgagtgtggatgcagggaagagcaacaccttgaaataggcactgttgtcaccagtaggtcaacaaactaaatgcctgcctttgaattgtgtacagcgcagagaaggactgttttccagcatggttgctcttggttggtgtacagacacagtcttaccattcacactctggtgaacagtgtcctctgttgggaatagtgatacttggatgtttctctgagccagaaaaaagaaaatgtaaggagagagagattgacttctttttaaatcttgcccaccagtgtcactgcctttcacccagcattcctgcattttagattaaagagcctggttttcacttgaagtttctctgccttagctgcacgttgcaattttctgagatattttaaaaattagtgatgccgggaccctgaccctagggattttgatctcattggtcttgagtgctccttgggcttcccagctgtttgtactgggcagccagggtcacttcttacccaggctgtctcgaatctagt

SEQ ID NO: 74110 - DNA, 1049 bp, Homo sapiens
tcttggccagtattcacaaaagcagcaatcctggtgtaattaatggtgcttacagtttgtttaaaggctgtttatcatacatcctgatgtgctgcgaatagtcactacttgcctcaagaggagcttgtcctatgctaataaagattctataacattggccaaagggtccgtttatacattctttgagcctggtggagcacgtttgctgaggtgatgtggtctcctcagtgtcactgtgaagagctcagtcaggaaaagccagcagcatctaccctgccaccctccaaaccttctgactttggggagactccagtcccccaggtctttacccagcctgcagatctcattctagcttaacaagggcatgcgtgtgcatgaagttgaactaagagtggaggaaggccagaggtagggttgggtgtgatactaggtagcagatattacagacttctgaatgcattcagatttccaaagggtttcctgagacctctcaaccaatctttctaggacaatagctagtgtaggggtctcctgactcaataggggacccaggccttcagataccagccactcactggctgctctgtgacgtgctatcttaagaccgtgaatggaagacaagccctatgtaaacacaaatcttaaagccactgttggctactcgagggcctccttgtgctaatatcttttgttggatattatttcaaaatatgtgaattttagacccttttgtggttgcctttgctgccgcttgttaagggcaaaataaaaacgcaagaaattcttttagcatgaagaaatacatttaatgagctccagaactcaaaataaatggcttcagctccttgaacagtcatctgtatgccattgacaatattttattagataggcgtttaattagaggaagtctgtgggccagattcttccctgcatgtgtgattcatatttggaaatttctgatttatctccccccaattgtgccatgtggcctgcacttaaaatgtaagtaattctgattttattctcaagaacttatttgaagattcaag

SEQ ID NO: 74111 - DNA, 1960 bp, Homo sapiens
gactccacttttgagtgagatgtggaggcggtagtggtgtgggggttgtgagggagtgagtctgctttattatgaatcaggattgatagctggccttaaagtgggaaatgatagaagggtcacttaggagcctgcagtggcatggtgaccagtctgttattactcatagatgaccttttctggctcttgaaaccaagctaacgactcctttttcttctgggcctcaaagtttctttgtaggaagtaaagcatttgtcactttccctgcagtgatttattgaaagactgaagataggtcttccttagttaaggacgcacactggctgctcgctccagaagcaccaagaatggctgatggataaatcccttacccatactcctgtttctgcctcctaaggttgctgtgaaaacctaactaaccaaacctcaccagcttggcctatattattaatcaaattcccttctgttctctctgtgtgtatatttaatactgtagataatatgttttatttaaaatttctaatacaccaaattaatttgaaatagaaaaggctggggacttcattctcatttttgtcatttgtttaatcagtttgggaaaacattttccgttgttccattgtatgcagtgtcttgtcagcatgtacctatctaggagaaaacgctttgttttcagcgttctgtctttaccctcaaagcatggtgtagcttctgttcttacactgttggagcactgtctgatgtctttttttttttttttaacactgctgaataccaatttgtacttggaatacctctttcctctagaatacagtgatcctattccccaaagtgcaagctttcatgtggaagcatcctaagtgatcgtcctgggtgatgccatatttcactaaagtgggaaaagaagaggtgaactttgctcttccaacaaggcttgcactttatactttgggcagtgcatgggagaaggggggcccttagaggtgagcaggatcactgtagctagaggagaggtctcactgaaacagaacgcatctgtgactgtagcttgcatggagagcctagacagccaaccatggatttgcctttatgttttgaatggaaacatctatttcaattgggatagaaacctttacctatgtcatatctgtaagagaatttagcttatagatatgtagatacgtgtgtgtgttgctgggtggggaagtgggtgggaatgtagaaaaggcctcacctgacttggtcccagttggcttctgatggccaaggagctgtttttcattttggtgggcacccaacatgtaggttctcacagatgctgtctggtttcttcttctctccatggcggaacaatgaagtacgtcaataaagcatggactcataccactgggaagaatgctggcttctccagtaacaatgagcttggtggttctttgagcatggaaggccaagctcatgtcacagtgtatgcacggtattaatatatctcttgttgatctaaactgaaggggcttttacttgtcctaacaggtatcatgctgtaaaaactgtccattgtaactgttctttcccactgatggctgaagctttgtcctgagtacaagatggtatttttcattggtacgaagcaccatgttcccaacccaaacactgcctccaccaccaccaccaccaccatcaccaccaccactgctactaccaacatcaccaccaccatcaccaccaccgtgttcaaacaaagcagcattctcctgtgtcttttcctcataagtaagaacaaggtagcacattcatttttccattagtgcatttcaattcttttcctgcaagttgcattgctattgcttttctgaattgcttgatgatgaactgtgaagctgatgcttagctgcttgtgaaacttttcttaaaggaactgggtctaagaagcacacatacattaccctcaacaacctcaggt

SEQ ID NO: 74112 - DNA, 1095 bp, Homo sapiens
caaattctactaattgcccccttgtcagcatatttcattaattgctgaaaggtaaatgagttacatattttgtttggaccacgtcacctgtacattttcaaagcctcggattgtttatcttgcaaagagagaaggggcctcttctccacagatgcagctcaaattagcaaaactgaactgtagagtttcaggcctttcccttccttaaaatgctgatagatttctagaccagactttgatatttattggcttcttggtcttgctgtttaaacacacccattgccctttctttcttaggccctataagcaaagctggagtagcgtcttgggaaaaggccaactgaccaccctaattttgtcgttccaagtctgcagagcgcacatattaagtagttgttactgacatctttaggctccgtgagtgaaatgcagcaagcctgcccccagcagcctgtgggctaatcctgagctgttccttcgtttaggtacacaggtgaccctgaagttcccactcggccctctgttttctgagtcctgtctcctctgtagcacagtggggattgttctgaaccgtggcacgccttcttggcgaggcaggctctcttatggaaccatagtctgttacctcatttcttccaactgctctgtcccctaaatgtgtgttcccaggtgcagtgcagcaagggtgctcgctgttggcctttgagagtggaggtggctgtatcggagtgtgctccccctactttttcccttgccccgagtggcagttcttttcctctctgttgccggatgctgtctagggcctgttagttgctatttccttgcctccgctccccttcccactagccttctaactaccttttattctcggctccaactctttcaatgatgaggtgaatgctttttctgttccacgtcactgcaaagtcaaggtgtccagcatgctctcacttataactgcctcacccgatctcacgcacagtgcgagagctgaaggtaagccccggatgttgccagattacggtggacaaataaaaaacaactctccaacagcaactcacaaatgcatgaaatgttttaacctctagacagact

SEQ ID NO: 74113 - DNA, 1050 bp, Homo sapiens
cccaggtgggaggaagccagtaggtttgcacgctcgcagtccgttcttggggtctgcacgctcgcagtcagccctcaggggctacaaatttagccctcggggtctgcacactggccgtcagcccttggggtccgcacgctcgcagccagccctccggtctgtctcccctgcaggagttcatccgtctgggcagcctcagcaagctctcggggaaggggctccagcagcgcatgttcttcctggtgagtggagagagcggcttgtcctcacaaggattgtgtcacctgggcaagcaaggctcccaaggccggacctcggccacccaagtgagggacctggggtagaggaagagcagccagaggtgcccaggcccaagttgttgaggacagtgaaggcacagttgaggacagggaatgctggagggaagcctgctgtccaaacgtggtctcacctccacacacttctgattcctccagttcaacgacgtcctgctatacacgagccgggggctgacggcctccaatcagtttaaagtccacgggcagctcccgctctatggcatgacggtgagtacagcacaggctcgtggccagggcctgtcctcgggggcagcaggtgcgggcgctgctgacccggcgatgaggagggaaggagactggatagggagggagagggtggctagtggcatcttggttacaagacatgggctcaaagaccatcgaagaccatacaaccctttcacctaaaagctcgagccttctagggcttctctagtggggctctggggacacggctccttctcctgcacatgggatgtgcaggtccattccttatagaatcgagtgaaagggtaagctgacaaggccgcgtggcatgaactcgcctcccacagcctgtgcctggccccaggggccccgacagtcctcgccacacacaaggatgacagcgcccgctccctggagctgggccagccacctcgtcctcccccgagttggtttggggctgcctcctgtcccccttggcaggcaggtgtagagggcgcctgggcct

SEQ ID NO: 74114 - DNA, 1029 bp, Homo sapiens
atgcttgtgacacagacagacagcaaaacaccacggcttattatcttcccattgtgtacaccactcacaggacggtgacagtccaggtattgcactggatctcggctttgcttaacagaaaacaaccctgctacggttggaaagagttaccacttaaaacgatttggtcaacttgcaccaagaagtaggttgggaacaggtgttttcaggtgagcgtgaaaccccgcagtggaacgctgtgtgctgcaaattgcttattaatcagagaagtgagtcctactaacttcctattattacaaaagtagaaagactgaaaaaaaaaatgaaatctgaaaatgatctcatttgcttaaggctgcactgagtgtattgcaaacaaacaaacaaacaccgggaagtccacttcgtaaaatgcagcagccaataggtgaaaataataaaagaaagaactttttttaggaagaaaaacacttgccctgtcttgtgttgaacggatgtgtgtgtactgtttttcaggggcagggtggagggaagatgtcatttggcactctcgtaatgacaatgttttaatactggcactagctaaagaacagcgcccccagcggatgccaggactggaggtgggagcgctgttcattcagacgctgagaggtcggggttaaaaaacgcggctgtggagacaggagagctgctgggaagccatgtttttgattttcagacaggtgttaattttaccaggcttcattaatacagaagaaaggaaacgtcttccaggaaagcagccactgcggaaacgagtgtgtccggccatcaatacacaagagactctttgtgactcaacacgtggggtcgcgaggcagagctggtggcactgcggatcacttccatccacctgcaacacgggaacgccagttagtcaaccttttgtttggacggactcctgacactttggtgggcatcgcttacagaaacacaaggtgaagtcaggccgcctggttggtaatctgccacttcagcagaagagcaagg

SEQ ID NO: 74115 - DNA, 1025 bp, Homo sapiens
tgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaccaactttgtctgtagtcttcattttctgtgtggggggggaggggggaaggggacactccagcaagggtttctaaagccccagtgttcagagtgacacagggagggcctgccccccactgttccctatgctccccccacctccaggcaggggcagagcaaacaaacagctccgggccacacagcagcatcaggctccctccagaagtcaccactcactcattcctggagacttggggacaaggcagtctcctcagctatttatttctgaatgattgattgattccaaactacttgctggacactggtggttctgacctgtgaccagcacctctgcttcctgtgtgccctcaagaaaatactagtgtgggtaacagtccatctgagtggagtttgagacacactacacatgagacacacaatgatgcagatactcgttttcttgagctttattggcccctgcatgatacagtccctgtgcttaagaacatgccctattaggtcactctgcctttgctgacacattttatagcagaaat

SEQ ID NO: 74116 - DNA, 3414 bp, Homo sapiens
tatgaaaactaagattttggttactatatgaatttttgcacagggatgagaaatgacatgtgttgacttctctctctctctttttccctagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacatgaagcattcttttatgtttgttgaagctgatgattgacatctcccgtgggtgtgccagttcttgtggagttaagacaggatttttggaagcaaggaagttagtgggtgagcttggggatgtagctcagctatctgctggtctagtggcctctaagctatagggaggggacagagccctgagctacagatgcttgagtgggttattgtgtcggtttgctagtgcagtctggtttttaagctctaaaattgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggctggtagctcctgcgtttttgagctgtgtcctggctggctgctgccaatgaggtggacaccagtgtggtttggggtgcactggccacttcttgctgggttctgattttcttggaagtgcatctgccttccttatccaatagttttatccctgcattgctcttgtgaagtggctggtttggttctgtatgtagcattttgtacctttcctctggcaaaacactgtcagtttataaacattttttatatttccctcctttaaaaacagcttgtgtatttctgctataaaatgtgtcagcaaaggcagagtgacctaatagggcatgttcttaagcacagggactgtatcatgcaggggccaataaagctcaagaaaacgagtatctgcatcattgtgtgtctcatgtgtagtgtgtctcaaactccactcagatggactgttacccacactagtattttcttgagggcacacaggaagcagaggtgctggtcacaggtcagaaccaccagtgtccagcaagtagtttggaatcaatcaatcattcagaaataaatagctgaggagactgccttgtccccaagtctccaggaatgagtgagtggtgacttctggagggagcctgatgctgctgtgtggcccggagctgtttgtttgctctgcccctgcctggaggtggggggagcatagggaacag

SEQ ID NO: 74117 - DNA, 1060 bp, Homo sapiens
accacctcccgatggtctcttctctgtgagggaggaggcgggggggtctttgggaaatcccagagggactggacaagggtgtgatgggtggggacttggggctggtgggtgtgggtttagaggtccccaggcggcctccccctgaacgtcccagcgcccccagagcaggtgtgcgagcactgatgggatttcctgcatttctgtgttaagggaaacagatggccaagcctcggggggcagtgattctggggactggatcttcacaatccgagaaaaagatcccaagaatctcgagaatggagctcttcagccatcggacttggacagaaataaggtacgtctgctcactccagaatggccacgctgacctcagtctgcagtgttttggaggcacttgtgtgtgaagcttgctgtgggtgcggctggggtcctttgtggcagctgtcctggaattttgttgctaggggatgggcagatgaagagctttagttctgtctgatgatccaggtgttcacaccagggagtctggcctctggtctgttttgtgccactctattctgctctctgcagccctgctgttgagttaggatgtcccgatgtggcaatgtcatggggtttgggggtgacccgtgaaatgacttcatagctctgagggactgttgtgcatgttgcggttacttacatacatatcataattttgtgactgagttttaaggaccttataagtaaatgcattgcttttgatatttatgtaaaacaattttgattaattggttttatgcctgttaaatttatgaaaggccatatatttagggtcttgtaaagcatagtggtgtagtttctttcaggcagggtgggccagtggctgtcccctgttgatcctacaagtcccgctttgataagtgaacaggtgttaaatgtccaaatagaggttgcaaaagtagaaactcggtctctgtcctagacagccattggaatggccaatcttgacctgatttctatttccagggtttcattagtaaagtacttttctctctctctctctctctctctttttttt

SEQ ID NO: 74118 - DNA, 1071 bp, Homo sapiens
agaactggcatttcaacccaggtatcttgagaccaaggtgcccactctcgacctcagagctgtgccctaagttctaagcactgctggagggggtgactcgcgagcgtacacccactccggactcctcctctctgctcacctctcttactggtcctgctggcccccgggactccacggggaatgccgaatgcatccagcaggaggcgtagtaggagtgaattgataagccatctccatgtagaggcagaaaacatttggcatattacagtttctcctgttgtctcttttgaaattacagcgagggcttatgtttttaaatatcagttaaaaatacctttttcaaaacctcagaagtattgagacatgttaccattttccccctaaatactgtgtattggaatagattcctgcttggtgtttgtaaagatgcttttcttgttgcaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttgtaagtttcccagggatcacagcgtacctcttcatgtgcggcttgacttggttgagatacatcctgttgggattgctttaatcactcttttcagctgtcttcctggtattattcatttttctttttctaagtaagtatgattgacttctttggtttgcaaatacattttaatttttaagtattaaaaatctccttattttcttttagatttctgccatctcatacttcattgaatctgaagaatattctccttaatattaaatgtggaatcataaatgtttaatatttatagaagatcaggccataaactgttacactgtttttaataatggcaaaggttagctggaaacaaatggctaaatatgtctttaaagtaaatgttttcactttccaggtggcatgtgttaggaaacaaaagattagaaaatataaccaagccac

SEQ ID NO: 74119 - DNA, 1015 bp, Homo sapiens
tttttacttaagctttatttttaatttttgtgggtacacagtaggtgtatatatttatgggatacatgagctgttttgatacagataacctatcttgaattgtattctgccaatcgattctatcatgtacctaatttttgtagtttattattcagataaggtggttttctgctcttaaactgggggggctggggaaataagaattttcacttgaaaaattcatgttctaaaactttgacataggtaggttgcagcctcctcagttcctggggctctcttctggagtctctctcgctgcccctgccctcctggcccccgccccacccctggctagccgaggaagaggaggattgggccttgcacagttgcacagtgcctgtctggagcacaccacagctctgtgaggagggagtgtgcaggttcagggcgattcccctcctggggtttctcagctccacaggccacttctgtgactccgcggtgaggctgtgcaagcgaacccgacttcagttcctgaaaactgaattgtttttagtcactttgcttaattatagactaaagagtttgaaactacacataagaggtgtaaataatgtgatataaatattgttggaaccctctgttgtggtttccctttttttcccccttatattctcatttcatttcaaagttttaaacagtaacttgaatgtgtattggccagtgtgacatggacgcgcatgttttactcatcagatgtagtaagaaaagatgtggctacttaagaacattgaggtgtgtgactttaaaagtctaggtgtgtcattaaaaagtgtgagcatcccagtgttctcctgggtctctggaatcatgaaatttgccactaacatcacttacactgtattttattaagttgggcctacccagcacttgcctgtgtgctaaatctaattattgtcatagttgggcttgtggacgggttgggggaggatgggaggggaaggaaggggcgaggtgtgggaggaggcatggcaga

SEQ ID NO: 74120 - DNA, 1105 bp, Homo sapiens
agtgcccttgtaaggctctgcctagtgtggctgtattagaaaggtcattcctggttcttacatgtgcttctcctttccacgtctcccactggcgtgctgactttccaaggggaacgtgaagctgtccgcagtccttgcccttgccctttcttttggagactgtgtgaatgagcagcagccactttaatgtgaggcagccatataaacaatgaactttcacttgctgccaggaggtcataaactcaaggtcaccaaatgaattctagcttcagctcttggtttagtaatgtaccaagtttggtattactttttgtttgttttaatcaggtttctgccctcatcttctatttgggaaattaaaactggtctgttggcatggctggtgactgagcggcaggcacattcttagtctctgactttctgcagccatctttgagtgcatataagtgttgggtaacagtctactgaatgtgctacaagtgtgcggagttgtgttcatctttaacttgttttttttaaaaaacactctcttggtaaattgggatctcctgttgaaaactgtatttgtttggcagttgagtttatgcctggagcccctagagcacatttaactggttggtggtcagttgtaccatactgaaaaaaaaaaaaaaaaacacatggaaagtatttctaatatattcattatgggatgtgtgagcccttaattacctgaaaatctgaattgtctttcctcacaggtagtagtcctctcaggtgtttcctttttaaaattgtaaatggaatttcacatatccaaagaaattaggattcccagtgctgtcttctccctctagtagcatattttgtgtcttagctttctgttgttataacagaaagactgggtagttaccatagactgggtgatttataaggaaatgtatttttcacagttctggaggctgaaaaggccaagaacatggtactggcatctggcgagggctttcttgctgtgtcatgacgtggtgggaagagcaagcaagctcgtgcgaaggagaaaggcaccagggacaggacttgctgtataacgacccactctcacgataacaaacctgttcctgaagtc

SEQ ID NO: 74121 - DNA, 2923 bp, Homo sapiens
ctgtaaacacacagccaggcttcctcctaagtatgaccgtcataagacatttgaaatgtagtgccgtgactgaaaacaattgagcaattgttcaggaaaaaaattaaatgcctctcgattaatcacccaattgatatgtttagtgcagtactttaagtggaagttggatagataggttgatttttaacacagtggatgtttgtgtagcgttttaggagccaagggggatcatggctaaaactgtagtccttgtaatccctggccgctcgttagacctcggattacgctggccatgaccttccggtgtgggctgagcactcagtgtctggcctctggcctgtcctgctctcttggtaaccccaggacgcatttcccgttgggtatatgtccaccacgcaagccttggttcattttgtactaagatggttggtgggttttgtgagcttttgcattgtttgatgtgcagcctcaaacaaacatggggcaggggctctgcgcccctgtgtgcaggaggtcactgtggctatctgctcgtgtgtcattgtggcgatatgtgcgttgttgccatggtggacacgctgtagcactgtaaggcctgcaaaccagaaatgggctgactggctttcaacagttctcttggagagcagctgctcggaactcagtgtgtctcaccttggagagctgtggctgggtggcccctgatgggccctgaggctcacgtcactcatgaggcaccgccgttgctgcagtgttgtgtgtgtgacccacctcacatgcaccactctggataccctcttctgtgtcatctttcttctcctcattctctttctttacctccttttcaggcctccctctcctccctgtgcttgttccttttcctagtagttcagcttcttcaaaggactcatagatttggagggttggcctggcgttctgttccttctatggaccatttctgagggaagatgtgtctgcagcagtggtgtctcttagagtccttccttgctctgtggggttccaggctagtgcttgtcaccggggtgccattggcattttgagctgggcagttatttgtggggagatatgcagcgtccctgtcttgccttgctaaacatcgggattgcttctcagtttcctgacaaacaggccctgtggatgacaggttactgccccctttgagaactcagctgttcacacgactctgtactgtgtagctgttaggatgagagcttgagctctgacagctagccttcttagaaatgtatactatatatgtatgtgtaactaatcaggtggttaagagcttttagaggctatttccagggtacagcatgtatgtgacaaaacaggctgcttattgttttctggaatctggttagattgttattgttttggtgaaggcagtactattcatgaagatgcatagttacggtatacgtttttttttctgttctgtgatatagctggttaacattttagtaaaaattcatttgaattcaggaacttttggggattgggtatggagaaaagtgaatttttgcttagacaaaagtgatttttcgataagtctgtgtatcctaacattccaataagtgcttagattttaatttaccctcattatacaaaagttggcattttttccatgttttctaatctagctgggtgattgttcttattgtacgcttgctgcctttcatagtctgatgcgcatgtgtaggtgagacctaggaatcttatgtcctgaacctgcagagctgtggtcaccaccagcctgatgctggacacagaaaatagatgagtccctggaagacagtgtggtctataacattacacataaaattgacaaaggagttgtggtgctatgagggactaaagtttcccttttctcttccttctctctacagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggtaaggcttaaaataacgtgcttctccgttctgcagcacttggctgaggtgccagcagggaatgggaaggactctgataggacaaagcacagcaggtttcagagcaaggagagatgttttgaccttcgtgatcaaaagaacctggctttgatagttccatcatctcaaatgtctcctatagaaatatttgtggtgaaagtgtttgatgttctaattctcttttgaataaggaagagtatttctggtgggactttgtcattaaaactgtttcttattaagttattataacagttattcacctaattttaggactgcttatgattagtattaaaaactcataccaacttaagaatgttaatcttttgatattctcacttaccagctgtggtttaatttaatgctgttaaaaactgctgatgagaattgataatgttggttagttagctagcttatctacgcttgacttttaagaatgctaggcaaattggtaattacttaaataaaacggtagttataataatatgacacaaaaattgtcctgcactgccactctgttctttaagtgggaaagaatagtattaaaaatgtttttctgatcctgcatggaaccattttaccattttagacatcgtagaacaatcctgttacaacactaagaaggcttatgaccgttcttgtgtttcaagttcctcaaaatatacctgtttcactgaacttaaaaatgttgtaacctttaaaatggggttttagaaatcataagaattggtggggaaaaaaacgctctgaaa

SEQ ID NO: 74122 - DNA, 1034 bp, Homo sapiens
acttaaaatcttcttcctgaagccaagtctggcactttttttttttttttttttgagatggagttttgctctgtcacccaggctggagtgcagtggcgtaatctcggctcactgcaagctctgcctcccgggttcacgccattctcctgcctcagcctcccgagtagctggaactacaggcgcccgccaccaagcctggctaattttttgtatttttagtggagacggggtttcaccgtgatctggatctcctgacctcgtgatccacccgcctcggcctcccaaagtgccgggattacaggcatgagccactgcgcccggcctagtctggcactttttgatctgcacgtgtgtacgttaaaaattgagatgttgccctgcttttcccgaaatatgcctgtgtgaaataggctcattgctaacaactgggacagtgcagaaaaacagagagaacatactgttaacatctcagtgtacctcattccacatgttttctttgaatgtgtgcaggagtacgcctgtccctcaaccaaaagggcaccaattcctgtcattaattttacattgatgtctacctaggtagtttgcagctttaaaaacatttttggaaaactttggacatatgaatcttttcacttgtctatttccctaggataaactaactggaagtggggtttttgccttttgcttattttcattttcaggtatggaacatcttttctgatcacttttccatctttttagcgcttccattcttcagatgatatgcttttttgtcattgttttctactttttgctgcttttaatgtgatgtttattttgataatgatttttattaccttcatctctagctgtgttaatgctttttggagacttaaaaggtgctccgaattgtctgtaatttctttgagagttgagagtatttttctgaaatgtttcccctctcccttgggaattcggaaatattttccttttgcttgttttctttttcaccactgtctttccttgtagaggcgtctccgcatgcctcggtg

SEQ ID NO: 74123 - DNA, 1152 bp, Homo sapiens
gacagtttcttgtcacttgatgatttattttcctatctcagcctttagttggaatttactgggtgtgcctgtcacttgtgattcagctgcttctttatgtagcattggcagttgtggcttagaaaggacaacacagctgaggctgcaggtcacaccataatgggaacaggggagcacttactatgtccagttttaaaaaaaactttgtttttgccccaggaaaataaaaaattgtcttattttagccccaggagaataagaaaacatcttatttttagccccaggaactataatatgtatgcatttttctgtattttttacaggtgagtaaactaaggcctagagaggcaaataacttgtaagaggtggaggtggatttgaagccacatgcacctggccgtagactccacgttcttctcttcatgtggtgtcagctcctccagtagatttgctgctggagcgggaagttagagtctctctgagttcttaagggagagaggggagggcttggtggcccagctgcataaatagcctcatctaccatgagggtttagcagtagtttgctctgtgtggataagaactacagtgtgggatcagtttactggagatgagaaggtgaatgaggctgtgatattgaagtataggaaaggtgcttgcacatcatgtattttctcagtttgctcctttggtcacaaagagttggtaataaggcgaagtttactaaattgatggctgaatacaactgggagccttgcagagaaaaccatttcacagctattgattttactcttaatcttgcctccccagcccatggcgtgtcattacaggaatcctggacaagaggtgtctcagtacaaatactggaaaaccagctgactgcaaacaacctattgactttttatcatagttggtcattaattttgttttaaagaaatagggtctcattctgtcgcttaggctggagtgcagcgatgtggtaatggctaactatagcctcgaactggtgggctcaagcagtcctcacgccacagcctcccgagtagctgggactataggcgtgtgccaccgtgcccggctcattgtttaaatttttggtggagatggggtctcattatgtttcccagactggtctctaactcctggcctcaaac

SEQ ID NO: 74124 - DNA, 1171 bp, Homo sapiens
cggctgaagattaataaaggaaacaatggctgagctctgttctagaagaatttcttttaaaggcagagggcatccagacagattagaatgttcaaaagcatggtgtctttaaatggcacagagtgtttggaaaaatacaaggaatccaattctgccggacttaaggggaaaggaaagagaacaagacacatatgttgaagaaggtagtccaggaccagatcatatcaggtcctaaaataagtgctcccagactaccttgtcattatcacccatgggaccatgctgagtggtttgggctttagcctattaggtgatgtgacatttctgggaaatttgaattggcagaatgagacccattttgggcgttgacagtttggtggttagactggaaaggaaggaggctggtcccccagctaggtctcattgcggtttcccaggtaaaagctgatgccagatcgaactgtgccaccagtgggtggggaggaggagggatttgagggagggagctgtgggggtgagcggggcaggcttcagtgatgatggtgatggagggagggaggtgccctggggcgaatgaacgcacccacgcacccaagtccttggggctgatgactagcatggaagatgaagatcctatgtagataaggaattctgtttcagatgagtggattgtgggcagaggaaatgaacaggcagttagaaatatgggtctggagctggtggaagagttcaggctagagactgagtctggtgactgattaattaggtcatttgtgctagcaacatgggacggctgttatcactatacagagggtgattgaagagggagtagcctgtgtttcagatcccagacttcatcacacttggctactccacctagctttacctgctaggcaaagcaggttctgctctgaatgtgagccccagagtgtccacacggcagcagcattggctcaggtggatggatggggtgcgaggtgctgtgggtggctgatcaccagtgggaacagtgtgtcagctggtcgtaagtcaagagtagcttgtaatttcttagacgacaggagttccttttaacaaatttattagacaaatcatgtgtctgagctccacatacctaatatatacatcattttgaccctgcatctcttgtccagtttagtggtggtcactt

SEQ ID NO: 74125 - DNA, 1048 bp, Homo sapiens
tggtgtgatcttggctcactgcaacttctgcctcctgggttcatgtggttctcctgcctcagcctcccgagtagctgggactgcaggcgcccgccaccacgtccggctaatttttttgtatttttagtagagacggggtttcaccgcgctagccaggatggtctggatctcttgacctcgtgatctgcccaccttggcctcccaaagtgctgggactacaggcgtgagccactgcacccagcctggaacccttttaaagtgataaacacctcagtactttttacatggcctgttgcatagatgatttcttaatattagctatagcaatcaaatgagagtgtttttgaaattccccgaaaataattcttcttgagtttgtcattttatgtcagagtagtagtaattccgttcctttctgctggaggacttgtgatagtaagggcctttggaaaccagcagaacagccagttgcttatcggctgtggtgtgcgagtcccgtttcctaccctggccccgttatgcgtacatggtctataaaagaatcatgtgaagtggggggttgaggattgtacagaaatgggaaccttcacccagaaaaatatcttcactccatctccgttaaagtatttttaaagcaaaagcatctagaatcccagtacttgagtatgtagttcttcctattttatttgccagttgtctgcgtacacacatttccttaagtaattgcagtcataatgtaggtacacgttgatattgttcctcattcagcattgtgtcataaatatcatcccacatttccatatggttttcatgatgattgttttactgtcttaactgacttctgtgcctcctttaatacaaggcgtgtcacatctttttttttttttttttttttttttgagacggagtctcactctgttgacccaggctggagtgcaatggtgggatctcggctcactgcaacctccacctcccgggttcaagcgattcccatgcctcagcctctggagcagctgggattacaggcacgtgccaccacacctagcta

SEQ ID NO: 74126 - DNA, 1036 bp, Homo sapiens
actgcaacctctgcctcccgggttcaagcaattctcctgcctcagcctcccaagtagctgggattacaggcacccgcgaccacaccaggctaatttttgtatttttagtagagacaaggttttgtttgccctgttggccaggctggtctcaagctcctgacctcaagtgatcctctcgccttcgccttccagagtgctggggttacaggtgtgagccaccgcgcccagccctctaatagaatataaggccactcagtgtcacctggaggggttggtaaaatgcagactacaggctctgccctgctgccctggagtttctgattctgggcgtctcggagggagtttgtgttctgagcaagtgtcctggtgtattgccgcctcgaggatgacactttgagaaccactgcgctggagaatcaaaaaagaatcctgaatcctcattgctccccactctagtgaagcacacagtagccttgcccatttgaaaagcagagcaagctacaatcagtgcttgcagcctatggcttgtatttccaaagactgactttggaaccgctgacctaactttgggaattgaataggcctgtaattataagactcattagagcctttgcgattttagcatgtatttataaacctgttgggggcagaggatgtgtgttccatgtctttttgaccttggaaccttatttttatttttagaaatgggaatctcgctatgttgccaaggctggacttgaactcttggcctcaagcagtcctcctgcttctgcctcttaagtagctgagattacaggcttatgctactgcgtgccacttggaaccttatttcataaggagtgcatctctcaagatctagggtgcagtagtctttttggaaaaccccgaactagaacaaatgctctgaacctgataattctcaaatttgtcaggataacttttcttaactgtggtattgcctgctgctcctgacttcctgatcagatgtagacgccagcctaaaactcagggccttttttagtacccagcttcctcc

SEQ ID NO: 74127 - DNA, 1037 bp, Homo sapiens
atcatcctgtccccctcgttccccttctgtttttcttgctgcttggataaatagacctttgctgagaatgccccttgcatcaggatagtgagactggtgtctaatggccagtctgggaacatggggagcttttctcaagtgctctgctccaccctagggaagcctgtgcactctgggagtctgggaaatgaaggcaaacacaggacagctgcatttaattgtggcttaagtgctcttgtacttttttttcttgttagtgtcacatttccacgggttcttttccgttccttccttgggaggtgcctgcccagttaccctgttaccatctgcaccctgggggaaggttggtgtgtcactgggtgtggacagtcaggacatccgagacgtgggttcggagagcaccttggggacttgctgaactgtggagtgtgctctggtgactgacagcattggactgcacaggggagcctgcagagtatagtgcccggagtcgttggaggcagagttcagagcctcagtccatcctgtcctcaagaggtcggctgcctgctttggggcatgtgctctaagaaggttgcagtgactgaggacacagtgagcaaaggcacatggttggaaagcggtgacacagcttctggtgggctagatctagatcggtcctggagctgaagaggcagtggggtgcctgtgggcctgggggaggccttgcatctgtagacagccggaagtatggcacatttttgagcagatgatctcctgttctttggggctcctgctttctcaggtgtggggagtgctgggtgcccctttagaaggcattgcagcacttcagggaagaggaagcccagggatgcgagtggggagcccaggtgtcagtaggacagcctaagtggatttttttagcattcactcagcttcgtggcttgaactctcagtgaacattttatagtatctcattactcctcttgctttatgatcctttttgctgatcagtgctaaagagtaataagtactcagttactgttagttactgtttt

SEQ ID NO: 74128 - DNA, 1049 bp, Homo sapiens
tgtgctggttactgctctaagtactttgtaaatctaacctagttcaatacattaggaatattaagcagggactgaagtagatactgagcctcttcccttcaagaaggtagccgtgcctttgtgttccttgtttcagaaactttatttatttatttagagatggagtctcgctctgtcacccaggctggagtgcagtggtgcaatctcggctcactgcaacctctgcctcccaggttcaagcgattttcctgcctcagcctcccgcgtagttgggactacaggcatgcaccaccacacccggctcatttttgtatttttagtagaggtggggtttcgccatgttggccaggctggtcttgaactcatgacctcagacgatctgcccacctcggcctcccaaagtgctgggattgcaggtgggagccactgcgcctggccagaaactttagcgctcaagtagtgaaagaccaaaaccagatgctgcccagttcctaaaagatagaccccagttcctaaacgacacccccttctttagggggttgaggaggaaagcccacctacttcctacctctaggagcctcaggtggggaagggcacccgggactggagaggaagaagtgggccagcccagtaacaagagacggttttttcagtcttttttagagatgaggtcttgctctgttgcccaggctagagtgcagtgatacaatcacagttcaatgcagcctcgaactgtgggcctcaagtgatcctcccaccttagcttcctgagtagctgggactacaggtgtgtgccacaatgcctggctaatttttatttttatttttgtagagacaagggtctggctgtgttgcccaggctggtctcaaactcctggcctcaagagatcctccctccacagcctcccaaagcactgggattatgggtatgagtcattataccaggctgagagacagctttaaggaatccccttcagagggtggaggcctgtgtggtcctggagtgacagtggtcagcatcctgctggaatacagctttgaatggatac

SEQ ID NO: 74129 - DNA, 1040 bp, Homo sapiens
tggatggcagtgaatatggaccatctgcaacacgcacagctacttttaccttgcagacgatgccatgctttccaacgagcctcagaaatgcatttttgtatttcctagggatagcttcatctcagggtactgctttgtgcagcttcaggaggggttggagcactccgtattgtgttcactcgtacgctagaaatgcaactggtttcttttgacctagtattataatagagctgggagattaacttgatgtttaaaacaactttaaatcccataacatgtcagacctcattcctgatttggaaaagactcaccattgacttgtaaaattttaaaaacccacatccccaaataatacagcaaatgtattcatttttaagggctccaggtggacactgcaggcaacaactatgtccgggaaaatcgtaagtttgactcctttgttttagtttctttgtcccctttcttcttccctttcatgacatttttcactgagattgttttcctctctttttagggagctcttgaaattcagcccgatcagatgcaggtagaagacatgtaagttgctttcagggatcagagtcgtctttgagacaagcttaacatttctcctccacttcctctgcagaccgtgaacgccatcctgatcgtgatcatggtcccgatcttcgatgctgtgctgtaccctctcattgcaaaatgtggcttcaatttcacgtaggtgacgggtgggttgggttggttgaggctcccttggtcccagggctttgcagatgggctgcgctcagcctgcagcccttcccgcaacctcgcctagaggatagggttttgaagaatgaagaaaacaaatgttcgtgtgctgatgtttctgaaaatgttctttaaaataaaaatgctgtgattgacagcctgaaaaggcctttaatcaaggctttcttctctacgcagatgataggaatggtcattgtaatctggagtatcacctgaaccatagtttctagaaattaatgtaaatatacaggccaggcacagtggctcac

SEQ ID NO: 74130 - DNA, 1035 bp, Homo sapiens
tggaaccagtgagggtatgatcccggatttccatgtgagatgtcctctcctgaggaaatgctgtggataatcctcctcagactaacaataccactggatgctttatttcattgctgtctctatgtggaaggattagtgtagggaataaaatgattaaatgctagtttcctgctctagacagtcaccggtaagttactgaatctgcgttggctgcctttcatgccactggtgctcctttgtggctatggaccagtggggggtgtatttcaatcctgtgcttgtttcttttttgtcagagtttctttggttatcccctgagcatcttcttcatcgtggtcaatgagttttgcgaaagattttcctactatggaatgcgaggtaactgtattggccgtttctcacccttcagggaagagcgggagtggccataaccagtcctaactttgtttccccctcctcttccacctgccctctgcaaaagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagtgagtggctggaaatttcttgttcacaaacaagcgaaaaagtaaatgtaggttttgtagttgggaatggtggaatctgggaatgatgaatcaaagaacagaaactcttaggagaggccaggtgtggtatggttcatacctgtaatcccagcactttgagaggctgaggcaggagtttgaaaccagcctgggcaacatagtgagacccatctctaccaaaaataaagaaattagcaaggcatagtggcatacacctgtggccccagctagctgggaggctgaggtgggaggatccgcttgagccccagaggtcaaggctgcagtgagctgtgatcacatcactgcaccccagcctggatgacagaacaagaccctgtctcaaaaacaaattaaaaacagaaacaaaccctta

SEQ ID NO: 74131 - DNA, 1050 bp, Homo sapiens
caacacaagggaccccagagtaatactagaaacattaggctactcaaatatgcctctgaggtttactagcagggaaccaacgtaaacaggactgcaccaaagtaaacagaatcttgtgagagttgatacttgagttcggtctgaagtctcgatgtaaacaccacttctgcatttgagctttctaagatagcaatcctgttgacacaggtacattaagataagaaatgctgactgcagtgttacacccagtagatagctctggattctgtcaaagagtttagcaacctctgccctgtaataataaaagcagttcttggaatacacactttcagaaaacaaaatgccttcttggtaatggctgggtactgagtctcagatttacacttcaagggattgcctttcccataatttagttaggtgtataatgattgttaagacctaagctttctgaatgacctcttttctgtaactgtagtgggttggagtagagaaaaactttaccactattaagcaaataacaggtacaaaatattgagcaaagacaaaaggacgactctggaaagatgaagtctttccctgcaaataaaaatccggggaacacaggaaaggaaggtttgtgatgaagccctgggaacacagggaaggaaggtttgtgatgaagccccgggctctctctgctggatttgggtgatttgggttttcagagctcgctcctgcttccctgaagagggccaaggataacagggacctttctgtgacttcacctctctcgttggctttgggaggcaatggtaaggccatattacccaaagtctaagtaggcgaagcataacgtgctgttgccgtgtcctcaagaacgcacggcactacagcaatgacgctttgcaccttcaggctggtttgcaccgagcttgcaaaacacacgcttgcccgaccagcccttcctattcgccggacactggcgctttccctgcctggtgtgaaagacagcccaagtccacagcaggtgcgctgcctcaccacggacctcccaggacacagaggccatgc

SEQ ID NO: 74132 - DNA, 1116 bp, Homo sapiens
ttcactatgatgacgtcataccagggtagggtggcccctaattcaatatgagcagtgtcctcacaaaaagaggaaatctggactggacatggtggctcgtgcccgtaatctcagcactttgggaggcccaggtgggaggatcacttgagacaagaagtttgagaccagcctgggtaacatagcagaccttgtctctacaaaaattttaaaacttagccgacatggctgcacacgcctgtggtcccagctgcccaagaggctcaggcgggaggatcccttgagcccaggagttcaaggctgcagtgagctatgatcgtgccactgcactgcagcctgggcaacagagtgagaccttatctcaaaaatagcaacaataataaaaatgagtaaaaagaggagatttggacatagactcatacacagggcaagcgccacgtgagtatggtggcagaggtggaggtgatgttcttacaagacggggaacaccaaagctgggcctcaaagcaccaggagacaggcccaggacagattctcccttgcgtcctctgaaggacccaaccctgccgacctccatctcagacttccggcctccagaactgtgaaaggccacatttccatgttgtaagccacgcggtttgaggcactctgtaagacagccctggcaaactcctacactgaccaggagctgtccccaggctggagccatggacacccaagctgagggaggaactgtcttaaaggaaggtgaaggcaggctgtccagcacacgacagatggcgacagactttgcatggaagaggtacaggcaaggcagctcatgacccatgtaggcgggaaaagcagccctgtagcagcaggggctggcgacaggtaggaggtggctcattgccaaggagccggggccaggctgcggctgagtggttttgtgttccatgtctctcttgtgagggtgctgggcagaaagctcccccaccgcctcaccagaatcctcgggggtcctgagggaggtggagcccctcacggccttcccattctcttgtgttctgggaggaccaccaggcgtctgctgagactcaggtcagctgcagtcaagccttggcccagtggcccacgtgc

SEQ ID NO: 74133 - DNA, 1036 bp, Homo sapiens
ggggctaataaaccttaaggcaaacatcagcatgtctgggagaagagcctggcgctgagctggatcgtctagtcataaatgcctcatccagaaaccataaaactcaagtcaccatgtagtaagataaatagaagtctagaaagagcccatgtcagataaaggtaagtttggaaggcgaccaagccttgcttatgacaggagtggagagaggagccatctctaagttgggaacatcctgcagggaaacatccgtatcaattaaatcttcccttcgttatgtacaaagccaggtggagcattttcttgggaattcgtattgctattctgcagtaaatgtggggttttttttcccataggtcctacttattctttcttttaattgaggtaaaatatgcctaaaatgtaccagtttaaccatttttaagtgtaaggttcattggcatcaagtagattctcattgtgcaaccatcgccaccctccatctccagatactcatcttcccaaactcacactcagtactcattaaacaggaactccctacttccccctcacaacactgcttttgaggcaacactggaattaaaactctagttaagaccttgtcctggatattagccaggtgggaacaaatagagccagacccttgcacagaggacagctgctgagagcaggactgcaggatggcaaggtaacctgagtgacgagaagcagccatccagaatggtttcatcatataactcaaagcagtgactccgttccaagaaaatgtgatctccatccatgggggatcgtttgtataaaccatggtacatccacacagtggaatactgtgcagctgtaaaaatctgctcatttaatgtatacaatttggctgggcgcggtggcgcacacctgtaatcccagcactttgggaggccgaggtgggcagatcacttgaggtcagaagtttgagaccagcctggccaacatggtggaattctgtctctaccaaaaattcaaaaattagccaggcatgctggcgggcgcctgtaatccc

SEQ ID NO: 74134 - DNA, 1051 bp, Homo sapiens
tgtgttgcacgtggcaacattgccttaaactctgtaacattttgttacacttggtaacattgtgtcacacatggcaacatggcattgcatatggtaaccttgtgttgccctcagtaacgttgtgtttctgtcctcaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaat

SEQ ID NO: 74135 - DNA, 1325 bp, Homo sapiens
ctgtgtctccacgtctggtgtgagttcctgtggctcagttttcctgccattgctagacaagtcctgcctaccatgggtcagaaccacacacggggagctcccctaattccttgctaagctcaccagaccttccgggaaatatcaagcagtgaccacatagtcacgttcttccccaggctgtctcagacgcctggaacattcttcttcccatcccagtgtgtccagccttctttctcaccacgttcttacctttccttacttatccagaatcagcagacccttcttagctgcttgcaagggtggtgcagggttctggttcactcaccgtgctgtctgctcctaacatctagctctccagcacaccgcaaacgctcacttcatcccaggatagcaaatcagtttgcccatggctgtctatacaattcaatgaaatgaacagttgggtttcaaaaactggaatagttactgcatttttcaatttttcactgaattcaccagattggcctgttagttcagtgtagtgcagcacaaatcccagtgactaaacaccttggaagtaagaatccttgacctggatttggaagacctgggctgtgatctctggcgttttgcttattggctcttcaaacttcaacaggcccctaagttttccaagcattggtttcttcttacataaagtaaaccatcatcacaagtgccctgaagatggctgagatcatggaatcaagtggtgtgcaacagagtgaactttgtggtttctttttgggcttaagttcctggaaggcagggattgtgagtagctcacgcgaacgggctttttagtgcctgcaaactgaaactgagcagatggtcatggtgattttcttcctagtggaactgaaaatctttgctctttgtctaggtcaatgctggcccactagcatatgcgcgagctttcttagatgatacaaacacaaagcgatatcctgacaataaagtgaagctgcttaaggaagttttcaggtaaagcacactgaaagcatctttttctcttcgagtattgatcatttctgtactcattcgggaaggagatgctgctggttggactcatgccttatcctctgcgtgcctttgtttctcccgcctgtaccattccaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagggccgcactggctccaacaacttggagttcttggttaggggttt

SEQ ID NO: 74136 - DNA, 1052 bp, Homo sapiens
tgaaaccttgtctctactaaaaatacaaaaattagctgggcgtggtggcacacccctgtaatcccagctacttgggaggctgaggcaggagaatcacttgaatccgggaggtggaggttgcagtaagccaagattgtgccactgcactccagtctgggcgacagaatgagactcttgtctcaaaaaaaaaaaaaaaagacgtacttctttataatacagatacaaaggaaaagagtgggtgtgaaaaccttttctgatttcttcatgtcatttgctgctatggtggttactacatgtatctggctttagtgtttgtatttatgagacctgcaataaaagcaggcaaaactgatgtaccttttaataagcaccggtacagagttcagtcacacaaatgacacttttatgactcgtgtgctataaatatgatgtaggaggtaaatggtcttgcttagatagcgttttctgctaaattgagtcacaactgctttacaaatgtttatttactttgaatctgtaatctttgtaggcattagtcctgtagtgaaacattagggctggtaatgaaaaacacaggccttgcccttcatttacagtattgtgaaggatataaacattttcaaaagcaactatagacccttaataaaatattagtaaattgaaggctgggcgcagtggctcatgcctgtaatctcagcactttgggaggctgaggtgggtggatcacctgaggtcgggagtttaagaccagcctgaccaacatggagaaaccctgtctctactaaaaatacaaaaaattagccgggcatggtggcacatgcctgtaatcccagctacttgggaggctgaggcaagagaatcgcttgaacccgggaggcagaggttgtggtgagccgagatcacgccgtcgcactccagcctgggcaacaagagtggaattctgtctcaaaaaataaaaaaattaaaattaaaaaaatatatattagtaaattgaatctagcaatacataaaacagagaaatgcatcatgaccacgtagggtttattctggga

SEQ ID NO: 74137 - DNA, 1055 bp, Homo sapiens
atttgcccttttaactttgcatggacagacttcactctccttccctcctactctgtggctctctggttggctggtctattcctgtgggcacaagaggaaagcaccttggccaccatttttgttattccattggctccgagttatgtggtgaaatgtactatatagcctagagcatgggtggttggtttttttaattttacagtttgtatgttaatgtatcctcaagttcctagattaatgcttttcatgggagactcttgtttccatataacaaaataaaaactaaactgggatagtggcagatgctggataatccatgaatagtgtagaaacctgggatcatgtgcagcagaaaaatctctgacttcaggatctccgttttcaaggcttgatttcagaataccctgtgttcctctttctccctaaatgtagaagtctcaattcaagtttttacttctgttttattttattgtgaacagttatctcaaaatagagtagtggaacatctcatgcccttcttcacttgatcattttgcatagctgacgtggtccaactgacttaaagctgttttccagtgactctaagacgaggaaaggtcccaaatgggctgtcattgcttaagaaacacatccttatcccagacattgatcctgcctctaagctaacaccatttcctcttggagaatcagagtgcccaggcatccatgccctctgttgatgcagccagccacccaccccggggcctctggggtgggaaccagctaaggcagcctgtctgctcaccattatggctacgaagctacacctgggttgtgtggggaagctctcatctgagagatgtgttcttccctggccagagtgggtgaggtgacagcttgaaggaaacagttctttttgaatcatacatttctcttatattggctttgcctttgtttttcttagtatctcagcacgagtcatcctaccaagacaaattttcacttattgttattttactattactttgatttaatacctatttctcagtttatagtttaatatttagagattgcat

SEQ ID NO: 74138 - DNA, 1053 bp, Homo sapiens
atgctaaaaagtacacattaacgtgacagttttgactataaatttaatgtaaaccacacattggccataataaaaaggaataactaagagaagtaacttttctatcattctaagaatttaagattctttaatgacatatgtggcctaggtctcaaaaaaagaaaggaagaacttactaagcttcagctgttcctctgtgaattagttttacatggctgccataacaaagtacccagactgagtggcttcacacagaaatgtatcctctcacagttctggaggcagaagtccaagattgcagtggcagcagggccacatctccgaatgtccttggggagaactggttccatgcctgtccctgagctctttgtgttgccagcagtcttgatgttccttggcttgtagccacatccctccagttcctgcctccgtggtcgcatagcatccttccccatatgtctatgacaccagtaatgttgaatttagggcccaccacacaccagtatgacctcatcttaactaattacacctaacagagcctgtttccaaataatatcacattctgaggtctcagggaggccatgaattttggcgggacactacccaacccagtatacccagtgaataagggacgaaagcagctaatttataagatttcttattgcccttgccgtgtctggttttgtgtgtgtgctcagtaacccgtcatgtactttcctgcctgttcagtgcatgtgaccctgctttgtactgcaagagggacacacgtgggaggcatgaactctgcctccgaggactggacagtacataactccactctccaacagacttctctctgcacacatcagagtgcatgccacgctgctaacattcgttgacacacgtgcacgtggagcagcctctgctggtgtgtgttggctagtagctaggggtgagggtctagacgagggcaccacgtggtggcgctcaccccgctgacaggcacagaaccgcatgcattagaaccttgcagggggttcgcttctaacagctgtctttgatctttataacacc

SEQ ID NO: 74139 - DNA, 1008 bp, Homo sapiens
ttttaattaaaaaaaatacatgtcttttgctttttcagaacatatataatccaaaaagattagtgacgttttgacagtcgtcagaacactaaccattagtactgcattggagtgatgctcacttttttcagagtagcatctctaaagtactttctaaaaataaaaaggtccctgctttggcctgatttttgcttctggatcatcaggtgctttgccgtgaagtgtgcaggagctgccgcctgtctgtgtctctggctgctccactgtgttcagtcagtgcatggccatctccctcgtgccatgttctggcttcactaacactccccgtctcgctgcagtgtaacacgtctaacttttgcttctatcccatttcactcatgttgcaggaaccaggaggggttgggacccatagttcatgatcgaaagtctcagacattgcctgtttcccgtaacagaacaggaatgatgcatgccagattgcagcagctgggcagcctggataactctctcacttttaaccacagtaagtcccatgacatgccatcgtaacagccagccatctcatgtgccatctcagaggggagagccctaggccacacctaccacatcaccaactcaatttttcttctagctcaaagcaagtaggatgaagagctcatggcacagttcccttccttggaggagcgtcctcagcatttgggagtgacacaatgtggaacgtgctcaactacagcactaaacctaaaagtgcctgaccctttctgcatccctaaaacaaaactcggctgggtccatagccagccgttctcaagaattctaaacataaaatttggattcatcacctagaaccgacttaatgttggctttcccctgcaactctgagaacattcgggatggatttctttcaccccttctgatcctgtgcatgtaattgatcaagcgtccacattctgacattccagctctgaatggatgttaatccttgcactactgtgaaaacataaagcc

SEQ ID NO: 74140 - DNA, 1034 bp, Homo sapiens
tcgaaacgtgttgttttctgtgatgcctggctctgattgtgtgggattggtcatcagtggcggttggcagttggggttcatggaagcggccatggggactgatggcaggcccttggattgccaccgcagagcctggcagtgtctttggtctgcattcctaccggcgaagtctcatttcacctcacgtgttatctcttggaaagcattcctttagcgggctgtgtctacccttccatcctctcgtccaaactccccctccttctctgttctgtctccttcccatcctcttctccccagttcttcttcctatgttccttcctcagtggtttctcttcctctgtttgactttccaaggtcattttgactgttcctgctcccaactacaaagatactaaaatctcacctaaccactcttcttctttcttaatgaaagaatgttttcagtccatcccaaatttgtgtggacttccacaaaccttctctaaaatggagccttttctcttcctactcttgactagttggtaaacgctccatgttcttggccagaactccctggtgagtagcgtcactcccactttcctgtgcagaaccagcctcctagaaactccttgcagctgtgtggctggacacgccttctttgggggcgtttcttcgcagcacctcttgtccttaccaagttcttcctcctgccccactgccattcagattgtctgtttgtttttttctgtgttgtgagccattctgtgttattgtattagtggggtcttggtctaagtattatatttttttactgttgtttttaacagctttattataagtaaacatgttttaagaaaaacttaaaaatgtaattgtcattgaggtttgtttctctatatatcgacaattttgtcttatagtgatgaaataggccagagatttttagtagacttcctctttgtgaagattttctttttctgttaacattgttcttttctggggatatttgagaaattttcagaattacattttatgttaagaagtaaacatgtatg

SEQ ID NO: 74141 - DNA, 2104 bp, Homo sapiens
gcttctggctgaggtcacatatcactgtgttctcctcgaaaatttaaaataccccatgacacccctcagagttgggtaggctcctcagtgtttattaccagtttgaatgctacaagtttgttgtgtggtttaattttgtgatttgatagttgtaggtggatttatcttttaatttttttaagtcttcattctatcacattctgaaacaggtatgcatttagtctttagcgatcaaaggtggtttctaacaagtgaattgatgtttacatctgaatgtttcagactagtttctttttatctcattgtatatgacctggttctttaaaggtgaagtaatggaatgcaactcttgagccaacttcctaacagaaaaaataagtgcaataaaagcaatttcccttaaagttcagtactcatctttattttgttctgtcttaataaaactttattgttggcttgatttccatttagcttctccatatacaacctcaactccaaacatcaacagtgtgagaaatgctgattcgagaggatctctcataagcacagattcgggtaacagccttccagaaaggaatagtgagaagagcaattccctggataaggtaattgcttttcacccaacacaaatgtttcttataatcaatggatttagcccaaagtaaacgtacttcatgttctagtgccttttaagtgtgaccttttgtttttttctaaaccacccggctgacctggagtaggtgatgagagctttaaggttggggcccattccttgaagtgctctgattcctgtttccagtacctcagatcctgggcagggtttgcagtggagcgtcttgagtgaatggctctggtgggttgaacggggagggactcaaaatgctgcccatctcaatttcctgtagtctttttatttatttatttattttttgagacagagtctcgctctgtcgcccaggctggagtacagcggcacgatctcaattcactgcaacctccgcctcctgggttcaaacgactcctctgcctcagcctccccagcagctgggaccacaggcacaagccaccacgcccggctaatttttgtatttttagtagagatggggtttcaccatattggccaggctgggctcaaactcctgacctcgtcatccgcccgcctcggcctcccaaagtgctgggattacaggcgtgagccactacacctggccaattccctgtagtctttataccagagacaccatcatcaacacagctctccacccacaagggtgttaggtctgaagccagctccagagaataattgatcatataggtgattcaggggtaagaaatcactttattcacacagcacgcacccacaacacaacacttcctcctcatacttagccttttttcttgaaactactaagtgctcagaccatttggaactttgtaggaaaggataaagtgtgggtttaaacctggagccatggtagattggtatcactttgggcacagattttctaagttacttcaagttacaggcaagtgcccatcccaataaacagctgagccatttagggatttatccctagttctccaaaaacacccggaagacatccttcctcagcatcaggtttataatcttgtcacgcatcccatggctggcattgacatggttaccattaaatgcagttctgttgaggtgcgagcagctcagtttgggtgtgtcatgacgtattgaacttttcccttgaccccaacatgccttcatgtatagagggagaagctgctccgaaggcactctgcttgtgtcatacgcagtgctgaagaggaggaggagagctgccagtcagccaggaaaaaccgggtcactgtggatttttcccttctaatgattccacctttgccagaggagacattgaatgcaacaccttccctcccactgccggaagtactaagttctccagtggctctgatcaagtgggcaggccagagggtgcatccataccagttttgccactaatttcccctgtatttttttgtaaatgaaaatattcacatattttattaagcctgatatatatatgtatatatatacacacacacacacacgcataat

SEQ ID NO: 74142 - DNA, 1753 bp, Homo sapiens
gaactgggtttactagtttttttctggcagctttaacaattctttgttcatcagggagtttctagctaattttagtcctggtgcttctccttcaagagcaaactctccttacatctctgttagaagaatcctgtttccacacatactgagaatgtgccgtcacagttttttaaatgtctttggatcatggtgcctgagagttttaaaagtgattcactgcctggataaaaactactctgagattacattcattttaaaaggcaagcgtcctgaggctcagggtttctttttccacctactcagtggtaccaagggaagagggacgaatttatcttcttttcattttactcaagtgtcgtttaaggactttaaaagctatgcactgggccaggatattaaatacaaacacatacacaaagacataaaaataggaacaaactaagcatattgattttgatatattgcatttccatctgtttgtcttaaattaggactctagttctggaatcaagcttgagactctgagaacttagggcctaattttactttactgaggacctctttctcttgagttctgtgttctttttcatgacttctgtgttcttcaaatgctgttctacattaaatatgaaatatgattatattagaaaaattataatttggtcatagcatgtgtttcttatctgagtacagaaaaaggccatagttttttcacagggtttttacctgtcccttgcgacaatcattcacatggtttctctcctggggagacgcagccactggctgacaataaggcttaatgaaaccatgttcaagcctttgcttcttttttcaaattctcctggctcttcttttcttgatctttaatacactgaatcagtttcagggatagcagtgaataaatctgagtgttcaacagagggaaggatttatgaccttgatgtcacaggtcttccttctaaggttaaagagttaaagactgaccaggcacggtggctcatgcctgtaatcccagcactttgggaggccgaggtgggcagatcacctgaggtcaggagttcgacaccagcctggccaacatggtgaaaacccgtctctactagaaatacaaaaaaattagccagggttggtggcagtcgcctgtaatcacagctacttgggaggctgaggcagaggagtcactttcaaatatacttttggtgtaacctagaggctggctatatttattttgttgtttatttattttttaacttagaagtatcccagtccatggcagctcatttgcctactgagatctgaaaacaaccagcctgttgtgaagtgccaagtaatggcatcttcagcttgcgtctgggagaatgtgtgctcacagctgccagacacagagtccaaatctcctgatgccatctgccaaaccagccaggcctttccgctggaggcacgccttttggttcagcacggaatgtacaagtccaaagagtcgttttaaattatgtgatttatttaaatcttatctaagcaggaagtcaatctattaccttaaaaaattccatagtaccaagatagggagtgatttctgccttcaaatactgtttttttcatggacatcacaaattttatttccacattagatttcctttctgctcatagttgtttatagcagattcccagatattccccgttcacagcacccttagtgtcactttatttcgtggcatccctaggctgaaagacacacccagcagttctcttt

SEQ ID NO: 74143 - DNA, 1035 bp, Homo sapiens
ggggaaactgaggccagcatgcttgagttacttgctcaaggtcatgctaccagtgagtggagcagccaggttttgagtccagtctggccccaaaggttgtattcctgaatcacttggttattaacctaaagaaaaatatgtcttttcctttgattagcttagaaatcttcacgtttgttgaaatggaaattgtggtttcagcataaattctaagtgtcattacccatgatttattaagtgtcttgaccgtcatagacatttattcttagatgggagtatctcaccaatctcatgttctccaaaagcaatcaacagactctgagattatccatctcgttggggcagatgcgcagtctcaaatttcttctctgccccagcatccccttgtggtgaagcctggatgtgtgttcctttctgaccgtgggtcccccctgcttcccctggttcccactgcactcagccctgagatgactggtcttgtctctggactggtgcccactgaggtgtgtttggccacctcaggctctctgaggctcaaggtagataagtttctataaagttccaatgtagtaaacagaagtggcagtgtcactttctcattttgaagtttccagggctcctctgagacctgcagagtcctggagttgtccttgtgacagtgaagtagtgtagttgtttggaggcagggtctggttgaagtattatagaaggagcttgtgcagggagcgggtggtgctgggtcctgtctcacaatgaacacttgtgctgcaatccttgtaggcaggagaggggatagggagggaggggcagaatctaggcctcctgcacaagggatctgggctctccgaggaagccttggaaaagcctgctagattttgctggcagaaggttgatggttcaggcctaaagccctccttttcctcccgtaaagcagacactgggcctggccaggtggtttctccttttcttttttctgtctctctcttttgaatccagtttagagcttctgattttagtgcatagggagatgccaga

SEQ ID NO: 74144 - DNA, 1024 bp, Homo sapiens
ttccttatgaatggaaagaaaaactgagggcagatttatatggtaatattaactaacagagctagctagttctaatattagtaaataccatgaaggcgtctttaagttcacgcatcctattcacttttatgtcatagtagaggccacatggctttttaagaaccaggtgcttactctgaaatagtccattgttaagtaaatgtcacaaggttaggtgaagttgtctccttgtaaaacctgctctcagatcattaatgatgataacttaaagtgatactacccccaagggtaatgtttcagtggttcaaagtctcaagcttcacaggaatctctggtggtggaatttcaggcattagctcgttgatgggaaaaaatttttttgatgtttctatgggtatgccttcacaaactttcccaagtgttttccaaaaatcacgtctttctgttttttattttctatttttaaaatcccccttcaatagtgcatcaaaacctataactctgactggcatcttgtgaactataaatatgaagattactcaggagagtttcgacagcttccgaagtgagtaagctatattatacacatagggaaaagtctttgtacttgaaatgcttggggggaggtatgtaacttcatatgcaatcagagtaattgaggaaaatatttttagatggtttatgtgtatgtggtgtaactattgtttacagggcctttgattgtaagactcaaacatgctactttggtattgataggtagtaataaacatgtggatggtttaattatgtccagtggttcttttcagggtaccactgataaataaataggtgaaattttttcactacaaaatataaaacaaacaaaacgtaagtgtactgaaatatgctgcagtgcattttttccttgaaaagaatattttgaagaagataattataaagagcattttacattgaataaattttatgtttttaaaaaaagtaaatcaagaaacaagcattttcccagttaaattttttttttatc

SEQ ID NO: 74145 - DNA, 1175 bp, Homo sapiens
ttttgcctaaggtattaaaatcttggccaggcgcagtggctcacgcctgtaatcccagtactttgggaggccgaggcgggtggatcacgaggtcaggagttcgagaccagcctgaccaacattgtgaaaccctgtctctactaaaaatacaaaaagtagccaggcgtcgtggtgttcgcctgtaatcccagctactcgggaggctgaggtaggagaatcgcttgaacccgggaggcagaggttgcagtgagccaagattgcaccactgcactccagcctgggtaacagagcaagattccgtcttaaaaaaaaataaataaataaataaaaatctgggctccattcataaatgcatttataatatacaaatttatgctggtttatttagtttttaattgggcaggtacattttatacttcagaatagttttaatgtcctgcaggagacttggtggtacaatttcagttctagagcttgttgaaaaaccgctgtagctctttgaagagaataggatcacacccacaagaccacgtcgtacatagtcaggcctgactacttagctgtgccagtggacctaggggcagtagtgggaaaatccaaaactatggattattctgaaatctgactggttttggaatgaaattttgagtgtgaatgtatgatactcaaaatgtgaaaatgctttgagaaatctaaaaaaatcattttcaaggataaaatagcattttaaaatattcttaactacagagtaaaaaaatcaaaaagtttgccagctccaaaatctgactttgcgcttagcccttctctgccatttattccacctctcagaataattttaaaaacttacattaccttcacatcacacatcacacccttgccagtaaagtgcttattgtagagcctggcacaaaataagcacttgctgctgttgtaattcttactttcatgagtttggaggtggaggggagtttgcttcagaagaccttcaggcatggcctgtgacacagatagaaaggttgacagtagaaacgatgaagtgaaagaagcagaatagagacgttgttcatgttagttacagccagagccaaataaactagataaggcataaatacatttatcgacctatgttttcattgattcactcatgctttttttccacccacactgaagtctgc

SEQ ID NO: 74146 - DNA, 1090 bp, Homo sapiens
tgagtagcttggactcgaggcgcatgacaccatgcctgggtaatttttttatttttagtagagacaaggtcacgctatgttgcccaggttggtctcgaactcctggtctcaagcagtcctcccacctcggcctcccaaagtgtatttactcattcttgaaacatttaccgagtatttagcacatagctagaaataggaagatgtatctcctgttctcaaaggaatttgcaatctggtggggtaaagaagggcatgtgggtacaggagagttttggataatggagtcagggttgactagctgttcagacaggtctcggggtggtttataaggtcaccatggtacaggatcagacctcaggtttgcaagtccaaagatgggatttggtcacccagagtgtttcaggctcaggggaactgacttgttgcaggcaaccccacaagagcacaaaccagaatgtcattttattaatatgcattgagaactagaattcacaagcagatcagaatactacaccggctgtgcattttctcccagtaggaaagtctaaatgggaagcatattataaacaagtggctcagtgaggctgtactcagagcaagggcaatgaattagaagaccttagcagctggtggtatcaaacattgacggccccattggtgccaagcctggtagtcctcccctcccccatgggtccagcctaatgggttccaacctttcttttattattattttttatttattttttgagacaggctctcattctgtcacccagtctggagtgcagtggcgtggtcttggctcactgtgacctccgcctcctgagttcaagcgattctcgtgcctcagcctcccaagtagctgagactacaggcgtgcgccatcacgctgcctgatttttgtatttttggtagagatggggtttcaccatgttggctaggctggtcttgaactcctgatctcaagtgatctgcctgcctcggccccctcaaagtgctgggattacaggtgtgagccaccatgcccagctccaacctttctctgaaatagtgatagagacactgacagaattcctccagccatggaagcctg

SEQ ID NO: 74147 - DNA, 1079 bp, Homo sapiens
ctggcttttagagccttttagcttcattacttgccctcttcatttcagagttccaaaattgtttttactgacctaggaagaattaacaattttaggtcataatgctaaaaaaggaagaaaaatgcctggaagagtctacagtctagatttgagatagaattatttatacaactgtaatagcacatctttttcttttttgattttatttctttccacatgtgaaaaaataggcagaattagaagccgagactactgtatgtgtgtgagagacacatgctgggcccactgcaggcgctctacctggttctcgctgtgttccccttttacccttcctggcctggtgttggcccatggccggtatcagggtagggagaagacacatgaagcactgcacttgcaagggagctgctcccgttccacctagctctctcctcatgtgactccccgggcacaggacatggaggaagtctcctaaattcccgtcttgtcttcctctcctcattgacattctcagcagcatccccagcgagcacagctgacgacggcaggcgaggagttgtgtaggttttccttaattggtattattattcctgtctttattattatttccatttccattatcatgttcctcttacctatttcaggtgctattgatttgacaaaatcagattttgtcagatttgtcaaatctgtataactgctgtataaaaaggaaattcaacatcgtgttagtgtttataatataaaaaactgcattcacaaatgtctaattgttggtgttagtctgttcttaggataacaccacactggagcatgaaaaatatatttagatgtctgggagtttggtgtttcttatgcattcttccaaatattctccaaagcattaactgctgtagtttaacactcaggtttgagcttatttctaaatctaagtttaggtaagttttcctttttcctctagtatttagattacatgtgtatgcacattgtcaatgaaagtgcaaaattaaaatgtaggcatcgttttagtacgggctgagacaagatcctgggccagggctcaggaggttcctcctggg

SEQ ID NO: 74148 - DNA, 1013 bp, Homo sapiens
ggtaatgccaatagtcatgtaataataaaaatagccactacttatatggttccctgctctgtgccaggaactgttttatgcctgctaaatgttatttcaattaatcctcacaactctaggaggcaggctctattctttttcagacgaggaaactgagcacagtttcctcttgctcaaagttacacattcaataagtggcagagccaggattgtagactttgggtcaggttttctaaaatccatacctggacacatatgcacgattcatgaacaaaaatgaacgtattcacttgagcttagcattgagactgtaacaataaacaagaaaggaaaaacacactgctcttaaaaacttgaaaattgttagagaaaggccagtttataagtgataaccaacagtggttgaatagcatgaagacaatggtggtcatgtgaagaactaagaaatatgaatgaaatagagctgccgtcaggagtcactcttatcttgggtgttacattttatcatcttcccagaaagttacataggagcatagactggtgagagtctaagaatctgcaggcatcccgttttcctccctattttcctttctttttgagatggagtctcgctctgtcacccaggctggagtgcagtggtgcgatctcggttcactgcaaggtccgccttccgggttcatgccattctcctgcctcagcctcccaagtagctgggactacaagcacccaccacaacacccggctagttttttgtattttttagtagagatggggtttcaccgtgttagccaggatggtctcgatgtcctgatttcgtgatccgcccaccttggcctcccaaagtgctgggactacaggcgtgagccaccgcgcccggcccctattttcctttttaaaaaatttatagatgatccaggttaatcctgaaatgtttattccctaattagtaaaatgggcactgtggtccccatagtgtttacagaggctgccatttgtgcaggtgtgctctactc

SEQ ID NO: 74149 - DNA, 1019 bp, Homo sapiens
agagtaatatttgatcccccctttaatgttcatttctacataacttttagacaaatcccttaatacctctgttttaatttttcccaagaggtaaaaaagactccactgttaaatgtgaggaaataataaaaatacagacttttaggaacacatattttgggtgctactaaaccaccattgaaccgtaggttggtgatccagctattttcccgtgcttttgtgcatctctctcttaattttattaatttgtcatttatgatgtctgctcttcttgccttcccagctagatgtgaagttctttgaagggagagatactctaccttatacttttagtatgatcctctcagcacctagtactgggggtaccttctgatacccacacatctggacttaaagtaatattctgtttaataaatgcatttactatgatatgtggtatcccatgaaaatgttttgatgacctcatctttctggcatcaaatagtacataaattaagtgtttcatgctgtggtctgtcatgcggggtgaaactcatttcctccacctgtatccacgaggtgcaggctatgggaacatacttgctggtagctcttccctgctttaatcatcagccaggcatttggtttttaaccataacacaaatgaaagcattccaaaactggaagaattttagaacaagcagacaaccttgctgtctcttaagctccacgagcttcagatttaaggtaattatgaaggagtctaactgtgactggttttcttttaaacactgcagtattttgattccgattgatttggcccacgctgtgtggaacagacacaataaagccggtctttatcagagaggcagtacactgtgtattgttcagcttggagtttgttttcctttggccagcaagtaggagcctccccttttgcatggagtagtaacacccctggaggctggcctttgctgtcatgccttcccaccccacaggctctgcagacccagccagcggggctgaccacttgtgcctgg

SEQ ID NO: 74150 - DNA, 1317 bp, Homo sapiens
aatggtcttaattttaaaaacaacctctctgtgcatcagtaatttaaacccttttccatttttataatttttgaatcgccctctttctgttaaaaaagaaacatgaaaagaaagaaacactgaggataagttttagtactgtttatgttgtctgtcctgcaaccccagacacgcaggacttggctcaaatcaggcaactggagaattcaggagaaggccagatgatctggaaacaagcaagggaaatcatcattcaagaaatccttctattaggaaatgagattttaaaagccaatttaaaactatttttgcttttcttgttaaaagaagggttgttttggtatcctctcattagtcaccttccagagagagagagagagagagtgtgtgtgtgtgtgtgtgtgtgtgtgcgcgtgcatgcgtgcacacatctgttcataagctgctcctatgacctgtgttccaggtcacacactcaccctctgaacatgtgaacaagaagattaattagttggaaagactattcaaggaactcagggaatcgccacactgggcttttattccccacatctgcagtgtcttagcctccattgccagtgactctctgaagtttgggttaggtctttttatctcaagagtcaaagggggagatgatacaaatcattgacttcctgtcaccctgttatctgtggttaggtgattcacgtagcaaaagtgtgatccgagcttgcttccctttctccagccccaaggacactatggttggcttcctccaccacccacttattgtgagtttggggttgcaaactaattttgacagtagcccaaagtgaaacaccattaggaagatgagcctggttgctcagacccacagggaaatctggaaggccttggattgtctgtgccttcgcctctctccatgactatatggtaatcattggagggtgagatgaggggtcccaacgagtctgtgcctagactttagcagttggacgattaggggccatgcagcctaatctcagccccatttgagaatgttgctcctctgtgcctgggtgggtgatggattggaagaggccaggtgggtagggtaggggctgacctggaccatgcttcctgtaccacaagacttcctcattcatggatttcaccaagtctcttggttcggaaattcttaaaagggttttggaagcttggtgtgagactctgcccggatcattcagatggaaaccaaggccatgagtgctgtaagtgcatccgaggttaaaaaggattttcgagtgctccacacataattggtgccaggtgtttcccatt

SEQ ID NO: 74151 - DNA, 2213 bp, Homo sapiens
aagtgctgagagatggctcagaactggcacattcagtggtttttcaaattgtaggccatgagccacgagtggtcctgaaaacagctccgtgagctataccactttcctccctccctctcttccttccagtgaactctaatagaccagagacgctggaatagcaattaatattgtgtgacacaggttgtaattgcaattgtatttttggaaatatttttacacacatttaccgtatcatgacttacaatgagtttctcaatatgattcatggtgacaatactttgaaagctagaggtctaaagagacatttgaccttgcggttcccttatccccagcctctggtggtttaatgcgttgatttctcggtagcactccacgtggtgttcgcattggctgcagcccttcagtgggcctgagcatgaggatgggcttctgtcaaaatcttgtttccttggaacaaggtccaaagatggccattatgaatgggatcacatgtaaaactcaacttttagggttgtttagaagattaaatgaggccggatgtggtggctcatgcctgtaatcccaacactttaggaggctgaggctggtggatcacgaggttaggagttcgataccagcctggccaatatggtgacctctgtctgtactaaaaaatacaaaaattagctgggcatggtggcgggcacctgtagttccagctacttgggaggctgaggcaggagaatcacttgaacccagaaggcagaggttgcagtgagccgagattgtggcactacactccagcctgggcgacagagtgatactccgtctcaacaacgacaacaacaacaacaacaagattaaatgagaccatgtgactcagttctgtgctcagtatttggaatatagcaggaattcattcccgtgtagcacactgttaaaggtactctgctagagtactctgttagaggtactctgcactgtgctctttatgtaatgtttatctttaggttttacatttaaaatttaaatctcctacattgttgagatgactagactggcctcaatagagccgatttttaaatatgaataaaatttcatatctcctgttaacctttttccatccctcctctgatttttttctccaattggtatttttttcttggatcttgagaactttgtggttaaagcagagatgaaaattttgtgggaaaacatctgcaaaataaatttctttgaatgaattgggatagatggcttggccctcaggtccagacctccctaacataataaatgaaccagttattgaccagacaaaagatttcccttaagtgctctttaattttaaagcagaatagctttaactggctcttgatgaagaaatcatcttaccattcttagctgtcctctcttctgcatatgcagtgccaggagtgcttttgggcatttgctgtgttagggtagtgatatgttttggaaagataacggtattgaaattagggtactttcaagagaaattcaactttggattgatgtaccctctgatatgtgctgtcttgtttttaaagaaacacctttatcaggatatgattcatacatgaaatgattcatccatttaaaatgttcagtggttttcagtatattcagagttgtgcatccatcaccatagtcaattttagaacatctttattactttccaaaagaacactggaccccttagccatcaccccggaactctgctccacccaaccccctagccctagggaactgtttttttttttttttttttttttgagacggagtctcgctctgttgcccaggccggactgcggactgcagtggcgccctagggaactgttaatctgctttctgtctctagatatttgcctgttctggacatttcatagcagtggattcatgcactatgtgatccttatgcggggcttctttcacttagcatggttttaagagtcacccatgctgtggcatggatcatacttcattttttaaaagttggtacataatatttcattgtattctgtagttgtttatccatttatcaattgatggacatttgtgttgtttccaatttttgtttattatgaacagtgctgctaagagcattcatgtataagtttttgtgggaacatatattttcaacgttgggcatctaggagtggaattgctggatcatacggtaacctgggtttaaccatctgaagaacagccag

SEQ ID NO: 74152 - DNA, 1068 bp, Homo sapiens
cccgggttcacgccattctcctgcctcagtctcctgagtagctgggactacaggcacgtgccatcaaacccggctaatttttttttttttttgtatttttagtagagatggggattcaccgtgttagccagaatagtctcaatctcctgacctcatgatccgcccgcctcagcctctcaaagtgctgggattacaggtgtgagccaccgcacccggctgctgttttttttgttttgttttgttttgtttttaaaaagatgattaagctggtgaggcatctctttttatatatgcattttttgacaaaaattccgtatatttagggtatacaacatgatgttttaaaattggaatggttcaatcaagctaagtaacatgcaatacttcacatacttaacattttctgtggtgagaactcagttctactctcagctatttatttactgtagtcaccatgtttatactgtattccccctagctaactgaaattttgtatctttttaccaacatctctccaaaccccacccccagcccctggtaaccaccattctactctctacttctgtaagtttgacttttttagagtctacatctaagtgaggtcatgtagtattagcctttctttgcctggcttacttcatttaacatgatgtcctctatgttcatgttgttgcagacgatttctttctcttttgcgcctgaatgatatttcattgtgtatatacggtatacaccatattttatttatccatttatccactgatggccacttaggttgattccatatcttagctgttgtgaatagtgcggccatgaacatgggagtgcagatatcgctttgacacagcgatttcattttctttgggcaagtacccggtagtaggattgctggatcatatgctagtcctatttttaatcttttaaggaacccccatactgttttccacagtggcttcactaatttacagtcccacaaacagcatgcagggattccctttccaccacatcctcttagtgagacatctcttgaagaaggtctgtcgacttgggtaccactgaatggtttgt

SEQ ID NO: 74153 - DNA, 1058 bp, Homo sapiens
cttaggtgcgatgcccccttccccgcactggaggctgcccagccaacgcagacgttcccacttcctgttcacacagaatcgcctcttcctttctcatttctcacagggagtcctcttttcctgctaccgcatggggacacagattttgtttttgaaagtttgtagaaagttcctttagtgctaatctccaatgggaccctaccctacacagagggcaagttattttcttcccattctgttttttggaacttttatttaatttcagacttatatgaaaagtcaaggatagtataaggaagtcctggtgtaccctttaactagataccccggttgtttcaaattattattttttgctaatccatagtagtagagtaatgggccattcattcatatgttcattcaagaaaatttcatagcagaacctttgtgcaaaaaaagtggatgaggcaattctttccctgcttcatttctactattagcaattcatgactgatttagctctttggtttgtgaaatggatgactgaaaacctctcctaagttaggaaagtaagtgaagaaggcactttaaaactgaggtgccatcttttttgtcttctctgtgggatattcatttaaaatttttctcgtagtaaaggcaagcacagatggaaggtggtataaggttcagcctcatcccttaacttcagcctgatggtgcttgtgatagtgcttgatttgctggtgatactggcgtagttaagaatctcccagcttaggagagagaacttaacatggcaaaggtaaaaagaggagcaggtttcatcagactattgtgctttatgcttgaggcagggcagtagcaatggaagaacttagatgtgattctgggcttatgccttccctcttgcttgccctcaaaccctgtccaaccaacaactaacagcaaaccaagtttttagatttatcacagttagggacttaactgctttatgtggacttgtgtggctttctcagctattctgtaaaacctgctttattaccattgctattatttctgctgttgtgagctcagtgtca

SEQ ID NO: 74154 - DNA, 1233 bp, Homo sapiens
gccgtgcgtgactgtgctgggagtgtggtgatgcagaaacctgagaacatccagcccgttacacaggccttgagaagagtgtagaatttatctggtccttcgctttcagataatttcagataaaccattgcagacagatgagaatctcatctccccttataaaccaccagcagaggaatggattagcagtgagctattagggggccttcattttttagagagtgtttagggtagaacagacagctttaaaaaccatttatcttgtcctctttaaaatactcagtcataatcagtgtgcttaatcatgaggcccccgaccagctgtcttctccaccactgtcttcaaagctgacattttgacttcatatcagttttcaggaatgtcctttccatgcttccctttgaagggaaaaatgaaagaagcctttaaaaatagtaagctcataaatagttatttagagaggggatataaagttaggtaatttattttgttatgcctttttgcacgtttactttttccaggtgagagaaaataaatgtgcaatgggggccccggttcatttttagatgtgaacttctttcatatttccaaataaaagctcagtcactgcatggattgataaattatagatggaaaactgttctcagttttcctcctcttagatttctttgcttcatgtgaccatagatctctctcttctctttgaaactccaccttcctttgatatccaaatactgtcaccgccacctgttatttatcaatatagtgacaacagttataatgataagtctttctttgcacccttctctctgtttcattattttctctttcagcttcctattgtggccatcccatagaaaatggggacttgctgttctcctttcactttcagagagttgagctactgcctctgttccagtgactcattcctaagtcttgatttacatctttgaccaggacatctgtgagggtcaggagaaagctagctggtgaagagagaagatgagagaaaaaggtggaggataaaggagagtttacctcaaatggaagaagatctacaggtcttagtagaaggcttcagaatagagaagcatagtaggaggtgaggctatgaaagtgttgagcctccatttcatgttggaagggagggagtgctcctcagcgtgaaacctgcggacaggttggtgtgtcaactgtttataactgacctgtgacaagatgagttgtgcttg

SEQ ID NO: 74155 - DNA, 1032 bp, Homo sapiens
aaaacaaaaaaaccagtataatatatatcacatacaaattgtgtgttgtttatcagtaaggcttccagtcaactgtaggctattagccagtttctggggagtcaaaagttataggtggatttttgactgtgcagggggttggtagctctagctcctgcgttgttcaagagttaactgtaatatacagaactatttacttttttatgaaaaaaataagcaatattttgttcacggaaaaaagtttatgatcttacagattctaaagtaagccattctcttttgtttcaagaataagttaaatatcaaatgtttattccctcagttctaaacatagaaatgcagttgtataaccaagtttctgttactagggggatagttcttgccatggatggcagtaggatatagtgcatgagaacttgggttcaggaggcttcagccccagctcttcatctactagttctgccttctcagtttcttcacccagagagtggacattttaatagcacttaccccatagatctttgtacttaagcgagcaattgcatataaagcacttagaatggggcctggcacacagtaaatactcactaagtgcaagctgtggttatttatgggggcaagctaaagaaataccatataaccctttaaagtgctgcttgcggagaatttataacacaggaaaattacaatgttgagcaaaaaaaacgcagtaagcagaaatgcgtgtggtcacaattgtgtgaaaacatgtttaagaaaaatattggaaggaaacacatgaaaagataggaatatgatttgttttttatatattctaggatttcccagctgtttaagtgaataggtaataatctattaagaaaaagcaaatacattgaatattggaaggaaagtttgtactacatgtaagatgttcaaatcggtatgcttgaaaattacacttgtatatcttagtgcttgtacacatgggcattgtgatgtaaaatatgttcctgaagtgagggcacacacatgcatgttggaagcaaaaat

SEQ ID NO: 74156 - DNA, 1036 bp, Homo sapiens
tgatgccactcctcacccctttgaattccaacaatacaaatgaaaccaagtcaggtcgttgctaaatttcgcttggtattactgaaggagggcagacagaaggtatgggatggtagtgtccctgagtctgcctgaggcttccctcactgccccgtttattcagctcaagattccagtgctgtcggaggtaacgtgagaccccggtaatggtgttctttgaaattctcaagtaaggtaaaatctcgtttttggctataatttaaaatcagatgtcagtaagctgataactgaactggccagggcttctctgcactgtttttctccaccctccagtggagaaaacagaaatgtcccaaaatatcggaagcagggtggaggcccatcttggactatatcattaacagcaggttccattcctttggcttctagtccttttgattattagtacactgtcaggaggacattagtgaggccttgagtttgaacagggagggaaggaactgtgaaatcactgtccacatttactgagggccgaccctggggcagggctccctgctgggtgctaagaacatgataccatgtcagagtaggcccttgcccgtgtagggtttatgatctaaacaggtggacgggtcagtcacctactctaaggtgactaacagtactaaggcacaccatggaaagagtcaaacgtggttcagtgaccagaggaagatgaaagcacagaaccagtgtattcgggaaagaatttattaagaattaaactggacctggaagatgcagagataaggaagacttttatcctttttttctaggaaagaataagaaattgagcaaatgcttagtatgctcaggtaggaccaagaaggagcagagcggcttgggcaaagaagagcaagtttttggaggaagggagagaggttttgagaaattacagttgccaactttgggaacaatttcattgattggctgagaacacatcctgaaatagattttttttcctttgtctttttgaaactatttcaggaaagaagtt

SEQ ID NO: 74157 - DNA, 1342 bp, Homo sapiens
tagtatatgttacttaaaaatagggtctattcttacataactgtgtcataataaaattaacaacttgttagtatgctcttcacatttcccagattatattaaaaaatatttgattgttagtttgttctaataaggacctaaaaaagctttgtaggccttgtcaaacatggttagctctttcatgagccttagaattctttttttttttttctgagatggagtcttgttctgtcacccaggctggagtgcagtggcgtgatctcggctcactgcaacctccgcctcccagattcaggtgattctctggcctcagcctccggagtagctgggattacaggtgtgttctaccatgcccagctgatttttgtgtttttagtagagatgaggtttcatcatgttggctaggctggtctcaaactcctgagctcaggtgatctgcctgcctcggcctcccaaagtgctgggattacaggcgtgaaccaccacacccagacagaattctttataatggagagaaccctccatggggtcaggacttctgggttttaatcttagaggtttagtagtttagagcatgggttgtaaacctggttttatgcctcaccagctgtacaatcttaggtatataacttaaccttgttggggctcagtttcttcatctgtagattggagataataattatgctttccttgtattgttgttggaaggattaattgagctatgtgggtgaagctcttaggcagtggctggcgtatattctaccagctacttaagtccccttggactgttgcttaatgtctctgaacttcaaggttcctgctctgttaaataagaggcatactcggtttttctagagtcccttattccaccaatgggcttctatttgaagctgtttttttttatttatttatttatttatttatttatttattattattatttttttgagatggagtcttgctcttttcacccaggctggagtgcagtggcatgatcttggctcactgcaacctccgcttcccgggttcaagtggttctcctgcctcagcctcctgagtagctgagattataggcgcccaccaccacacccggctaattttttgtatttttagtagagacggggttttgccaatttggccaggctggttttgaactcctcacctcaggtgatccgcccacctcggcctcccaaagtgctaggattacaggggtgagccactgcgcccggccttatttattattcttttagagaccatcttaatctgtcacccaggctggagtgtagtggcatgatcatggcttgctgcagcctttgaactcccgggtacaagcaatcctctt

SEQ ID NO: 74158 - DNA, 1031 bp, Homo sapiens
tgggtgggtgtgacttgtgtttgttggaacagtgcaagaagatgggccttggaagtggttgtctgggccctgtgggggattgtcggggcagagtgccgggccccttaacacaggggcggatgcatcattttggtggcagatcgatgcccttcctgggcagacacagaattgcgtgaatgacgtttgtggagattggagatgaagcttcgctgatttctatatccagtttgctcagtttgaattttctctcgattgctagctctgccaactccaaatttctccaactccagtttgatccatagtaaacaaggatttaatttttctattttagggaagtcgattaggtaaggagtagagcaggagttgggaatagaccagaacctggccatctcttccataaccagctaacttctgtgtggcttcctgcatcttcctgagttttgccagtgcatgttaaggataaagcctgcaacttctttggcatcttttctgttctcacacagaagttggttcctttatctggggcctgccgtggtcatcagggatttgaggcagaagaagagtaaataaagtgtaccagtgtgccatgatttccaaagtgctgcaggtactggtttaataagccgtgtagatggagcccaggagtgctggtgcagacacaacactgctgatgtgcagtagtccccgaatatctgcccttcccatcggaggatggcctactaatggtgacctaggagtgtccattcccacgtgtgacaggctgccaactgtgttatctcatgatactttagtagtacatccgttttccctggacacccttaagcatgaagagccagatgcccggctgttgtcttaactcttagtctcgtctgtctgtggtcacttgtctgatgaaacctgtgatggaacagatacaaaatgcagggaagcaggtgggcctgctctggcatgtgagggcccctggctgaatgggaaataggaaatgcattgtgatggttctgaattgcagaaggaagaatctgggagggctt

SEQ ID NO: 74159 - DNA, 1026 bp, Homo sapiens
gcggggtagccagcttcgagggaccgcccggaaagacacaacgcgcgtggaaggcgccgggcgtccagtctcgggagagattagaagtggcgctcctgcccagcgccggcaatccaggggaatccgcggccatcgcggatccaccaggggtgaggcggcactgagcacaagtgtgaggctctcgggagctacgcctccgcttccccagtgccacccgtttttacctcaggcggttctgaccgccatcgtttcaacctggagaggtgagccctcccctaccgacgcacttcccttccccggcaggaaggagggcgctgacccagcgggcgcacgcccctgactgcgcatgcgccgggtgcgccgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccaggtgctctgcccaggagtctcttggggccgctgcaagtgggcaggtgccctggtgttctcgtgggccggccccaggccctttgcggagcgtgtgccgcgctgaaggaaggggccgtcccccttaccatgccccattcttttaggcttgggggaccgaactaactccccccgcccccacttgcaaagttcagcctccgctttagaagctgacctctcagtttcacttggatgtgtttcttcttcagtctccaagaag

SEQ ID NO: 74160 - DNA, 1076 bp, Homo sapiens
cactttgggaggccgaggtgggcggatcacgaggtcaggagatcgagaccatcctggctaacacggtgaaaccccgtctctctactaaaaacacaaaaaattagctgggcgtggtggcgggtgcctgtattcccagctactcgggaggctgaggcaggagaatggcgtgaacccgggaggcggagcttgcagcgagccgagattgcgccactgcactttggcctgggcgacaaagcgagactccatctcaaaaaaaaaaaaaaaaaaaaaagatctgttgggaatgtcatgaatcttctgagaatgtgtgtctcgtcttatagtctgacagtgagttagtatcagcgccacaggcataattttaaatcttcctcacttctcaacttctcaggttttgaagtggtttcaatatttatgatttcctttgtttcataattaatttgatttatggcatctttcatggattggtcccggagtatgttacaactactaagtaatcttccccaaactaccctttagataaagagcattaggactgtagctgaagctgacagttcaagaaggcaatgtggttttcctgggatcacacagtgagccaggaactactggttatgaaattaatggtggaattcttcaatttcaattgttctttagcattttgatctatccttgctggccaaagtacatataaaaaaataaagggcaagagaaatcttattggttgctgtactgtattagccatgagattatattggccaagtgtattcaaatttgatacagggcaactgtggggaagataatattttgttatctatggcacatggtggtgagtgttgaattctaggaaccaaactgttgcccagggagaggcgtaggtctggagcccctctgcagctgtcttggcctgtttctaaaattaagtgcttctgcagtgtaagagttgttgggatggccgttcctcagaaggctgtgtcttacatgctcattttacaaacattttgggcatctcctctgggcgatgaactgggctaggtgctgggaatgcagcaacgaacaggtcctggtctcagtgctta

SEQ ID NO: 74161 - DNA, 1060 bp, Homo sapiens
tgtacttaggtcaaaccaaagagaaatcagacccaaaaggaattcttaaactttatatttttatattatctttgccagagaggtattttgcatttttacttttagattaatgcgttgtctgttattctcaaaatttgtagcatccctgttttcaaaggtaaaaggatctcctgcagagaagtgactttttcttaaccttctgtttgatctctgcttgggttctgtgcgtatgaaccacttcctggctctgctcacagagaggccgaagattactagtgacttgccccatctcagtgcataaggattcaccatatggatctttttcttgaattagtaactagttacaaattattttttctaattgtcaaaatcgatttttttttggtaaaaaattaagatctcccatgaacagaccagagattatctctgttaatattttggtagatgcttttttaaaaaaagtatttatatattatttttgtataataataccactagaatattttgcgcttactatttaggaacatctttccaaggtacaaaatatttttctacaacctattgcttaatgttgaatattatcccatttttatggatagaacataatttacccatttcccaattagatattcatattgtttctggtcttttcactattataaacagtgctgcgatgaacattgttgtagcagaatctttgtgcacatttatgataattactttgggctaaattcctagaaatggatttcttggatctgtgttgcaacctccacaaactgcagtctttttatatttcgttcacaattacatttacttttgttacacagggcactactttgatttctattagtgctgtttgtgattgtgtatgtctttcacttgaaatccaccatgaaggtgaaaatttgtttgaaccgtggcactatatggcagtgcagtgtagtcagttgtgtttgtagtccggattatcagagcttgaattctggttctgctgctcactagcttcttcttgcacactgtttcagtgtactcagcctcaccttttattttatttctacag

SEQ ID NO: 74162 - DNA, 1093 bp, Homo sapiens
ttgcgccactgcactccagtttgggcgacaaagtgagactctctctggatatgattatatgaatgtatcagattatcatatgtactcccaaaatgtgttccctaatatgtatcaattaaaaaatgaaattaaaaatgtatttttatatatgtatgagttttgtgcatgctcaggagctaactggctgatttgatagaaacacacttctctatttctttacacttgggtagccattttctgaaaggtgttctatggaagttctggctgtaaacttggtctcatttaagagccaactggcaatgaagccctgctagggcattctgcttgtttccagtgtcttttgatcacttacatccccaggtcgatgttttgaaagtggatattagaaccaaatttcagagtttctggactttgtcttcattctgatttaaaagaagtgaattctcttgcttttcacgcatgtggttttttaaatcttaggaacaatcattctgaaagtgctttcctttttccctccagacaaggcgcctctgtcgaagagccttctgctggtccccagtgccctctccctcctgctcgccctcctcctgcctcactgccagaagctctttgtgtatgaccttcacgcagtcaagaacgacttccaggtaagctctgcctcattggcccctgagaggagagcggacagttttttttttttctttctagatttgctttttcttcctgctgttagtccctcaaagcccccaatttgtaagaaatatttattattaatatttcattaagtaacttttctagttattgatttttcagcaaaacagataataatgaagcaatggcagtatttccttttattaggcacatttgttttcagtttcactttttactcagagaagtgtaatttataacttcaagggaattaaaaacaatgtttaatctttttttaatgcccagtaggcatacttagctttgccaaaaccttgtctcaatttgaatatttgattagaggagctaggctctgtcagctgtatcagattatgaatttttgataacttttacagtggtggttaaacgaagtaagaaatttctcttg

SEQ ID NO: 74163 - DNA, 1842 bp, Homo sapiens
ctacatttttattatgttcttgaaatagaatcaattttatattctttctttaaaatttattttactttttttttttttgagacggagtctcgctctgtcacccaggctggagtgcattggcacgatctcggctcactacaacctccgcctcccgggttcaagcgattctcctgcctcagcctcccaagtagctgggactacaggcacgtgccaccatgcctggctaatttttgtattttttagtagagacagggtttcaccatgttggccaggctggtcttgaactcctgacctcaggtgatccacccgcctcggcctcccaaagtgcttgagccactgtgtgagccaccttgcccaggcaccttctttttttagctttgaaagtttgtgttttagagaattttaagtgaatttcctattctgatcctgatagaattagttttgtgtgtttttatagtgaaatttgtctttgtaattttatgaactaaacacaaaaatatagtttaattagattaggaaacaaaattaatttgtacgaagttaagcttctgaagaataattttttaaaagctgataatgtttaaacacttccatcaaacataaaacaaagccggtgtataggttataactttgtagacaacctgccgtggccaaccccactcagaatttgtatgctttcatattgcgttgatcttctttaaaaaaaacaaaaaccatgtattagtgtgtgaaataactagaatctaggagtagagttgacagaacgagactccatctcaaacaaacaaacaaaaaaacaggccgggcgcggtggctcatgccacctttgggaggccgaggtgggcggatcacgaggtcaggagttcaagaccagcctggtcaatatggtgaaaccccatctctactagaaatacaaaaattagttgggcgtggtggcacgtagtcccagctgctcaggaggctgaggcagaagaatcacttgaacccgggaggcagaggttgcagtgagcggagatcgctccactgcacttcagcctgggtgacagagtgagactccgcctcaaaaaacaaacaaaatacccccaaaaaaccatgtattagtgtgtgaaataattagaatctaggagcagagttgttagcacatgtaaatgacctccaagcatctgaatgaagtatctgagacactatttgggaaatgagatagtatgaaatatagataccagatatttaaaattctgtgtgtactatcttcagtctccttttaattttaaatatatgttttgagaactattaagctactgtatgtatcttgattcaaattcactttggatccctattttaaaattatagttagtgttctaatagctttcgtacctgcattgttaatgtttacagtgtagctgccttttgtgaattatagttggtgtgaatatccatgaatgttgacctttagctcttttaataatgtatgattctgaataatgtttgaatggaggcataaagttctgtgtcataattagcatgcagtttgaattccacaggtggtcattgtaattagactgagaagttaaagttgagtattctgttattggggaaaatagtgtagtcatcaggaatgattccacattgactcaggaaagcagcagcattgccaaatcatcagttttccccaaaacatctcctatcaggccagttctttttggttcctgtatagcctactgagtgatgggaggtatgtgtgtctgtgttagaatgaactttggagatggatagtaacttagcattattcttatttacactgtctccttgtcttctttttcctgctgcacatggaatcgaatg

SEQ ID NO: 74164 - DNA, 2839 bp, Homo sapiens
aattcagagtagggaagggctgatggggatggctgtaacaggccccttgggttcttgttgctattaattttgccttgtagtaagtaacagtaatgagttcaacataatttcttatataggaattctggaagtcagtgtttgggacataaagtattggatttataattccattcctagtgcaaattagacctaagggagctgcatctagatagaaaataatttaatcaaattattttgtatggtagctcgatttcccccctactgacttgattaacacacatgtgtcgcttgcacatagaaatgcaaaaagttaattatctgtgtgaacaaggcttgactaggaaagaaaaatcagatgcttttctctgaataattcacaaaaatgttttatataagtttttaaaatgaagataatgaatttattttttcaagagaaaagggacttgatagtattatacagaatatccattgacgccagagtagttagtgaagtgaattttgatgggattgaaatgaaagaaccttattattcataacatttcactgtttatattgcttagtgaccgtagactaccagatcggaaactttttctgcgcatgcttcgaaggtaattacggtatagcatgacactaatgactcgagcctgaaattgttttgaaacgatgtagtagagaatcacatccagacacgtgctgaggttcatgaggaaggtggtaaaggctccccagggattgtaactgttctcccccgttcccagcatcaggaaagcgaaacagatgtggaagggcataaagcagacgagcacctgcaccagcagcgtgatgatgatccttatggacttctccttgactttgggtttcagcttagacgtcctgccgtgaaggagattatgaataatgaccaagtagcacccaatcatgatgaacaaaggaatcaagaaaaaaaatgtcagtcgagtgaggttcagcacgttcacagcttttagatagatgatgtcagaaatcttgaggcaggtggcgggagtggagtctttatctgggtctttatagagcagtagcagaggggtggtcgtggtcagggtcattatccagactcccacacacgccagcacggctttgcacgtgtttttaagttctttggcgtacttcggctgtacaatggccatgtatctgtcagcactaataaaggcaagaagccataaagcaatgcttgggtaaaacactgtgagagctccaagaatctggcagaagtactctccaaatggccattcatcttttgcataataaaacattcgaaagggtaaagtcattataaatatcaagtccactaatgccacattcatcatatagatggttaccgtggttctcttcttggtggtacaactgaaaacccataatgcagtgatgttaacaaataatccaattatgaagatacagctatagaagacaagggctgcaattttgtattcatctggatgtgagctgttaaaagggacaggttgatcttgattgttcagggtgatcattttacagcttgttggtaggcatgatacttagaaactgtaaaaatagttaagaaaaataagaataaaatcgttggttaaaaaataaatgcttaacattctcccactcagcttgactgccagtgaattttaagttcgagagcatttaatcaaggaacgattcaactggttaactactgaacattcacagtaattctcatttgagagagaatgggaacttttcctttgttacagctatagccccactgtctattgagcatgtaataggtactcaataaataaatatttactgaattgatgaataaatgaaggaacttttgatgagatgattcacagcaactctactttgctaaaaaactctagtttgtaattctctagtttgaaaatgaagacttgtgtagctggctattaaactttttgttttttttaaagtggaaacacttcataatatttattaccttatgttctctttaaattatcataggttgagaaacagcaatgttttgtgtcatggtcagcagatcaagaactagactgttagagcaatagatgagctgttttctagtgcacaattgggagtacgtaaagccaagtcttccaggttttgtgatttcagctgctctacttcagtggttcacagaaagcagcaccttgaaaaaagctagtgccgttagtaactttcatatcctcattccatctagattcagaagcttcaatattatttaaattttaacaattttcaaagtaaatccaaaaaaggagtatctaagacaagtagatattaataagaagtcattcagtaacttgatgtgtatgtagaaacttataaatttccatcaccaaaaaaaaaaaaaccgtccattttaaatggaaaggaggttatttggggttgcaaatatcattgactcctcagtgtgaaacttcattcccccatgatgcaacaccaacaacagacttcaaaaatagactttgctgcaatgagatggaatctgtggcatccccttgtaatatggaggtggatgaaaagtttccttcaaaaatgtcactttgcagagtgggctgtcttgaaatcagcccagaatttctctttaaggaaaactatgggggagatttgctgtctgtggtcagtggcatcacgggctattgataattaagaattaacttgagcaattgctgtggttaaacacaagaaacgtgcctgtctgccttccttcctttcccttcccttcccttccctttcttcccttcttctccttctttccttctcaaatatttaggttaaatatgatttaggagcataattctatatatttaaa

SEQ ID NO: 74165 - DNA, 1050 bp, Homo sapiens
ccccattgctgctaaaatcaacagatacattgatggcatgtgtctagaagagtcctttcatcaagacttgaattcttcacggtgcacaggggcattcttgtttctgaattgccagactcttagaggaggcatccaggagcacctgagggctctccataggcctggcttcaggttggggtgagctctcactttttcctcatcttgctctccattccagccctctggactggctacatttgctcttcctgcctctcacatgctgttccacccactgtggcattcctcaccactgtctcccacctgatggcatggcctgctgctctttgttcttgtagctacctttttcaggaagctttctctgccatccgaagctgggctggtttctctgccctccgaagctgggctggttgttcatccctgcaggtttccttagcacttggtacctatccctgtagtggcacatgtttgcattgttactgcatatttacttgctttttctcctccactaaattgcattccttgagagttggcatgtgttgcatatgtgtgtagagaagaggcatttaatattggttgaatttctgactgaacaagtaggtgaagaaatggagaggttgggggaggaatggataaatgtctgggccttgagtcagcaggcagggacactttgaccagcttatgagatggggagacttaggcaagggcctgaggtctgtcgtcctcccctgcaacccatgagccctatagcattgacccccgttcgctgtgctcctggatcttcgcgatggttttgtgttggcagggaattatagtgaaaagaaactgcccagtcatttgacagcaagtaaacaatgggtcaaggattcaacttgtataatgtagacacaagtttctttaatacttgaacctaatgaatttttttttttccccaaacagaggaacttattcagggaccattcatgcagctttaatttcttcacttactttggaatatgagtgaaggagaaatgtttcacttgcaaaagagggattttacttattcccagagac

SEQ ID NO: 74166 - DNA, 1096 bp, Homo sapiens
tcagacaaggtatttaccagaactctcccttgtatgcttataaaataaaactagtactccattcagttgaatatttgcagcaatgttatcttcttattgctaataccatttgtatgggtagactttatgagaagtttatgactttcagctcatacagcttcttgcgctcagcaagccacagtctaaagagagtcttaactgagaagggaaggaaggaggcaggcaggaccaccctgagacccacaggccagctgccgctgtgcttctttggaaaaaaggttctcagactgtgttggcttacatctttctgcctctggtgtaggatttgctcttctaacatgaatggaacatttgatttaggatcagtaattacaggttttagaactggagtttgaagtatctgtgacacatctctctttgacagtcatgtgggtactgatccctgattgcactttcaccccttttcttcttcttgttctcgttttgtgtgtgccttgtgaacaaggacctggcacgtgcgtcttcaaacgtttcagcgcatctagagtagtgcttcacccagcaggccctcagttaacaggcatatggattcgactggtgtttgtgtttttctgtaagaaaggttatgccatgtctcaaaaaatgaatggctaatgtttctaggtagatacaattacaaagacgtaccaaataaaataatgagacaaaaagaaataggtagattgggattggctgtgtagaggttttaaggtaaaagtgggcaagttaaaaaggtttcgtatcagagaagttagttgcaatttattgaatgtaggagtactcacacagtttatttgaatatgaaatagatccagatttcttatgtatggtctccggttttccataccgattgatagttcagggctgctttgacataaatactgtgcttctactgccacctacagatgattagtgggtcttggagctcttcacctttaccccttctaaagtctctttgaaattgaaataattttttttaaaagctattaattggtagaatattataaaatattttaatgttactttatgaatatttctatattatattacataatac

SEQ ID NO: 74167 - DNA, 1052 bp, Homo sapiens
ctcattggtaggtaccacaaatggagtgcctatgaaatccctttaaaccgtgagcattctgtggtttaaatgagctatattctgattctgtgctcttctttattgtgagattcataagtaggcttagagaactagagaaattaattggagtccagccaagggaccgcatttcccaggatgttctgtgcagcctagtactggtacagcagaacttgttccaggacataattcactgcaatgtagagttattattatatttctcaaattctgtaatacaaagaggtttgatattttttctatataatctaagtgattgattttttgctttcttataagcaaggggtatttttaaattttgaagtacgtacttccagaaagtctttataaatacttaaagaggaatagaatgagaaaatcctgacaccattaaggtaagagctaaataatgagttggtagggtgacatatttgaaacatttataaaataaaatattcaaaataaattacatttttcatattattactacgaattcttacagaacttcaatctagactgtaagcttccatgttaaagctgttttcccctttctgaaatgagcatgctcagcagttcagtaggcattgcctgcagtaacactgcactagatggcagtgttacatagaacttgataaaagctttaactcctctaaaataagttattaaatggggatcatatggtgaaacatttttgtaataaataacagaatggtattatactttatacaaacacctttaacagtttgataccctgtgactatttcataaaggcgtgtgctgtagttagaattaaaaactggtattgtgtatgtgtgttaatttttcctaaacaacacaataaagtattttaaacaccactggtatagcaattgtgaaactcctatgatgtaaacctaagaatgatttttagttctgattattcatgggctcagctcagcacagttccaaattttaactacgtaaggtgaggcaacacactacttggccctaatagtaacattaaagaaaaaaataat

SEQ ID NO: 74168 - DNA, 1049 bp, Homo sapiens
gaaggatgtgagagaataaactgccaccattcaagtgtttcaagagaagcttaaaggtaattttttgcagaagctgtctttgactacccccaccctcagactaggtcacagtctcttgtgatatgctttcttagaacatttttctttcttatagcactcatcactatagatagtaaataagatgtaacaaatgatttgatacctgccacctccactagaatacagactttgtgccaggaggagactgtgttagtttgtctcactaatgatgcctcactgccttagcctgttcaggctcctctaacaaaatgccctagactgtgtgacttataaacaaccgaaatttatttctcacagttctggaggctgagaagtccaggatcaaggcactggcagatttggtgtttggggctgtcttttcgtggtgtcctcacatggcagaaagcagagagttcaatgggttcccttttataagggcactaatcctatttgtgaagactctaccctcatgacctaatcaccactcaaaagccccacctcctaagagcatcacactgggggttaggattttaacatgtgaatttggagaggacagaaacattcagttgatagcacttggttagcatagtggctcccacatagtggacacaactgtgagatggatggattgatagagcaaatagattaatgaaaagtatttgatcttttgatttcatctcctttggtttggactattgctgtagcctcctaactgttctccctgtcaccatctcaatgccatcatctgcactgccccactcccctaattttatctacaaaggagatctggtcttattcctttacaccttgagaaatctcctatggcttcctcctgctgttttataaagtttaacttgcttgtgacacacctcagagctccagccaatcttcccagcctcattttctgtcattccttccttgtactctgcatgtcagctaaattgcattactcactactgcctgtcacgcatacatcattacagatttctctggattcatttattacgaca

SEQ ID NO: 74169 - DNA, 1048 bp, Homo sapiens
tgggtggtagatagaaccctggaaagagttagcccacacccttgaggagctcatgacctaggaagcttgttgagaacttttgactaggtagaatatttctagtagttgactgaaatagctttggttgaggctattagtaaaaatttgttttaaagaggtttaacatctgttttcatttctgcttttctgagttgctttgctgctcaattccttttattttagctgtcttcctcttgggacttcaaacatttgagtgtgtcaaaatttccagtctaataggaaatatgttttgttcaaaaagaaataaagatatttataactgttgggctagaatgatggaagtttaacgctggttaagtgagactcaggtaacagacagcaaaggagatactttaatagtgaagggaacttgaagtctggttgtattcaagattcacttcctgttcttgtttatcactggaaagttgcaccttgtgaaagattttagatttagatcattgtattgttctaagaaaaaaaattcaaaatgctaaccatgtcttggtaactatagcaaaatatacagcacacaaaaataatctcatacctgtcttagggttggattttttggtatatgttatgtgttgagttctgaaatatctaatgtgcttgaaatctaatgtgcttttgttatctgaactaaaggaaaaaggctttgtcagttacaagagaataggcatccctgttttggctggattgttagttgaagtaatagaatgaattctggctgattcagcagaaagggaatttattaaagtagctcagagaatatttaggaaggcaaataatcagtcatgggtacaccagagctagaatcaacactttacagttctctctcctaaaattattttgtttacttacttaatgtttaatattggcttctaggatgtaggattcagagagcaacttggtctgtgtggttttcagctgttattccagtgtgtagaatagcagctggttcatagagacacttgataattatttgctgtataaataaatgacaatacca

SEQ ID NO: 74170 - DNA, 1043 bp, Homo sapiens
tgattagcattttagtaccaagcaagtattagttatctgttgctgcctaacaaattatgacatgtaataatatcaacctcttaccatacttaaaaactacaaatcatataatctcctcagctaatatttgatgacctatagtcaacatgtattttttggagcactgtctatgttcagggtgtcatgcccagtgctatccagaatagaaagaaggaaaagctagtgtctcttccccaatggagtttatgtttcatttgagggatacaagaatattgcacatgaaataatagaccatagaccgtacgatggctggcaaagagcttgcctattatctaacacttacttcactgacaagacaattgaagtctagaaaggctcaaagactggacaaagtgggatggagctgggttggagtctgacagaaccaggccacccatctccaggccagtgtcttttttcttcctttgttgtaagatctaaattaaaactatgtggcatatactgtaaaagccagataagttgaggaaaggaagatggatggctttgagtagtcaaagaaggattaagggaggcggtgtgatttggatgtaagtgtaaacaagaaggggaggaagcaggagaatcccactagagagaaccaaacattttatccacaggacagacaaaaccaactagacaaacttgaaaggcccatattgggcaatggagataaatcaggttggagggagtcgaaagtgtgggagaggaacttggacttgatgtggtagatcatggggaactattctcaatccctgagcatgaaatgacacaatgaaagtgggattaaggaagattgtttgccaagagaactggatagtgtctgcatttttcttttcttacactctgtgtattggtcttttttttttcattccaagtaggttaaacactgttttaatcagaacaggttagcttatgttgcagccacgaaataaccctgaaatcacagtggcttaatccacagtgtgtttcttgtttgcacacttgtctaatgcagttgggtgggg

SEQ ID NO: 74171 - DNA, 1032 bp, Homo sapiens
tgcagtgagccaagattgcgccactgcactccagcctgggtgacagcgagacaccgtttcaccaccaaaaaaaaaaaaaaaagaaagaaagaaagaaaaagaaaagatagggaagagtgcatttaagaggagagcacccaggtagggatttgttcaccacctgaatcccatgaatgagagaaaagtatcagatgtgggtgacagagaatgcaggtagagtttgtagagaaattcaggggcttgaggggaaaggtgaattgaattcagatgtggtgatggggagatgtccaaggccctggaggacataggacagggaggaatggagctcaggctacagggtggaacctcttactaaccaagtttcagtaagtggtggcatgaatgctccaagtcaggccacaggttctgggaccggagagtgtgggattaaaccggctctgccacaccatgtgaccttgttgctatagtttcctcatcagcaagatggggatgatagtcataccatgtcttaaggtagtgagggttaaataagatgatgcctgtagaggacttggaaagtggcatgtagtcagtgatcagcaaggtcttaatcgaatagaaatttgggggctgtcttttaagcaacctgcttttctgagtttaatgaaaaccttccattggcagcagttcttatgagtactcatgtagtcctccctgggttcaaaataatggccttgtcaccgggtcacttgtaatccacatgcttttcattttctcattcttcacccaaatagtcagtgagcaaatattttttagctatgaagagaataagaaattacaatggtccaaaaagtaaccaaaatagaccattttaagggctaatttaagatcagtgcttccccttctaaaatcgcatgccaccttgtactcaatggtaggagccactgtctgcccttgcctcttgaaatataaaattatttctgtatttagttttaaattgccttgttggctaattagcgctctcctttaatgtgtctaatttaaattacagga

SEQ ID NO: 74172 - DNA, 1032 bp, Homo sapiens
cacagcttagccaagtttataatctatacctattgttgggttatttgtcctatttaaggattatgaagtcggctagcatgtaataaagcagtcgaggcttctaacaccttttcaggggccacatgattgagttgtcttctttatggccaggatacagaattggggttacattccttttttttttcttttcttttttttttgagacagtctctcgcactgtcacccagactggagtgcagtggtgcaatctctgctcactgcaagctccgtctcccaggttcacgccattctcccgcctcagcctcctgagtagctgggactacaggcgcccaccaccacgcccagctaatttttttttttttgtatttttagtagagaccgggtttcaccatgttagccaggatggtctcaatctcctgacctcgtgattcacccgcctcggcctcccaaagtgcagggattacaggcatgagccactgcgcccagctggggttatattcctaatgctgcctttaatttatcagggtgcctgttctgaagttaggtttctttataaagtatgggtgacactgtttgctcaacctgtttcacaggattgtagaaaggaagatgttacataatatatggactgttttataaattattgagctcttcacatatacatgatgccatttctaacatctgacactattctatttttactatcctctcgctgaatagtcagtgaatttatttacactgatccaaactaaatagctttgagggtttttttttttaatgtggtcaactgccataataacgatccattttcccagattagtttttctagctcccaattattatttaaaattgttaataatgtatcacccgattcatggagaaaatacttatagggttgtgattttcaaacagtatgttatataataaagtcatgttctgtaacagaatataacaattatacagccctgtcctgttctccaagttgacctcctggttaggagaatgccccggaaataaatgtaaagctaacta

SEQ ID NO: 74173 - DNA, 1064 bp, Homo sapiens
gttttaaaaaagtttaaataatgtatcaaagcaatccaaactgtcttttatatatctaagttttaaaatttcatgacatgcaatttttaacagtttataattataatatggttacatatatgataacaggaagaacagaataaaatttgtgtttttactctcacaatttgctgactttggcaaagctctggcaaaggaaacagaaccatttaaatagggcaaacgcacttttgtgacagaagggaatgcactaaatttttaggcagaaattccccttcccttttttgaatcattgtctggttaagtaaagcaccccacatttcagacaggcattaagctttgcttttaaatttaatttcagttggatttttttttaaccaaatgcatatcactgccaggaaatgaaatcagtcaccacatttatgtagtgaaatatgaacttaccacagtgatctgatttgtgttaacctaaaagtctgagaaataggcttagtccatgttaggaactgaaagttagattttctttttaaaaagaagaagacgacgaccgcaacaaccatgactaaaatgacaaaaaaagaagaaagataaagaaaatgagagagaaaaagacttaagctacttcaaggggaaattattaaattttaaaactctatcaatctgcaagtactccatggatccatgcaatctatacttctacctttgcacatagtagcaagcatcacactttatattttgtttcttgctttattcaccaaacatcttcatgtcagtgcaatgtatatatttgtcgtgtatattttatataaacatttgatagatattctacagtcttccaatgtgtcaatgcataatttgcttagctactcccttgatgaacttttggattctttccaattcttttcttgttataaataatgttaaagcagaaattttaagtactaaattgaaaaatggaaaactcctacaataaagttctgtagatgagggtaaactttgattaaagcaggaagaacagagcaataaatcctgtgtgattatttttaaaagaaaaataattcctc

SEQ ID NO: 74174 - DNA, 1030 bp, Homo sapiens
attaaaaaaaaaaaaattccagctgtttgctgcttagaagagatacagctcaaagtgataaagaaaggttgagaataaaggcaagagaaaatacataccaggcaaatcccaaccaataaaaaggtagtatggcagtattaacatcagaaaaaatagaattcaaggcaaattcaatattaataggaatacagagggtcactgcaaaggttaaaaagaacagtctacaaagaatataaaaataatcatgaaatttgcatgtaacagcaaaatttgacggaatttgaaggagaaattggcaaattcacaaccatggtgggagatcttaacacatttctattatgatgtgctagatagaaaagagattaaagacttatttactcaacatgatttaaaagctaacagaacttgtactgaagacacatgagcatatatgcaaatttgaccatgtgctaggtcaccagaagactcaaagctttcagaaaatagttattttctgatcacattgcttgactacagtgcagctaaattataaaccaatgataaaaagataaaggataagtttggaaatgaaaaaatacacttctaaggaactcatgggttaaagaagaaatcacagtggaaatttcgaaatgcttagaactaaatgatgaaagtactacctgtgaaaactgtgggatgcagataaggcaatctgagatagatataaagccttgaatgcatttatttaaaaaaggaaagatttaaaatatatgttaaatatacagttcaagaagctagaaaagaactgtttgtccaaagcaagtggaagaaaacaatagagataactgcagaaattaatgaaatataaaagacaataaatatcagttttacattttgtgcaggaaaaaaaatggagtggttcttaaatagaaaatcatagggatttcattgtggaataaaagtagaaaaagatttttccatttagttgggaaaggcttcatgtgaaaagcagcttttcaggaactaggactagacacaagagagaggtgaa

SEQ ID NO: 74175 - DNA, 1048 bp, Homo sapiens
tagatatttgcagagatttaacaaaatatttttattcttctctttgggcttccaaaacaccacagccatctgtgttactgtcacagctttcagaggattctcacatgtgttatctcattttatacaatgcccagacttcttgagaaggtgataaaccccccagactggagaacaccacgcgtcctctacacaggccacgtccagggctgcctaacaactccagcaggtcttaaccatagcagagagaaaagtatccctgtaaacggctttattaggtgcgaagctcttttaaatgtaagcttcttgaggatgatgacttgatctcatccaacattttatcctatagaatgctacagaaccaacctacaatagatatctagtaaatatctatagaataaataaatgaattaaagtcatatagaaacctgagttaatatttattccattaactgactggtcatggtactaattagctctaggaagccagatgaaagtaatttatgcaagggatcattaccattgtcactaacgcgatacataaacatgtgagtgaacattttgtggagtagcatattctttgtggttttatgtccaaaaagtgcagtgaacccgcagagagaaaacatgctaaaatataagaagtgtgcagtcctaccagtaagcacagttagatgtgtgatcatccatagactcagggccatttatttatttatttatttatctatcgagacagagtctcgcatggtcgcccaggctagagtgcagtggcgcaatctcggctcactgcaacctccgcctcccaggttcaagggattctcctgcctcaccctcttgagtagctgggattataggtgagtgccaccgtgcctggctaacttttatatttttagtagagatggggtttcaccatgttggccaggctggtctcgaactcctgatctcaggtgatccgcctgcctcggcctcccaaagtgctgggattacaggagtgagccaccacacccagcctgattcagggtctttatgtaaaatatccataacatatctg

SEQ ID NO: 74176 - DNA, 1028 bp, Homo sapiens
ttggaatttatgaattgttgatatctgtggaactttataaatttttctgtaaaggtttaagtatcaaaaaattctttgaaagagactgaagcaataaaccttaaccaaaaaaaagaccaagttactgatgattttatattgattttgcatgtaaaagtatgggtttttaaatgttttaaggaaaatagtgtcaactttgacagtgctttttacctggaaacttggtatcagggagtagtttacacattccaccttatccacagcttatgagaaagaaacaggtttctgtggcgtgggggtgagtgacagtccaggatgtggagtggactggattagtcgccgttttcagtcgagaggctgcctgagtcagaggctgtgtgagtacttgaataacagggaaacagttgaagggaggcccattatagataaaatccagcctcttcagcacagggtgaaagagactcatgccattcacctcatagttgtagttgactcagtttaaaccaactaacgtgtctgtcagaatgcagtttatttgtaggctaaattaccagatatgtagcactcagatcaggagaggtgatgtttacacttagtcaggactgatctggccattcccagccacttctgggtgctgctttttacgaagacatagataacacctgtggcagtgaggggcctggatagcaggtcttaggagaactgattaaataagctggggatgtgtatgctttgtaggcatagggtcattatccttatgcttgtggaaactctcatagaaaagtgtttacattgcttgtgtcagtcttcctaactccagagactagcgggagggtcagtaagaagttactggacatagcttttggatcaaaagatgagagtcattcccaaaagttgtgattattttgaaaaatggaatatgctgtttcttatttagatgcttgagtaaacttgatgattttgagggatgatgtaaacagaattgaatcatttggtaggaatttgtaactctgtgatctcagaagcct

SEQ ID NO: 74177 - DNA, 1344 bp, Homo sapiens
gtgctgggattacaggtatgagccaccacatccagtgaccttttctatagaagaagtgaaatggacatttgcaaccttaacaaggtgtctctgttattttatgttttctatcgagtgcgatcatgaatatatagcagtagatgctcagtaaatattagtgattttaaaggatgaattagcaatggctcacgcctgtaatctcagcaattcagaaggctgaggcaggaggattgcctgatgccaggagtctgagatcactgtggggaacacagcgagaccctgtttctaaaaaaagtttaaaaattagccaggtgtggtggcacacaccagtagtccctgttactctggaggctgaggcgagaagattgcttgagcctaggaattagaggctacagtgagccgtgattatgccactgcactctactccagcctgggtgactgacagataccggtgtctcaagaaaaaaagaaaggatggatgaaatgtttataacctgctttctcttttctgtgctaccagcctcatctgcttaagccagaaagggcttccagaaggtagttcttcacagtatgaaaaaggtcaaactgaattactgttgacagtatagagaacagatgttgtcataaaataaggaaaagaaaaagactggtcagtgactaataacattatggtattttgtgaagtctgtgtgtgtagaaatagcaacggaaaatttctgcagaacagcccatataattttggtctgaaatgtgtatgtgtggcctagtatttagtcatcatttaaaattatacagtgattaatatttttaaaggagtttttaaacttctattggtatgtgaaatgtaaactgtggtcattaaaatttctaccagtattttttttagtttacgttgaaatgtaacctcaaaaaagaactctgctttaggttatttagttataacatcactatttgtactttattactaaatgtaaacagaagaacttctatgaattaagcgcctccaagggcatgttctgtggtaagagacctctggtgcgattggctccccaaatagggttctataatcaccaagagagcaggccatattttgagctacatatgaaaccatgtgttttaatcccattaaaaatgataaaaaggaagggggctttttaaaacaaaaggcaagttctgctgtatggttttactgttttaaaggaaaattcatttcttctgcaaatatttattgaaaccttactctatgccaggcacaattctagacagtgggaataaaacaaaacagaccaaaatccccatctatgtgaagcttccattctacttttaagatagataggcagtgat

SEQ ID NO: 74178 - DNA, 1142 bp, Homo sapiens
aggcttgtgattgttaatgagttattaaatatttttaaattaataaaagggcaatgaggagccagcaaagggtttctaagtagaggaggggcttgacgagatttgtatcttaggaactaactctggagccaccccggccatggactgtggtctcacacggggcagtgagagtgagggtggagacagtggcgggggagttccagtggacagagcctagagatctggtttatgcagtggatggatgtggatgtcacaccccaagacaggggacacagcaagagatatggggtgggagatgagtttgtttgggacgtgttctatcttaggtgtctccttaacatttagatgaaagtgtgttcaggagacagtgggttacatggctctgagacacagtgtttgggttggaggttcgagtttgggagtctctaccccatgaagccctaggaatggatgggcacccagaacacggaagaaggagagaaacactccccacatggaaccttcaagaacacccgtgtctgaaggacaggagtgggaggaggagaatctgaggacactgagaaggcgtagctagagggctagaaagaaagcgggatgccacaaagcctggggaagagaatgtcgaggaagagtggtcagtaagacctggtgctgccagaaggcaggtcacagagcgctcaggaggatccactggatctaacaaagggtgctttgataacctggaagaaaaaggaaaaagtgtttcattattaaaataccagactatgagcttctaaaaggcagggaggttgtcttaattctctttctacttttgttgctgaaagtattaccaggtacattagtagatgtgataattttgtgattttacattaactcattcaagtaaaacgatctagtctttttctgcccttgatctccgtggtaggtcatcccctttgtcagagactcctgttaaatcaacctgtttcctaaatgtgtaagtatttccttatggcctggggtaaagcttcccagccactgtgccatggtcatagatgggctgagatactggtcccctccccgcttgggggcaactggaaagggcctgaagccactgggccagctgtaaacagttttggcttttcctgtggaccatgcaaatc

SEQ ID NO: 74179 - DNA, 1055 bp, Homo sapiens
ctgaggttttatcacagtctgcagtcttcctccactgtgtgcgctcaggatttacttcagtcataagaagaagaaaggtagagcaggggagcattttaagggccgtgatggaaacaccagatttctggctgccctcagtgatttagcctcgtctccatgccttccttcctatcacaccctgcaaagccctgagctcctaagagttaactggagttgggacagtcagtggcgtcacagtcgggctgaaattaggagtgtctgtacagtgtctttcactgccttccagagccacagtgcacaaagagcttttacactgcctattactttcttttctcctgagcacctactgcaggctgccaattttgtgctattgactgaaggatgttgtgatacttttgaatttgaattgcttgcatagagcggatcaatatgatacttccttcccagtctatagatgtaactgcattgagagaaagctcttccaagcattatgatgattctgctccttctgtgtctgataactgtgtgttgatctctttttagggaggaatgatcaattggaatcgtctttttcctcctttacgtcagcgacaaaacgtaaactatcagggcggtcggcagtctgagccagcagcgccccctctagaagtttctgaggaacaggtaattaatcagtaatacctggtactcattctaaatccatgtttcagagttgaagcagtttcgatcaacaggactcaaaagtaatcaagcgtgtaaatacaaagatggtgacagcagtccatctgccaccatgatagagactttgggcttttttttggctattgtggttcttacgagtttaaggaaggcattattggttggggggcggcgggtgggaatgtattatggtagcttgttttagatgctcttacacttcatatatacaagaaactaatgagattggttctctgtgaaggatcggggacaaggaggtgggaggatggggagggagtgtgcctttggcatggtttcacttttgtatggttttgagtcatgttaatgttttacatatt

SEQ ID NO: 74180 - DNA, 1016 bp, Homo sapiens
ccactagagaatttctagacaaaggttatccccatggataagaaaagcccaataacctgccatgtgtaaaatcttcctataacatgtttaaaaaataagatactgctgtcaagttcagctgaaaagaaatatcaaaattccgttatgttactgtttacttgatacagcagtgagtcacatccctcatggggcagccgttaagacgaggtatttaaaggtgatatatttctcagtttgggcacttcaggaaaaaaaaagtgtcaaaaagggagtgaaaggagtatgtgtgtgattgaagtcttcagggttgtttttttttttgtttaatgagtcatttttccttgatcatcccagaatgacaacagcgaggttacttcttgtcaacatcagtttaaaacagtacttaatttcttcctcgctccgtgttacgagaagttgtaaaaacatgaggggttgtttttaacatacactttcttatacattgattttctaaatcttgtttttggtgtttcttgattatcctgcaaatagctgttataaaccattgttgccttaaagatgcaaggttcttactggcattattcattctgcaggctcttggtgttctttgcagtgggtactatagagattataaaagataaaaaagatactgttgttgccctcaagatgcttacaaaaaagtttataaatttatattgtataatctcttggccagtttgtttaaccactgtctaaaatatttgttaataacatgttaagataacttgaattaacaaaagctttttttgcttactttttcaattaaatgtttgtattttcttcatttaaatatcagagccacgtaattttaatgcattaagaaacttagtaattttttaagccaagaaaaatagaaattattatttgagttttttctgctgtaaacagatactttaggaatttagtgagagttcaagaaaacctggtagacatgaaatgtatgccatgtactttgaaagcagaatattctaagaaga

SEQ ID NO: 74181 - DNA, 1068 bp, Homo sapiens
gcaagcgtcagaatatgggaagtaaaaacccaaaaaaaacatttgtttttgacgcacttagctaaaagggaagttaaagaaaaccacactctagtttgaataaaccaaaaggagtctttcactgaggggagttgctagaaatctcattggaatgaatgtcccattttacttatgtcaaagaggagttgaattgcaagtaaaataccaaagtgggatttcatttattttcttttctcttttcctttttcccttttttttttttttttttttgagacatggtcttgctctgtatcccaagctggagtgcagtggtgctatcatggctcaccgcaacctcgacctcctgggttcaagccatcctcccaactctgcctcctgagtaactgggactacaggcacatgccaccaagcccagctaattttttttttttttttttttggtagagacaagggttgcccaggctggcattttcttaaatgagaattatcttgaggtagtaggcacacacatcccaatcatagatgtttaaaaataaaaaataaggaaagagaaactggtacagatttatttccatctctagggtgttttcctcattcagtgggttctctgaaaagcacattattagggaatgtattccatcttgctctcctttggaacattgtcaggtgacagtgacagtgctcttgtggcaacgcctatttctgtcatgctcccctgccttggtcagccagccatgtggaagtgtcacaccagggctggtgaagggctgctgacgcctgtggttcagaagctcgtgacgaaaggcaactgatggagtcacaccttgctccactggggcaccctggacacctccaagagggtcttcatccctgtgggggctctggtggggcaccctggacacctccagagtgggtcttcatccccgtgagggcggagctggagtttgccattgccacagcaccagctgcaccttggtgtcctctgagtagccttatctctgctcctcacctctggaagtcaggtttcctgttacggaaagcaggctctggatgttacatttggggaat

SEQ ID NO: 74182 - DNA, 1461 bp, Homo sapiens
atcggaacacctatcccctgacccttctcgtccttgctggctggttgtcatcgcatacccaagcccaagcatgcagtttcagtttgccatggatgtttagttttggacactatgggaaaccttcaggtgccctttcttagtgtaattgtttattctttttaaagaactgtgctaacattattgctacttagcaatagtttttaatctggtgaaaataacaggtcagtgggcagtgaaagttctcctgtcacacttgtcttctcacccataaaaatcacttaaagctctgaagccagctttggctaaaggggcatgatctgccccgcagaggatgaagagcgagcccgctgcaagctgtgacagcagacgctctcttctgccaagacctgtgaaaagccagtcttagttgtcaaaaccagcaccgcggcacatgtcgttcatgtctgagagaatgaactcagaaggaagtctcgtgtacatagaaagctttcgttcttactctaggatgtcacctacgtgacttacaacccagcccagccatcccagacctaaggggttcttccctctccagggcagggcctgcatgcagtccatgctgctgccctgtgttggtgacctgtgtgtagccagcccattatcagcatcctgtggattccaaaccaaatgtatcatcagtggagggagagctcaagtgccaggtggagctgtggcctaaagtcacacttcatcactccagattatgaatcgtcatttgccagatctccaaattgctgagtgtggacagcaaatggattcgtttgtgctggctgggtgcaaagaagcagccagtcctcagctgcacttgaagtactacaggtagtagtaaaggtagcttttccaagccgtttaaataaacgtcattaagagtggccaagttgtttgggggccatggcatcatggtggtggatagtaggtggaaggaaggcaggccagctcccgtttggcctgagttatctccaccaatgacaatggtccttaactggagggaacatcatacaggttatttccacccaagattggaaagaccaccttgatcagagagagttttccttccacatgacacatatccagcctgagtcctccagcccctctccctgcacaacctgatggaggcttgagaaagcacagggaggaacacttagcttgaaaatgttcctaaggaaaaggaaagtgtgaattctgagaaccaagtggcagaattgaagtttcacatctggcaaaagcttaaacagattattatcaaatagatggtttgtgaacgttgaaaagacagctgtggtctaggacaccaaaccaatcctgttggcaagagatcaccaagacctttgacaacatctcatcagcttatgagagatgttggtgacatgcagaatggataatgatagtgcaatgaagtgggtttgaaactgattaaaaatgttg

SEQ ID NO: 74183 - DNA, 1048 bp, Homo sapiens
acccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgttttactcttcagtatttttctatcagacttgtacaaataaagccttgttccaggctatacatatttaccagtcaaccaaatcctccgc

SEQ ID NO: 74184 - DNA, 1053 bp, Homo sapiens
aatatgacagcaccatagtattggcggtaaatcagagttggcaaatgcaatctgaagcagaggagaggagagagtcatatccctcaagttttacagtcccattaaaagtattagtactttgagaaaaggaccgtcacgatcatggggagaatgaaggaaaaactccatttctttccagtttgcaactggaattgtcactttcgtctttcggcacgacagcgcccaggccacaaaagcccacagggcagggcctccattttgtggcctgcgtggagggcggggcggtctctctccgccacgccccagcaccgggtagacaccgcagccacgtaaccaaggaaccccgaatgaggcgttggccaggtgaggccggatccggaagtagggggaccacttcgccccgcgtacgagccccgcccccggcccctcccaccagacccaggccgacctagatgacgtgtccgagtaggagttggcgaggtgcggccgggcggccggccctgcgcatgcgtgatacttgcaccggtcgagatggtagcatgagtctggaggtcattttctttgagaaaggctccgcttctccgggtttttgctgatgccgatcccgggggattgaggaaacattgagctctggagtggaaaaggttgcagacttttagactcccaagtcgttgtagtctcaatctctagtggctgcgttactgcaggaagtcacggaagcctctcccctttcttaggcgcatccttggctgtaaaaggaggttaaaagcccctggaaaacctcaggtttatttcagctctgaaagtccggttccaaatttagatccagcactcttgtggcctggccagtgatggtcgtggagtgctttccccgcgcctgcggtctctaggctctgtggatgtagaggtgtgggatgtaggagcaggcccttacccgtggaattcacatataaatgggggaatgagacagcaaacaaacaaacgtgatccttcctgatagtggtaaatgtgggatgccgaggtttaagcagacgagtggtattaagggatttc

SEQ ID NO: 74185 - DNA, 1017 bp, Homo sapiens
tttgtttccttagcctgctcccaaccaggtgtctccagaactttttctctccgccaccaactccgcctccagacagaccgcaggtgctttctgtcatagggactggcgtgccgcggacagtgtgacaaagaaactgtatgatggatatgagaacttcgtaagacccagcagcaaacggggagcggctggcgagcgctccacagcccccaagcgtgggagctctagatcggaatttgtaatttggaattggaacgtgagcgccggaacagctctcccagcaaccacctctcccagcaaccacctcagctggcgcgcggaaaacccggaaagtggatttcgcccccgctccctcccggaaactcctcctggtgcctgcgaccgttctcactgagcatgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggtgggtgaggcctgacgagccctctgatgcactgttggaaggggaagtcgtccctatccgggggagctgatcctcgggtgggagcgagggaagggggcgtagcagcgggtggggttgagtttccccagaagcttttggggtctgctgggctgtgggtggggggctctgaaacagcccttgcaagggtagtttctggaggacgcagtgggcctcagactcgcctcccgtcttgcgggccaagtggc

SEQ ID NO: 74186 - DNA, 1075 bp, Homo sapiens
acttaaaaggggcaaatggtgggagaaactggtgttttcctagggcaagtcttgaaaactttgatctcttacaacattcacactcaaggttttcagtttaattgctagtaaaagaggcgtaaataaagtaacctgcttttaggttatatggtgtagggctttacagtatacatacacaattatttcgttaagtttatttaaaacttaacatttgggggatgaggatctctttgaaacctttaatgatttcaacaattcaaataatcgttcaacaaacgtttacaatctataaataggcttatttattaagtttgatttttttaagctggtgtttattacagttagctttactatagctgtgaattttgaggttattttagggcattagataagctttaaatttttcataacattttgcagtttctttttaggttgtcagctatcttgaatgacatgtttatacatctgtgcaaaaccttgtatctgaaaaaatatctaaggatatttaaggtttactcaagtctgcagttagtgtttcagtacttaagttcatactctgcagtgcaagaagctttcactcctttttgaggattctgactgaaagactgttgttgtgcttccaagtggaagatctagacttgcaagtacactggtttttccattaaatattttagtaaccaacctttaaggcctagtgtttggtcttactttaacagcagttgtatattctattcctagtgcctcaaagatgaaaaatatatttcctgccctctgggaacctcaaagtaagggacataagcttatgaacagattattgaaatctgatctgttacacaggatgatgtccaaagtgtgctaaaacaaaatgaggaaacatcagtggactagagtctttagggaaagctctatagaagaagtgacagggccaggtgtggtggctcacgcctgtaatcccaacacattgggaggccgaggcgggtggatcacctgaagtcaggagtttaagaccagcctggccaatatggtgaaaccgcgtctctactaaaaatacaaaaattagctgggcgtggtggcg

SEQ ID NO: 74187 - DNA, 1077 bp, Homo sapiens
attgatactgttaccaacagtttttccatctgtaaaatagggataatcatatttgattatgacatattccccttgaaaggtattttgcatttcttagaggaaaagtgcaatatttgtcattgttgtgatagtgtagagatgaaacaaatatatcttcaacttatatataatttaggtagtagagtgtttttatgtactgtaaagtttgtctcatgcatttagctcaggatgtaaattgagagagaatcagaagaatgctgaggatttagtaattttctctctttaaaaattatcttatgttgaatttactggcagagaaacaggagtccagtgaatataaaattctatttatattgctgtaacttctgattaattttcttagccttcatagatactgtgagtatgttttcatggcctcctttttttaacttattttacatgtgcgtgcatttggatattgaggaggtgcacattcttattgctttttatagccgatactatttcattctgttcctgtacaatctgtggtttgcctgaccattcttacttgtagggcctttagattgggcccaatttttctctattatgaatagctttgctacagtgtatttagcagtaattatttgcatatccccaaatataaaattctaggtaaagacaagaagaagtttttagttctgtttagtattgccagatttctttcaacaatgataggtttgatttcctttaactaaataataccttgtgttgccacatcattttaatttttatttatcaatttaatagtgatgtgatggtccctaagactttttttttttttttttgagacggagttttgctcttatcacccaggccggagtgcagtggcacgatcttggctcactgtaacctccacctcctgagtttaagcaattatcctgcctcagccccctgagtagctgggattacaggcgcctgccaccatgcccggctaatttttgtatttttagtagagatggggtttcaccacgttggccaggcttgtctcgaactcctgagctctcaggtgattcacccacttcagcctcccaaagtgtt

SEQ ID NO: 74188 - DNA, 1029 bp, Homo sapiens
tgatacattctttctaaggagaattggaagctgcttcatcagatcaggaagggttgacaaataaggtacatttaatgggtattagatattagatgaaatgccaaacgtagatggataaaaactaataacatgtagataagaaaatgagggaggaaagggtgtgaaaaccccccgtgggctatgtactgaaatggaataagagtgatagtaattggtttaaatgacaccaagttttataaacagaagattaacatggtttctggaaaagaagttttcctggtctctagagttactggaagatttgctgtagttttagaaggagccaatgagtttgatttctaaagttttgacaacattgttttttaaaggttaaaatggaatttaaaggaagtgtggcttgggttggcttaagggctgagtgaggtggagtgagagaaatccatggggagtgctgacagtggagatttccaggactggtgcttgaggctaatttgggttttaaatttagaaaagagaatgcacatgaaatactttaatttgctagtggtacaaatctctgtatgtagcataatgtaaagctaatgaaaatatattttcagaagctctcttcaagttatatgagacagcaaaaagtaaattaatttgctcaaggacaaattgagaaagtatatctgaagagaaacagttaccatgtttttgagatgatgagctccaagctgtcagtttagaacataggaaggaaataaagaactgtccatgaagaatttaagcttctgggtagaaaggctaatgaaagtaacagtgttattctatacttacatgaaactttaacatgtaaatcttaaactttgctgtaattctctatgacatgccttttaagaaggatatgagaatagggcaaggtcctgagaagagcagctggcatgatcaaggagataggtgattcagaagattgagactcaaaggagataggagagagtgcagaaaatgagaataatgttttccctcaatcttagactcttagagcca

SEQ ID NO: 74189 - DNA, 1013 bp, Homo sapiens
tgattgtacctattctatgtttagatgtgtttagctacacaaataccattgtgttaacagttgcccacagtatttagtacaatcccatgttgtttaagtatgtgatggaccacaccatatatatacccccaggtgtgtagtaggctacaccatctagatttgtgtgggtatgctctgtgatagtcccacaacaaaatcccctaataacacgtttctccaaacacatccctgtcgttaagtgacacatggccgtaaagggtgctgagcatcatgctgttctttcccgtgctgttctttctgtttctggtctaacacagaggccgttagcctcctgggactatttacatttaattaaatacaacttaaaattcagttcttcagctacattgactgcattccaagtgcccaatagccacatgtggctggtggccaccatatttgaagaacatttccatcattgcttaaaactctgctggacatggctatgtaatagtaaatacggtactttatgccaggtgctgctcttgaatcttctcaaaaacttcttgaagtagggattattatcacttctgttctacagatcagaacgttgaggaacagggaagtgaagaaacttgcctagaatcacacaactagtgtcagaggcaggatttaaacccacacagcctagcttcagagtcttgcttcttaatcatttcgtgctgagaaaggttgagagtgaggaatacgcttaattgtagcaagagggacatggcttatgtgttgacagtgctgtacagattttgaaaaacaaaacatagaaaagttgtgtagagtataatagctgcattccttcctagaaggaaatcgagagataggaactggactagtattttggagacccttcagtcttctttatgttaaatggatcatttgaattctgacatatcttcatagcagtgttgaccctttctaattagtggaaattattttggcaaaggaagccattaaatgggaattttgtcttcacaacg

SEQ ID NO: 74190 - DNA, 1051 bp, Homo sapiens
tatttaaaaaaattttaagacacagccttgctctgtcacccaggctggagtgcagtggcgccatcatagctcactgtaacttcaaactcctgggctcaagtgatcttcctgcctcagcctcacaagtagctaggaatacaggctcatgccattgtgcccagctaattttaaaaaattaaaaaaaaatttttgtaggaacggggtctcgctgtattgcccgggctagtcacaaactcctggcctcaagtgatctcccacctcagcctcctaaggggctggcattacaggtgtgagccaccattcctggccttactttggtatattttaaatgtatataaatccagtcagtgaatggatttgtaagagaattgtttaaagttgactggaattataacattttacatttcagacatgtcaaattcttttttaattctaagcatgacttaaggctttgtgtcctgttgtttatattctaattttgtgtttccttattttcaggccgaaatagaactatttgtgaacagacttgattcagtggaatcagttcttccttatgaatacacagcgtaagtttttcagcttggcttttatataaaattttatgtgactcatcagaattttgtacattgagaactttgttttctcacagttatggacaagcctgaaaatattttttaaggtgtactcttccaaggtgtggttaaaaatgtgatcttttttttaatgtttctttgtaatacaacagaagcactgactaaacaatggatttctttttttatctgactaaacaaaaagctattttgttttcttaacattttaaaattataaatagctccacatatttttaaacaaaatttttatgtcccacataatcagttcccagaaataactactttgatgtctacctccacattttttctctgaataaatagtctaatctatataatcacatttatacatttttgttttaaacagaagtagattcatagtatttatttttatttttatttttttgagacagagtctcactgtattgcccaggctcaagtac

SEQ ID NO: 74191 - DNA, 1115 bp, Homo sapiens
ctcctgaactcaagtgatttgcccgcctcggcctcccaaagtgttgagattacagatttgagccagtatgcctagcctaacctttctattttgatgtatttggaacatctttggtacatttttcgaacaccagttaaaccaaactaagcacaatataaggtattcttttcaacatatgtacttcatcatctctcagaattcttttgcctttaaatctgttatcttttaagcctattatccttccacattgcataatccctgtttgttttgtatctgttctcctactgtacaaagaacaatggtcttttgcttttagaaacattaaagtagtttattataataatgtatcaccatataaaaaaattaaatgatgcaaaagaataaataataataaatgtgcagttccacttcacagtttgttattaaaatttcctgaaaattttcatacacctataagcttacattaaatagattagatttacttatttgttttaacatactatatgccacactttgcatttttcctttaactctctaccatgggcatctgtccacatgagaatgtgtgttctgatggctctaacttgactccaggtgttattccccagcccgacagcttcctctcctggcttcgcgtctctgctatgtcttagacctcatccatagccaccttccctgctttctcacgaggcacccccatctccctcgacattttattacatggagcacaacatttattatctgtccagcaaatcccgaagcctagattcatctcaccaaccgtcttactccctccagcacctgcacctacactgtgaagccctgggggaaaagaaacatcactgtgcaaatttaatccactacaagttgattggttttgactgtaaatatatcctcttcaaatattctttttttttcttttctttttttaagagatggagccttgctctgtcacccaggctggagtgacgtggcacaatcataggttactgcagcctcagactcctagtctcaagtgatcctcctgtctcactcccctgagtggctaggactacagatgcataccaccacatccagccaatttttaaattttttatagagacagggtctcactc

SEQ ID NO: 74192 - DNA, 1029 bp, Homo sapiens
attactgaggaaagaactattgaaaataaatctgtgaaggtgtgtggggaatttctaattttaaataggcttactgcaaaggtggatttaaaatcttaaaaaagccttaccgagaaggtgacatttgagcagaagacctgaagcaagtaagggagtgagccatgtgaatatgtgggggaggtgttctagctgaagagaggccccaaggtgtgtaacttgagcaggtgagcaagatagagcatagtaggcagtgggcacagagaagtaacaggaccacattatagaatgactcagaggccactgtgaggattggcctttacatctgagcaagatggttagttaacactggagggttttgagtaggcttcgattttaccagggtcaccctggctgctgtactgagaatggaccgtgggggtgcgaggggagaagccaggagaccagtaggaggccttctccctcatctaaatatgatctgacttgggaagggtgagggggtggtgaagaggtcagaatctgtgaatctggctgtgttttgaaggtggccgacagaatttgccaagggatgggatgtggagtgtggagtttctattttctaagatggggcagtctgtgggaagagccaggttgggggatggggaagagttagttttggatgtggtaagtgagaggtgtttattaggtgtccaagcagagatgctgaataaacagccaaatatatgcttttggagtttggagaagggcttcatcctggatatacacagtatatatttgagaatcatcagtgtatagatggtatttacagccacagaattgaagagatccccaagggagtgggtatagatgaagaagacaagattcgaagaggcacaggactctccccatcctcctgacctataaaatcaggtgccccaagggctcctggtattgtatttttagtagaaacagggttttaccatgttggtcaggctggtctcgaactcctgaccttaagagatccgccccctctcagcctcccaaagtgctgga

SEQ ID NO: 74193 - DNA, 1022 bp, Homo sapiens
gagctgtgagtattctgctaaaggtaaattacagtgaagtgtctaaatagtattgttaaattagcaattacaataaattagtttataaaactctttcctacctaccatttatcctttcaaaaaaggtacgaagttttttttgtttttttttttttctttttttaaggctagtcaaatgaagcagtgctgtacctggttgtgatcaattagttgtaaacaccactgcactcggaccagcctgtagttttttccatcactgcagtgtatcagatactggcatattgttattgcttatgaaatagcacatttcattaacattctttgtggtttttgtaatcttaaggcatttacacatttaaattttacaaagtgatgacactgatttgggcagtaattctttgtcatgtttggtgggttcttttctaacttaactcctctttccatgtgtaggattgtggataatatgcctgtaacgtggtgttacgatgttgaagatggtcagaggttctgtaatcctggatttcctattggctgttacattacagataaaggccatgcaaaagatgcctgtgttattagtgtaagttcatgataaactctttgctgctttttaaaacatggcttttgatagaattcagtctttacctggacaaaaattgttatattcattgaatgagtgtacagttcagatgttctgaagtacaactacttcaatcttaaacttacagcagattaataatgtataagttgaggtttagaattggaataattcagattcagttcaacatttactgagattgtctgttgtatgttaaatgctatggtaaggtctagaagtttgtcctaactctcataaatcttatatattacaaaatgtacatagtagagtgtcaaaaaaggcttcattataagttaactaaatttgtattgcagaagtcagatattataacctttttaagacctatgtgtctttgaggccattattatatttaaaaatagattaatcaaatagagacattact

SEQ ID NO: 74194 - DNA, 1074 bp, Homo sapiens
agcatgagttaatcatgaaactgattatatcagttagtgcttttgtgagtgctgaccagagatacttgaataatttaggttatgagtttagtccaaacttataagcttccaggcaggaaaagtgtttaaatgtataagcattagtgtgctcataatattttaaattttattttgtttcattttaaatgaaaggctagaaaatactagattagtgttcttttgaattggtacttattagattttatgtaaaaaaactgtaagaagcatataccttccccaattaatttttggcttaaaaagagtttaagtataaaattgaaacatgttaatgtgaaaggcttaaaattccattcaaacttaaattttcttacttgttgtagcccattttaaagttttaagttttgactcttatgtagtcagttttctacctttaacttttaagttctgttctgcagtcagatttccatgaaagagatacattttacatcttcaaccatgttgacatcaaaatatactatcatgttgttgaaactgggtccatgggagcaagattagtggctgctaaacttgaaccgaaaaggtaattatattaatgataaaaagtaaacaagtataagtgaaatttagacccaaagaataagtatttggggctcaattactccttaatattctgacatttcaggattgatttcactaaaactccctttggcatgatttgttattgttatgggttgtccagaaaaccataccaatagttattttcctgtcatgataagcggtcaagccaaggtgccttagtgttttgtttttcagtcaggaggttttgacagcttttccacgtgtcagtggggagggagaagttgagtggttgggacagtggtccccttcgtggtggaaagaacactgcctcagataatgtgtggctttcctctggtcagaggcccaaatgagtggacaagtactgtgatttctcaagcccctatgcagtgttagatgccactatgaaatacgagccattgaaagagatctcttcaacttattattttttatcacgaacgtacatatcagttattt

SEQ ID NO: 74195 - DNA, 1036 bp, Homo sapiens
tacttaaagagattttttaatctcctctaggaagatgataagatcagatgggcgtctagatgggactatattctggagtctatgcctcatacccacattcagtggtttaggtaagagtacagagttagcctgcttttgctttctacttttctaccctctgtccctttgaacatctcatttactctcaaatcctctctactttattcaaaagtctggccttgggttcaaatcctggctttcagccactgattgtgagtcacagcaggtcccttaatttctcagcgtctgtttctttatctagaaatacccaccttatgggattgttgtgaggattaaaggacatcatgggacagaatatttgaggacattgtctggcacataagagtgttcagaaacagaagccgctgttgttgctatgactttattattatccccttcaaacatgattcaaaacttttatctagagttgttcatgttgccataactctccttttcctattgctgtctgatctttttgacactcactaatttactgagtaaagttgttcttcagtaaatttcttgagggcacaagccagtcctttgttgtggcagtgatttgggcacagtagttatttcataatattgaccatgtaccaaaaaattctagttctaaacagactatgaaactgtattatgataagtatataatgttatttatctactggagggaaacatgaaagaacacagttcattgaatttgttggatttcagatagctttcattttgattttgatcaagactgttttaatgttactcaataaacagtttttaaaagagttttactgttcctaggattaagctacagattactcatgatgtgcttatttctacagcattatgaattccctggtcattgttctcttcttatctggaatggtagctatgattatgttacggacactgcacaaagatattgctagatataatcagatggactctacggtaagtggaaacattttagtctttagtctgccaaggacactgtttattgtta

SEQ ID NO: 74196 - DNA, 1041 bp, Homo sapiens
gcttactgtattagcaaagtagctagaatatgagagctaatgccatttgcttattgtggagatcattaagagtaggatgaagaggatagaatgtgactaaaaatcgtcatcaagtcagatcacaaagcttgacttagagtagaattaggtagcaatcacattgtctttgtaaagtttctcaataagtatatttgtagaccttaatgtcataaatttaagaaactgacatataagacagttcagcaaagccatattaagctccatgagtcaagctgtattcttcaaaattgaaataggtactaacatttttaagtttaaaaaaaacctgttttctgtaacagcatattcaacagtgaacaaactgtctatagttgtcttgttgataccatgagacaatcgaactgatttcattccccttttaggaagatgcccaggaagaatttggctggaaacttgttcatggtgatatattccgtcctccaagaaaagggatgctgctatcagtctttctaggatccgggacacagattttaattatgacctttgtgactctatgtaagtgttaactgaaaattttcaagtagaaaatactttctaaatacagtaattgcttaaaaaccagtttttctggccgggcatggtggctcatgcctgtaatcctagcactttgggaggccaaggcgggtggatgacaaggtcaggagtttgagaccagactggccaatatagtgaaaccccgtctttctactaaaaatacaaaaactgggcatggtggcaggtgcctgtaatcccagctacttgtggggctgaggcagtagcttgaacctgggaggcggaggttgtagtgaactgagattgcgccactgcactccagcctgggtgacagtgcaagactccatctcaaaaaaaaaaacaaaaaacaccacagtttttctaagtgggtaggtaagccagattatttctgagcatcctttaggttctcaaaatctaagtgacttggggcaggtttagttgcacccaaagactgactcttggtttctc

SEQ ID NO: 74197 - DNA, 1922 bp, Homo sapiens
attagattatatatgtctcttctgtttgaatgttgtaaggttttgggtttttttttttttacccccagaggacccccatattttttaatgaaagaacagtgggaatattttgtagtggaaacattttcacttatgtcaattttaaaggctgtacttgaatctcagaagagtcaaatgcactcttgagcatccagtcagcctcccctgatcacaggaaggatgtgatctctcattctggactctgagaagaaacttccaaagtgaagtttgcctcatgtatgatcagattggtgcagtacagtaaatattactaagattgtgtagagctgcatggtaggagagcacatggttttgcgtgaagttgtatttttttcttgtttgaaaaatgagagggtttctctatcatttcacagcaaaggaaacagagtaataacatgtacagcctttcacgatttgtgttttagttttcgcttgcctgggatttttgtcacctgccaaccgaggagcgctgatgacgtgtgctgtggtcctgtgggtgctgctgggcacccctgcaggctatgttgctgccagattctataagtgtaagtcaaagccactgtgactggcgtctgatcaggaagggactctgctgcggctgtggatctgacctgggtatcagatggtgatgctttgtaaatagtgtgcctcataggggtctgttcttagttaaaaggagcctgcttggtgattccttttgtgtcatgagttactatcccaaaatttatttgttcgaaaatgtttagtgaaacaagcaaattgtgccacttatccactatcccctccctctttttttctttaagctttggctaacaggttgggctgaacagcttagatttgctgtgttcatagaagcacatatagactaataaaggagaaaagtatacaaatgagtatcactgatttttttcactaaaacaactagtacatctaggtgtaccttttcttacatatgagaagtcatacttacattgtatcaatttaatatttataaaaatacactgtttcaagtaaacaaagatctcattattttggagacctggaaagttacttttgtaatatcattagtcacaatctcttgtgttcttgcattctagaagtaaaataaagttcagtgaaacaaaaggctcacggccacagagtaaggctgagatgggactggatggcttagaaagcagctggcagggtcagcagggaccagagctggcctcctcgggaatgccacagtctcgtctgggatatacagtgattccccacggtctagcaatgtgaaaaagttttgaggtgaagcacagtagagttacgtggacaaccttaatgtggggttgggtagtctcagcccccagtaaaagattaacttagaccttgtcagacacagttctctcttgagtatgtgaagccctgtatgtatgtgtgttttaagtgtgttttaatttctgtgaattttgtcaagttctttcttcccctttactaaaggaggtaggattagggccatcatacggattttaatgcatacaaaatacagtcagccctttgcctgccacaccagccttacttcatgccacactccccctttctcaccatttcagccacacaggctttctgtcggttcctcggacaggctgcctgctttcccacaccctgctcccatctgcactccactcactaatgcctccccatccttcaggtctcccagctgcagatcctgtattacttgaattttgactgaaattatagtaaacccagaattaatcatttcataacagtctgtttatcagaaacattgtgagttcaaatcatgatacatatatatgatcttatgtgtatatgtaattttattattttcttttagggcaagtggcacttaaacttgcctatcaact

SEQ ID NO: 74198 - DNA, 1308 bp, Homo sapiens
ctttcttctcttaagcagagtgcacaaaggataaaagggaaagtggttgcgcttaaaaactgtgtgggggaagtacagtgattattgtatgattacaaccatatttttaaaaatgtattcagaagaaagactgaatggaaattaactacacacatttagatgtttgggttcaaaaaaagccacagactgtgacaagatatttaacaaggaattagtaagtagaatatgtaaataactcacatacatgacttggcaagacatgcaggtcaaatgaaaaccaagcagtggatgtcagtagcccgtcacagaaggtaaaaccaaaaaagccagcaaacaccagacgcctgctgcagttttcaatagaaaatacaaattaaaacaacagaattgacaatcccaagtgtaatgaaaacatgtaaggaactgactttcataggctgctgggaggagtttaactcaggcaaacccaatctgaagagcaattgggtagtttctagtcaagttttacattcagacatcctgtgatgcagcaattccactttctttgtatatatatattagaaacatagaagttgtcatattaattacatactactgttgcattttgttatctctggttttacccaaaagcctgttgtgtctttcaggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgtaagtttataggtgttaacttattcaggtgaattttagctgcagaaattagcatatgccatctcaaaagataccataaaagtgtgtaaagatgtaaacttgtcctttaggatctggatttcatagaatatttttaaaatagtagtattatttaggagcgtggtagagaggttacagatctaaacttaggtttcaaagttttttaagtgaatagaagctaatatagattaattgggaaagaaatgctgatataaactaatgaaaacattcattcattcattcattcattcatttagagatggagtctcattctgtcacccaggctggagtgcagtggcgccatctcggctcactgcaacctccaccttcagggttaaagcgattttcctgcctcagcctcccgagtagctgggattacaggcatgtgccaccacacccagctaatttttgtatttttagtggagacaaggtttcatcacgttggtcaggctggtcttgaac

SEQ ID NO: 74199 - DNA, 1233 bp, Homo sapiens
ccttatggtcgtaaagcttcatacagccattcattgttgttttcatgttcttaagtcttagtaaaattgagcaattttagtaaagatgacattgcgcacctccaaataaaaatacatggaccaaaattccagaaccagctgatttcttacagtacatgtgtaatgaaaatgaaaagcctaactctacctttttattaactattattttccaagtattctcttatctcctgtgtactttttcctgtgtctaaagccattagtcagtagatcactgctggagacagtattaacttgttccagtagacagactgagtattgtacctgatggtacctggatgatggcttccaaagacaaatttcagtttgatgtcttaagtagactttattgccattagtgacaacatagaagctgaaaaaaagcaggcaaataatctcgtgtagagaagaatatttgagacagatacgtaattatgaattcttccttcctttttttactgaaggccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtaagctaaggataaagtcctctcattctcattaccattatatgtaatatttcctttttgtttgtttatatgggttactatttgtatcctgtaaatgtaagcagttcttcagtaaccagaaatcttaaaagccaaaagcttatttttatcttttccatgttggaagaagaacaatagtgataacagctagtataatatgaattcaaggcttgttaattcttactcttccttaattcttactacttcattctctgtgaggtgagtgttatccccattttacagagctgtaaatgaggctttgtaagttgagtaatttgcttgtgttacacagcaaccctgtgacagaaaattcaccgaagtttctccaaacctatgttcctaactaatctgcactgttcagagaagatcctctgagcacttgtcggaggggattggtgaagggattggtctaggtgacctgcagagtcctttgcaattctcagatgccttcattctccgattgcttgttcacatgtaaaaactcataatagtcattttgagccattctgtgtgtgtgtatatctatatatagtgttatatca

SEQ ID NO: 74200 - DNA, 1050 bp, Homo sapiens
ggattaagatatcccagttcagtatatttagttggaaattactattagagactttaacttgttaattttctgagaatagtatgttgtgctaactttttactgttgttttttaactgacttaaaaattaatacttttgtgatacaaatatttatatcatgcctgagataaaagaatataaaataatctattaaaaaatacaaaaaaaattttagactgaaaatttaataaaagtaaactagtaagaaaattcattaaaaagtttctataatcacattgtaatgagttctattcatggcagcaccaaaatgatagtatccttatgtaataggtagaattgaattttaaagatttaggttgtgttaaatctactatttaatattgtctatattggagaaaaagctaactttattaaacttagtgtgttattcaaaaaatggaggttaaatttacataacagaaaatgaaccattttgaagtggacagtttaatggcacttactgcatttacagtgttgcgccaccaccacctctgtttagttccaaaatatttttatcacccctaattaaagccctatacttgctgagcagttgctcctcattcctcacttcccccaggccttagcagccaacggtctgctttctgtctgtttcgcctgttcagacatttcttacaaattgaatcatataatatgtgaccttttgtgtgtggcttctttgacttagcatgttttcagggttcatcatatcatggcatgtatagtagtacttcattcctttttttttttttttcctttttttcttgagacggagtctcgctctgctgcccaggctggagtgcagtggtgcaatctcagctcactgcaagcaccacctcccgggttcatgccattctcctgcctcagcctcctgagtagctgggactacaggcgcctgccaccatgcctggctaattgcttcttgtatttttggtagagacggggtttcaccatgttagccaggatggtctcgatctcctgacctcgtgatccgcctgcctcggcctcccaacgt

SEQ ID NO: 74201 - DNA, 1634 bp, Homo sapiens
tatctaatcatgtcacttttaacattttgtaaaaacttactgagttattttattataattctttgaagactgataacttccaataactgtacttagaaaatatccccatttaatcattatttgaacctgttttaatgtattcatctcataccttaaaaaattctagtagcgttttccattttgttgtaaaatattcttaaataggaaaggacagttgacatccttcagtcttttctatgtagtaaggaaaataatgtgtattgtagaaagcttaggtaatcttatagtagaaaaaagttctaccaatttttgtaagaaacttgatttgaggtggtcgtatatttttcagacgtgctcatagatctgtagtatattcccggtgggtaatagtttatagttttgcgacttttttaaggaaccagtcattgtaagtctgtatttttgtgtaaagtatgaaacttcctttgaaaaggggtttatttttattttttctcttataggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgtcttcattgcatcattacctattatatattcaaggaggttctgtaaatacagatctatttaccaaggtgttttgaaatgatttatactattttatcagattttactggattttgttaatgtaacactttctgagttttgatctgaatggaatttcactgtgtaaggcattgtctaaaatgttcactgtgaggcagtagaggaggttgaagtcatgcatatctagacagatgaattatctgcaagtacttaaggtggagccttactacattgtcattaaggagtttctatttttgacttgtttttcaaaatacagtgttttaagtcaggttttattacctggacattagcaatcactagcaagtcttcatctttatgatttcattgttttaatttagatttcacaaacagttttacttctaagagttaagaaatgc

SEQ ID NO: 74202 - DNA, 1009 bp, Homo sapiens
agtgtgttctcaggaggcacacctgaagcctcaaaggtgaggacatagacatggctgtgggtgagcctgtgccaagacatgacccatatccatggggagtgctctcagggcagctgacactgctcagcctcagcagtctccagtgatagcttcggaacagccacggtctgactgatatactttctgaaaacagcctttggtcacacagtttcctaactaaatgtggtggtggccactagaagttgccattttatgcgggactccctgtgaggaagcccatagtgctggtagctgaaatttaggaatgcaggtttctaagaaggctcggaaaagcaagctgggctccttggggaggagctattagtacgtttaattaaattttttaacatataaaaagttgttaattataaaaacaacatttttttctaccctgagtgcagctggagctgtgttctgccgttacacaattcctcattaattccacacattgcttacgatcctgtgaagtttagaattttattaggcaataaataagaaatcaaggaaataatatttgtggtttcatatcggtcacttgggtatgaatttaaatccactgtaattcaaacaggtttagtttatttcatgttgctacttgaatgtgttatagcgtatcaattaaataactcacttgaatgatgcagacttgagattcattccctccttctttccttccttcctttctcaccccatcctccctaccataaaccaggtttagaatagctgttaatttagctgctttgattttttgttgttgtttattttgaaacggagtctcactctgtcgctcaggctggagtgcagtggcacaatctcagctcactgcaacctctgcctcctgggttcaagcgatcctcctgcctcagcctcctgagtagctggaattacaggtgcacaccaccacgcacagctaatttttttatttttattttttatttttagtagagatggggtttcaccatgttggtca

SEQ ID NO: 74203 - DNA, 1116 bp, Homo sapiens
gcggaagactgtgtttactgtttaactcacagttcacgctaaaaattggcacttttttttttcctaataagggcctctctatggacctttttaaagtttatatggtcattaaaaacatcattgcacacatatactttgtaccactttggaagtagtgcaggcttgtttgaaagcatacacttgacttgtcttcttacttagtctcacagtattctttgtgagaaggttgatatgcccacattattctgtggccaaaaacaaaagtttaggaaatgaaaacagcaaacagaaaaccccatgccaagtgctgttttcgtagtgaggcactggagggcgctccgctctagcaatgggagatgcacgcagtctctgcagtctgcaggctgccctcacgaacgcctttcagaagatgtaagagttttttctgttcattttaaggcaaatgaaagacacatggatggtagaggaaatatttctatactgacctataaacggtccctttaaaagtttatgagaaactgaagaagtagctctgtgctccagccctccttatgacctcctctctccctagcctgttgcagcctcaccggcctcctcttctgggctgtgtcgtcagcctgaagccctctgtccctttgtgcctcagctcaaatgtcacaaatcagagaggtcttccttgaccaccctgtacaacatagcctccaccccgctaagcagcctctgcactaccctgtccccttactgctgttttcattttttcctattgccccatttccaccagacatatcacatgcttatttgtttattgtccgcctgtatcctaccccagcccccagatattcatgagagcagggacttggtttattccattgctactatatatccagaacctaaaacaatccttggcagtgcctgatataaatttgcagaaggaaaaaagaacagatttaggaatgaaatattttgagtgtttctaaagatttagtggattttttttctttattttggtaaattatacataacaaaattatcattttaacttttttttttttgaggtggagtctagctctgcccccaggctggagtgcagtggtgcgatctcactcactgcaacct

SEQ ID NO: 74204 - DNA, 1760 bp, Homo sapiens
ccgagatcgtgccactgcactccagcctgggcaacagagtgagactccatctcaaaaaaaaaaaaaaaaaaagatgagatgatgcattgaatgctaggtatggcgtgtatgtagttcataagaacaccaataaacagtggatgtaaaaagcaacatcagatagatacctaaaggccatgtctttggaacaggggtaaccacctgaagcatgtcctcccttccctgcctttttcctccctcagagcaccccgttcttcattgcacttatgatttgtcaccagccacgaatgtgtgcatctccctgttatgtttggtctcctgcactgggctggaaactccacgttcaccctttatgcctgtgcccagcacagtgcctgacacagtaggcactgattaaatgattcttgaatgactgcatcatcatatggtcacagtaaacagaatccatcactaattatctatttgacatgagcgggtggaaaggcaaagtttttatgcatgagtgtgggtgtatgtatgttttcctagattatagatttgtctaaacattcctgctaattttaagatatcaaatctgaagtttccttggcttgaatttttgaacataggccaaggttgtttttagattcctcagtattctctcttttgtgaaagttttcaaaagtataaacggcgcatcttccgtacaactggtttacattgttggtttatgcagttgagttgtgggcagaggggaaacctcaatgtctgaatgtggctttaccccagcgctgagatatccccgggagagcttggccagtctgagtccatgtggcctaaagatcctccctagccagttccctgtcccacctacattctgtttatttcagaacttctcacctgttgaacacacagcccttcctcaacacaggaccagctcagcatcgggaagctgtattttaagaaaatcatggtcttccagctcagtggaggcatcttagcgggatccaaaataacattcgcttttatcttgaaattctttctgtttttggtttttccccaactctcatccttcccccaccttcacctcagacactccaggttattactgaaattaagcatgatagaaagtgtggactcataggctcagttctgttccctccttatggccagcgtgtggaagagctcctctgctctcatgccttctccatcggagctggttcatcaccttggcctgtcttgggcggagtccccgacttgggagttgtgctgttcgtttgctgtccatcgggctgtaagctccttgaggaccaggcaccatgtttactcacccctgtcccttctgggaacctgggggaaactgctaactggcgtggctctcagaccttgcatggccccacacattttttttctgtgggaaccactaagcattagcaactcgccagtgatcagcagggattagcagcgtttaggctccgcagacatttaatgtgctaattgaggagcccagggttcggccaaggaagtgatttacaaaggtggaaacgggactgttgacacaggtgcatcttattaattactggtttggggaattagtaaaaatgttaataatttgagggattattgttaatgaaggataagaaacttcacaaccatatggtttactacttgatgcgattttcccttttttaaaaaaatacttttaaatctgggttttaggaaggacaagccatttcttgcagaacttattgattgtattacataggtaaatggaaaaatat

SEQ ID NO: 74205 - DNA, 1397 bp, Homo sapiens
gctcagaactttctgtccacggagttcacactggttttgtgtttgggctggtgcttttgaatctgaaaaaaagtgcataaaaatatgccagaaatgtagtaaatattgtgatcatttcattttttaatccgacacttttgagaggaaaagagtattcatcagtactttatcatagatttaattaatgggataatctttaatttctgactcagacatctggatttgtttcttgccaccccctcctttttttctgtgttcctttctcgtctttatttttgatgaagataaaatacttaaagaaagcgttgaatgtgatgatgagtattgttttaacagaaagtaaaatcaaaagcatgcagaataaattaaccttgcattttctcggcaggtcagttagtgggtgttatatccttagttgttggtgctacaaagtaaataatttttggcagctggtttagttttcaccacttctaagcctatgacaaatggtcttggaagatctttggtcttaaaaaggaaaattttctgtgtgcgagttttaagttcagttttgttgggttttgaagtcttttttatgtaagccacttatgtggcattttgttttatttgaatttgaaattttttttaagttttaaagctagagtctgccacattgaactgtttttcacacttggcatttaaaagttaatttgctttttctgtttttaaaagagactaaaaaactaaggtttcccctactaagcatttattagtcaaccacttttgaaaattgaaaaattagtttgtatggttttagattgtttttctcccaggagaaataatgttgctacataatctcagacctgcattcacgtatttagcctgccataagtcactgtcaaaatgaagaaaatgctgaaagttagatatacctgcacatgtgaatttcatgtattttctggtaatcaactctgttttaaaggcttttgggagttgttttctttcagaagcagcccactggtgctgtatttggcatgttgtgtgttattaaaacttcatataaatgcagaggtactaaaacgtgaagtttacaaaacccatcggaacatttttacttgtgtagttagcacgatcacttctccaagtacaataatctttgtgttgtgagcctgtagacaaaactcgtgtctggcatatctgattggaatgtgaaatttaatattttccactagttatttcccaacatgcaaagtgaactgatacccattaaatatatatatttaagtaaaaatagagaggatcagtggcctaatcagctttacagctgtgaatttaggaagtgaattcacaacatccctctctccagagagacgacttgatgacttactctcggtttctttaagtgatatagtagacct

SEQ ID NO: 74206 - DNA, 1164 bp, Homo sapiens
tggagcatttcttgtttaactgtcatgtaagccccttaagcaatgcttttttcagagaggtatcatcctgataaattgtcaaatgcctctttcaaatccattccttttaaaaaaaatcctcttttctgtttattctggagtcactcatcatgcaaataatatctttgtgagaagtggtgttcctggagttggagaaggctctttagtagggctgctggtcagtacagtccctgaaaaacatgactatttataacacaggcaccagagggttcagagacgtgctaaaagtggagaagttgggggcaggggagtgctggcaaggatgaactttgcctatttcacaagttttgactaaagtagttctgaataagaaaagcgtttgatgaaatcttacctagtataaagacatattatttttggcctctcttttttctttcttctttttgttctttcacctttcccctgtgacctcccattccagctgagccctcttgttcccatttgccctgtattgttgatcttaaccccagctctgccctctcttaaatcctgttcttattcttggagaagactacagtctcccgagctctttctatatgccaagcactgtacttttatacattcatattatcatgaggaaatattcttttgcctattttacagatgaagcaagtgagattcagggaagttaagtaatttatccaaatttacatgcctactaagggatggagcaggagccagacccctgtttctgaagcatgtttgctgaaccactacactttagccacctactgtggatacctttggaaaggaggattcttttaccgttaccaaaaagatattaataaaaataagtccaggtgtggtggctcatgcctgtaatcccagcactttgggaggcagaggcaggtgggttacttgagctcaggagttcgagaccagcctgggcaacatggtgaaatcccgtctccacaaaaaatagaaaaattagccacgcatggtggcgcatgcctgtagtgccagctactccagaggttgaggtgggaggattgcttgagcctgggaggcagaagttgcagtgacctgagatagtgccactgcactccagcctgggtggcagagccagaccctgtctccaaatatttatgtgtgtgtgtgtgtgtg

SEQ ID NO: 74207 - DNA, 1099 bp, Homo sapiens
cagaacttggtatttgtgttcagccaagttagctgtctgctagaacaaaaattagtcttcagagaaatgtgcagaatctggaatctctataacatatcgatcatcatgtccagtgtcctatcagaaaccactagaggccgggcattgtggctcatgcctgtaatcccagcactttgggagaccaaggcagacggattgcctgaggtcagaagtttgagaccagcctggccaacatagtgaaaccccatctctactaaatatacaaaaaaaattagccaggtgtgctggtgggcacctgtagtcccagctattcaagaggctgaggcaagagaatcccttgaacctgggaggcggaggttgcagtgagccgagattgtgccactgcactccagcctggtgacagagtgagactccgtctcaaaaaaaacaaaacaaaaacaaaaaaaccccactagatagaggtagaaatgggaaaaaagtagataatagaagccaaactcaagatgatagagatgttacaattaatagacaaggactttaaagcatctaccataaatacattcaaagacttaataaaaatgtatacacaatgaatgaacagatagggagtatcagcttagaaatagtagctatgggccaggtgcagtgtctcacacctgtaatcccaacactttgggggcccaggtgggtggatcacttgaggccaggaattcatgaccagactggccaacatggcaaaaccctgtctctaactaaaaatacaaaaattagccaggtgtgggagactgagacaggagaatctcttgaacgtgggaggcagaggttgcagtgagccgagatcataccagtgcactccagcctgggcaacagagcaagatcctgtctcaaaaaaaaaaaaaaaaaaaaaaaaagagaagagaagaaaagaaataaggccaggtgtggtagctaatgcctgtaatcccagcactttgagaggcagaagtgggcggatcacttgaggtcaggagtttgataccagcctgggcaacatggcaaaaccccgtctctactaaaaatacaaaactgggcatggtggcacgcatctgtaatcccagct

SEQ ID NO: 74208 - DNA, 1995 bp, Homo sapiens
aaatctacatctgtcacacgcccccccggccccgccccccatcacaactccatagtgggaagaacttatttcagtgcctatttttcttgaggtttataaaaacaaaatgtgtgaagggaatgtatgctgattctcttgggactaattaaacaaacagattcagagaaagaaagcagagaagatttaggacagttaaaatgtaaaaaatgtaattttggggataacagccgtcaatttttccactcgagtgtttttccaaagggcagagggcaagaagcatcttaagtcctctcgaagctgagacacatttcaactggagatattagaagcaaatttggtgcccaagacaggtgccagattttaattacagttggcatttctgagcatgcttttggcagaggtggccatcttgttggaaaagccatagattttgacactagcagtatgggtgcccagttgagaacgattgcaaataatttccctcctattttcatcttgttggttgtgagagaaaacttcagtggctaatatttaaacaagatattctctgttcagaggaaacagttcattggaattgtcttggtggcttggtgtgttggctctgggggtaataatttctatcttaaagtctttaaaaccagttaaaacaataaaataggatatttcattatgagaaatgaagttggcatgcaccaggttttccattaagttccaggtcacagacaaataaagaaagtatgttcgggggggaaaaatcctttttaaaaataattagggagctgtctgttttgttcaccagatggaaaatccgtagttgtgggtggtctgtgttggagagggcatctcacaattggcaggactatgcctttaacttttcaagtcctcggacaaaaatctcaacgccatggactattcagaaggctccgaatgttcatcagtccttccaggtctgcttttctgaattttaccagttttctaacaagagtgtgtaagcaaaatgattatggaatgccgaaataaatagtccattgttcgttgaattctgaaacagcattcctgctagccctggttttttgtgacttttcttgctgtcaataccttatgatgataatctgattagtggagctgcctgcgttactatttaaaggcccctttttcttacatttctgtgttccagagtagatagggcagccagatgtgctaacagcataagaaatcatcataagcttgttatttattgaagatggatattgcactgttatcagtgtttagggtcttttctacacttgctttgattctggtcaaattaattcaataagaaaatgtacttttcttactcctttcttgaactgataatagaatgttagctacctagtgtcactagtattttttttatctacacatcaaggtatcatttttttctagctcagtcttatgttttacatggctttacatctgcaagttggactttgaaatgaatattttatgtttgaacataaggatatatatatttttatatttcattcatacatttaacccatccccaaaattttcttaaaaaacttaataattacaggagatgtaaattaataaaatcatctaggatgctaaatgcataaactttcaattgagtgaaaaaaagccctggaacgtaaatcatttttctcggacagccaatgtgtttggctttggatgtacatcagattctgcctgtgcatagtaaaaatggcaatgatttattagttccatctccccccagcacagatgctgcacagtctgtcccttttctgggcactaaacagtgggttttaaaaaacataatttcactcaagttttccgcttgcattctgtgttgtactattaatagcaaccctttgttattcatgccagctcgcttctagcataagacaatgatgtggggaaacggttttaactaaaatactactaattggcacccatttttcatatactggtgcaggtgcagttctgtgagga

SEQ ID NO: 74209 - DNA, 1012 bp, Homo sapiens
cacatggctcccagccattgtggctctttttttctgggactctcctctctcctgtccatcttccagaagtagctttctgaacacagacgtcattgcgctcctctccacaagcagcagtcactctcaacactgaggaatgaagaccttacagtgttctttacaccctaacccaagattaccttcccagaatcatcttcctaccccatgtctctgaccttccaatcacattaaaattctcagggtggtgagatactccagctcctttctgtctctgccatggctcatgctgctgcttctccctacagagccctcctctcatcttccttgagatcttgctgaccaaatatcttctcttctgatgacttagcagtcacccacactgccgtgggccagcagacacccttcctctgccttccagtagctttgcccaatgtgatctctgctctttgtaccctgtgctgtctcccatgttagatccaaccacctaggtcatagcgctactgctggtacctgattgcaggcccagcatctgtcttggtgccaagcacatgacaagaactgaataaataggccaggtgaggtggctcacgcctgtaatcccagcacttggggaagccaaggcgagtggcctgacgtcaggagttctagactagactggccaacatggctaaaccccatctctgctaaaaatacaaaaattagctgggcgtagtggcgcatgcctgtaatcccagctacttgggaggctgaggtgggagaatcgcttgaacccaggagacggaggttgtagtgagccaagatcacaccactgcactccagcctgggtgacacagcgagaccccgtctcaaaaaagaattgaataaatattttttgagtgaaatggaattctgggttgtggctttccatcagttaagattcttggttgtggccaggtgcagtggctcacgcctgtaatcccaacactttgggagggagaggtgggtggatcatgaggtcaggagtttgagacca

SEQ ID NO: 74210 - DNA, 1907 bp, Homo sapiens
aatgttattcttttaaattcagatttggggctttttaggattaaggcacaaatgtctcttttcttttaaaaaggcagtaaaataaacagattgtagttagatcataataacatctaaattttgacctaattagagggggagatggggaaaaaaactctttaaaagaagattaaggtaaagttctaactttatccttgattctgaattttttttcttttttggaaatattgcatacattttatactgcaagttacaatgtgaagggcctttgaagcactctaaagagacttagctgctttgttttgagcaattaaggtttgttattgagtgaattaagcagctctgctgtggctcatctgtaaatagtggtcttcagcgagtttcttgatccgcttttcccaggaacagaagccaagtcggcttccttaggagctgctcgccctgagtctccatgtttcctcgcagtccggggcagaacccaagcccgtgccttcctcgccctgccttcggagtttcctgctattgacctggcggggcgcgccagccctccctgcccgctggtgccgcggtccctctcggctgcagcagtggggcacagggacgtcatggacaaaagacgaggatgccagttcgatgtgcgagcagaaggccgcctgcgtgcgctctgcagagcaaccggcccggtttcataaggggccgccggcaggggactgccatggcgccccctcctaccctttttggcaccagcagcttcatccgcaggcccactcggggtgaatagtgtgggagctctcaagagaaagaattttaggtttgtcgatagtaatcaccaccttcagcgctcctcccactgctggagagaccgcggactgggtgacaagtcttccaggctcccagaaagtttctgctgcaaagcgcagggtccgcctcccacttccaggagggaccaggagggaaccatcgcgaaaccccgaggctgccggggactctgactgaggcctttcctcctgtgtccctctcccccacgccggcctcccctcctttcaactctctgcgctttgaaaccgcggagttggggtagctaggccctccagcccggcgacaggcctcggccacaggcagcggggcggggtgtggacaggaacaaggaggtggggtggggaggaagcctcgggcagagcaggttctctgcggagtttcggcagccgggtttatccattttgattaaagaaaagtaaaaaaaatcccccaaaaccaaacaacaaaaaccctctcccaacccccaacccgcctccacagctgcattttgttcctgggactgttggtgtcaccagagcctctttttttatgcaatcctagactccattgcaaaggacttgtaaagcctattaatttttcaggcaaaacagatcaagcctgcctttgatgctgctgtttcctaatttagtattcaaaggtaaagaatcctactaccgtctcttcactttttacataattaaaagagatttttcccccaggggcaaagaactagttgcttagtattttttgaagtgaaaggtctaactttatatcacatctgtttttatgctctttcctaaacataaccaatatttactctttgctggtacttagttgcatgctattcacccttgcattttaatttctgacagagaggggattagtattcctcttctaaatcatcctctaagctatgtgtgtgtgtgtgtatatatatatatgtatatatatgcgtgtgtgtgtgtatttctcctctaacaaactgagagtgcaatttaaaaaactgtagaatcagtgattgccctaacttgtgcatgactcttgatttcacacaggagcattcaaaagttccgttaagtgggctttcacaggtttccatctgctgtgtt

SEQ ID NO: 74211 - DNA, 1012 bp, Homo sapiens
taacgtcaaaatggtcaaactgttggactgattcatgttagataaaacagatgggattctcagatcgtgcaccgttcagccgtttgatggaattcgcgccaccctgaccagcgagcccagatggcgcttaaatctgtcactctttaacgaccctactgttttttaaaaatatttttatatttgagctcattcagttaatctgagagattaatcttttccaagatatgtctggggagggctttactgagggtttcacttggaggagctcagggagagtaagaagaatgatgaggcctcttggacacaggactacttgctagaaggaacctggggaagaagggctggtggtccttgggctttggaatatttttgaggcaacaaggcccagaagtgcacgtgaagagtggtagtgacgggggttaagggaagaggggatggatggggagggcgtggtgcagggaggtggaggtgaacactgacatcgctgagacagtacagcccctgccaagaagcttagatctcagtaaggggccaagtgctgactgtgaccacacctgagtggctttaggcagcctgaccttcactgcatggggatgactcggtgggtgtgccccaggagcagagcccaagatgggctccaatgtgataagcctctgggatggctctggaaagaacctgttctgcaccacaactctcacaaatctcatggggtttttttccctgtaggttttttcccccctttcttaaattgttatttcgagccagtcagcctactgaaatgcttcagtcatttggggtgtaagatgttggccagctcccgaatctctaaccttggatacatttgcagagtggcttggaattgctttctattcctgctggggtaagaaagggaaaaatgaatgatttttcattatgcacacatggtattttttcccgcatttgaatcagatgtagcaggtgtcaaaatatggtacagaatttacagtattaatgtgaaaatttctactgtccc

SEQ ID NO: 74212 - DNA, 1054 bp, Homo sapiens
gcctgtaatcccagcactgggaggccaaggcaggtggatcacctgaggccaggagttcgagaccagcctgaccaacatggtgaaaccccatctctattaaaaatacgaaaattagctgggtgagatggcagttgcctgtgaatcccagctactcgggaggctgaggcaggagaatcacttgaacctgggaggcggaggttgcagtgagctgagattatgccactgcactccagcctgggagacagagcgaaactccatctcaaaaaaaaaaaaaagaaaaaaagaatattggctatttgagcaagatgaatgtattttggtagatagaagaaaaatgagaactatcgctcatcactgctgatgtctaaatcccctccctgggcatgaggatggtacaatgacacagcaaccccagcctgccgggcttctgggatgccaagctgggggtgtcctggccaggtccaaggtgctggaagccaatccagaaaataggatgaagggataaaatcacactccaaggccgtgatatgattgaatcaaggtgttaatctaggtgaagagtgcagaagccagattcactaggggctccagggcaggacaagctggttcagcggggagaaggcaggaggcagatgcccaagaagtgtgggcagatctaggggtgactttataggccctcagcttttttttttttttgagatggagttttgctctgtcaccaggctggagtgcagtggcgcgatctcggctcactgcaacctctgcctcccaggttcaagcgattctcctgcctcagcttcccaagtagctggaactacaggcatgtgccaccatgcccagctaatttttttgtatttttagtatagaagggattttaccacgttgaccaggatgctctcgagctctcaacctcatgatctgcccgcctcagcctcctaaagtgctgggattacaggtgtgagctgccgcgcccggccaggtccttagctttgaatggggagtgaggcattaggggcatggagacacgtgaagaacatgtagcttgtcctttctt

SEQ ID NO: 74213 - DNA, 1043 bp, Homo sapiens
cttttagctgcataaaaatatccaagtagattttcttataacctctccaagataaagatgccagaaacggcagccaaatacattgactttgagagaggaaaaaaaaaaagcttgtaattgccgatcactccttagatttacttctggggagcatcaattaaaaatctcaaaacacgtggctttttcagtaaaattatattaatatggaggaagagtttttattaaatatgagtgcacgtgtgtctgtgtctgtgtgtgttttaaacgtttccataatgagttcccaagtgcttttttggcagtagttattaaagcttgtgtgtttgcgatttatctggcaaaatgcctttagtgaagaaaggatatagtgttctcttggttctttgcccaaagtaattttggagaaatctgtgactgtatttagttcatgtcattcattggagacaagtcattgtaattacatttgatcacaatcagtttacagttgttttatcatgttttcatgctgaatatctactcagacatcatagcaaaatttaatggctactgttttatttgtacataaaaagatttatagcccttttttgcagtacacatcgggtttcaatcatcactgctacagagtgagaggaaagctatggataaagaactatcagaaatccttgactacataaaattttatttcaggtcaccttgccataaaagatattgaatgtattttgtggcttttcctcctgacatgctaaccgttgtagaagagttgcaatatttggaggaaaccgtatgaaatgtggaacttaattcacttaagatggtttacatttgcgcgtgttttccactggaaatagccatgccagccttatgaatggcccctgggtaatgcagagtaaaaggcaatggcattaccgatattgttgagttttaaaaggaagttgtcttcttaaccatacggctgaacattttgtcattgttgtttcagaaggtctgctctaacatctgcactgcggcagagttgtgttacagggtgttatttacagctgcca

SEQ ID NO: 74214 - DNA, 3121 bp, Homo sapiens
aatacattccttatatctcttccagctcctgcatggaatggaggatctgacagtggccgttcctgggtattaaagccagtgcaaaagatagagcgtccaaaaggcaacttcttccttatttgtgaagtcagaaagtaaaatttacattgaagtgctaagctacattattctgaatattttggcagtcatatttgggcagatgagttgctttcctgaaattactcagcaccgtcattcatcctgacaaaagctagtggtacagatgcacctttgggactgaggccaaggtgaaacctgcgttttccaggtctgcccactcagttttggaaggactctcaataaaaccggcctcacaccccaagcatcacccctcctgtccttagtaagtacactctggctggaatctagggtcccagcatctagcccttgggacttcacataaattcatcaagtatcttcctccactcaaaaatctcttacagaatctttgacattttaagcttcattactgcaaagtggatatagttcattctcagcttcaggattccagaagcatacataccaggtcagaatggagaggcatcacgctttccttcagcaagcttcaggggagacaggatttagggtgggctacacatataccagttgtaggatgttttgaactatattcttgcaatcacagacaggttgtcccagagaaaataatctggctctaacttctcttgttatcagtgaaaagcaaaaattacttagtgcaggtatgcttaaaggaagaaaaaggcaagagaaaagtgagaggtaaaaattattaccattttaattccatgattctcagcaatgaaggagcatgattgaaatcccatgtgcccagtcatatctgtaaatgagagtatgatttttgaagactgtattcaattgtttcaacttgagcaattgcaagtaagacttaggactgtgtttaccagttactgttatttactattactttctaaatgtgacctgacttgaaacctttatagatgcaatttttatccatcacagaacaagctctaaagaggagagcagcttcaactttttcaagtattttttttaaaaggatttaactttgaccaacaccaaacttgcatcttgttaaggtaactaataactgactgctataacaatatttagaattttgtttaacagcaactgtcaaaaaaacaagttaaaatagcccaggagatggatggcgattaactctgcgttctttttagactgtgttattaattagctctctagactcaaataggttacatcctctgagcagtaaattgcatgccatttgcaagctctgtggatgaaatttacatgtggcctaaatgctatccacattgttttgttaagtagcattttatctctctggactggtcccttgcctcctcccccagccccagtggaaagttttattcacttttcttgcgggaagggaaagtcgcatgtagtttggtcatttggcgccatcttcttttttattgttaaatccactaaaggcagtcatgcctggcagtaccaggcgggctccttccggggttctggtcggctaagcattcagagttctttgctttttatttactagaaatgttttcagcttctgtctttgctttaagatctgattaaaaggaaccttaaaaaaggaacatagattttggtgtatgtttttcctctctacttctcttccctgtgccccccaaacccaatcaccaacttcccccatccccagcaaacacgggcttttttgtgtatttatttaaaagcattttaggaagcaccgtaataccgcacagcttggaggttaagatagaattggatgtttccctcaccatcagttgatggaatcatcagtgttccggttctatttatcttcatgatttgagaatgtttctgaacagctgcccttccgaggatgctggtatttagacagaccttcctgtcatttatctgactcacaggcacaactcttttgaaagaattaatatcaaacttacatatgaaaatctaccatttagaaatggattctttttcagtacctacttttcaattcaaccggggagatcccatctattttaaaaaatcattaatcacatacttctgacattttccctttcagtttcctcagggggaaaaaagttatttgaataacaaacaaacaaacaaaaacccctcatcgcaaatagctgtcagcctcctatgtgaacaaaagcgctctctcacactgagacctaccgtgttttgtttagttagaggcagcagggtggtagggacactatgcagaaaggcttgggttaatgagcactttctggattgagtgtctctcctgattaacccttggattacttgctttgagttgctaaccctctctcactgcccactcaagaatttcccacatggtagcctcatccatagatgcccttccctagatgcactgatggtagacagcataaaaatgtgtaagcactgtagctttccaatgaactgaaacaaaaagcttaagcattactttttatttccttgatctaaagaacatgttttgggggatattttcttaatcaatatctaagttatctagagttataaatactataaataaattagttacaaactaatttttagacacaagtcttttgttcaaaccaactcttacatagaaactctaaaaatttgggggggaaggggacagttggggatcagaatcactccccattatctctctgttggtgctccccaaaggatcttcagggaacgacgtttaaaaaccattttgtatcatgaaatgggacccgaaagacattctttctagtgactttgtgttagattgagtcatatgaaattgccactgtgtgacccattttgacctaaaaaaaaaaccaaaaaacaaaaaacaaaaaaccagcactagggtaccagagtatttttagtgtaatcactgtacgtgataagaaaatggagaaatgagaaagcttgaaacttagactataagctcctcataagctaatagcgacttcctcccttcttccgcagtcacctggcaagtcccttctatgtgctgctggttctagggatacagagataaaaggcgtagtca

SEQ ID NO: 74215 - DNA, 1050 bp, Homo sapiens
ttttaaatttaagtgaccatagcttcttagtatgatatcaggtttttgttttcttcccaccttgtctttgttttttagtgtgtggatgcctttgaaattagtttttttgtttgcttggtttttttttgagatggagtctcactctgtcgccaggctggagtgcagtggcgcgatctcggctcactgcaacctctgcctgccaggttcaagcgattctcctgcctcagcctcccaagtagctgggactataggcacatgccaccatgcccagctaattttttgtatttttagtagagacggtatttcaccgtgttagccagagtagtccgatctcctgacctcgtgatccgcccaccttggcctcccatagcactgggattacacatatgagccactgtgcctggccaaaattagttcattttttatacatgtcctttacacaggagatgtattcagaaagattatctatattttttcctttaaacaatgcatttgtttgtttgttttatttgtaagctcatctcctgggtttagagcagaatgaaaaatttgaccttaatcttctcttatccactggttggaagctcctacttttatgtcaacagacataaaaaagcttatacatataagataatgtatagcatgcataaagatttatagaatgctatgtctcataaatttcacagttataaaacaaaacctaagcttatgcatgtggagatattcctgtgtttgcagttgtcagtgacttctagagaatgtggtaaaggaaaaaagcacctgtggaagttatttatgtaaaagttgcttatgtaaagactcaagccattaacaagagaaggagacttctttatattgttaatgacattcagatctttcttctgaatgagggttgtcactctgaatgagtgttgtcattcatttcctccaagccttcagatatctttttcctttatctgacacatttcaggaaagagtaagggaaagatttatttatattactttgatggtttcattttctttgtggaagtccagtgacccagatataga

SEQ ID NO: 74216 - DNA, 1017 bp, Homo sapiens
ttcagtgccccttagtctctctataagaatttgttacagcatattcagatgtggtaaattgtcacagaaatgaaaacttttcattttagtaaggataagtaagaaacagaggtgacaaggtttaactggagagttccagtttgggtaggtaagttaccattcatcatgatggttacaggtttcagtgatcttttttgtgacagatgtaccaacatttaattgtttttcatcaagggcggagagaaaagacacttgtgtagatttttcaattctcctccgtgtcacttggctgtcctcaccattgtctgagctcctttctcttatcctttttgctgcaatgagttgtgtcattccctcatggtcagcacttttgttgtctttgttttttgctgtacctcagaagtccatcttttctttcatctctttcccattcatgcatgagggaacagttgtgccctgttgtggggatgttccgctgggtttcaaacagtagggtttctttttattctcttctaagtagtacaatggggctgaatgtctgttgcagaatgcacacactaatatgccaggttatttggtttctaagaagtcaataaaaatactacatttaggctcagtctttggcttgattttcccctatttgcctttcaagccttccgttatgaatctgtttgtttctgattgtaaaatataatcttgcatattaaaccgaagcgtggaatcaacaaacactttgaggaaaatgttcctggcggtggagtattttcacaccaggcagggttggcagccggcaccctcccttgataagagcctggaaacagcccccagagcaattaatggcagctccgacttggagaagatgaaaaaaaaaaaaagaatggatcccaagttggtcttggcaaaactttctggtgtaagaaaccagctcctctctgcatttagagggtacagctgtgattgttttcgtgcagacttctcactcagttcttgttttggtggggagttgagcacgagcag

SEQ ID NO: 74217 - DNA, 1428 bp, Homo sapiens
gctgaaagttcttgatgcgtcctgctgagtattagcatttctcgggcctacttggctatggggaagaggcacgcactgcagacagctctctaagccttgacaagcagggctggcctctacacatgaccgtgatctgggatatcggtttaggaaagagcccgctctcaggttgctggcagaaaacaaatcttgatgtaaaagaagagaagaccgaacagtaagatggtgacttgctgtggtaataccgtgcggtttttttaaggttctggacctgcttcttactcagaagctcacagcttgggtaagtttcaggaactgctctcaaggggaacaaaagaaaaggaaaagtgagggctaacaatgtgagctttcactggggctgttgtgggaaagttgaagattggccccaggatggtcaggatcaggtagaaaactggattctattgtcatttgttttcttttattgaccagctttcttgtttgtggagagggcagcagagagatgaagggacattctagtactatgctgtagaaactcagtgggaaatgttaactgttttgatgttaggatatatctaaaatgcttagttaaactgagtcccatacctgttgtattttataagctcattttggaaaatgtacgtaatgtttatttattgtaaatgcaaggtctgttcggtatccgtacatttccacgccgctgaaagggtggatttggttctgatggactggaacggctcccggggaggcattgtggtgtttgcgtaaatcccctttcctttttggtttactcatttgatgcaggagggtcggttcttgggctgttgctttctctcctgttaatccagctactgcacatgcgcacgaaggcaacaggttaaaagtcctaatttaagatagctttgggtatggagagataaaatccctttttctccagttgaagcatctgtttttcagttgagtgtagatgggttgattttcatgaatgtatacatctaatatgtttatgtaaacacattaaggcaagatttcagaattaatttcagagtatgttttatgataattactgctattctgccaaaagtttaatagccaatcataagaattttcttaaattattattttcaaattaataaggtgttagacttctcatttgttctttctggtactgttttgagattaagaactcaaagatgaactcattcattcatcaaatattatttattaaactcttcctccatgccaggctcattgtcataattatcattgtaattagtctgtaacttatatttacaatgattatgtaaatagcggaaacacctaactatcctgcttcttggtaatcaggtttaactctccatggggtcggtgtgttctttctgaagcatgtctttgaatagattactcgggccttcccctagttcttgg

SEQ ID NO: 74218 - DNA, 1077 bp, Homo sapiens
agggccttgctatgggaaccagagaaagcagaatggccagggccatccaattgtctccttcccagagatcaggatgaagggctgtgttaaaagatctctctcatcttcagctggaaacaaatagtactgaaaagaatgatctggactgtttctcttgtcttttaaaagtgtgaggcctaaagaggggagagagtatctttgtgctgtgttatgcctgacacattgtcggtgaccaacagatgtacttggccatttatatggggataacatacatgtgatcttagccaaaaggccctccaaaccttccttcagcagccctttagattgggctcctttgtcagtcatctgcttgagtatcagctatgctgaaggaaaagacatagggaatggtggttggaggtggtggcagccagagataaatgtatctctgaggcatggtttcatctggtcagtaagatgtgtgcctttggatctgcttcgggctaaatatcttaggggtttggtgggctttagaagtgtgtgtaaatgggaggcgggaaagtgaggccggagactcatcatcactgctctccaccctccagaggggactgcggaaagcgcagccagccatcggcctgttgacaaggcactggcagtcactgaaaaattcttttcctttctctgtcaattagcaaatgatggtcttctactgataaagtttaggaataaaggagaaagaggaagatggaatcctggaccactttcagcctgcacttgagtattccttatgtgttctcctgactccctggtgccactaccccctgccaccgtcggccctgtggcagtggggcccttccccccgccagcctcggcaccgcttcagtgtggctggtgcctccaccaccattggtactgtgtcagcattgctggtgcacctgccaccgtcggtccctcatcagcattgcccatgcccccaccaccgtcagtccctcatcagcattgccggtgcccccctaccaccgttggtcccacatcagcgtggccggtgcctccaccaccgttggccccacgtcagcgtggccagtgctgcgacccagt

SEQ ID NO: 74219 - DNA, 1020 bp, Homo sapiens
aatgtaagatatagtagagatgagtagagaacagaacttaaaaaaaaaaacaaactgtaattactaggaaattgactctaccagggaaattaacagacttgtccaaaattgtccctgtagacagagagggctggtaaggctggaatgaacccgtcgtaatttgaatgcttaaaactttttccattttattgtcaaaattattgcctgaacttcctttttctcctcatttgcctatttcccttgctttttatcttgtgcaccaccagtatacaacatagtggtgtttaactacttcctgaaggcattattagtcatcaggaacaccaggtcattatcgaagtagataaatgggcattccgcccatcgactaccccttggactaatttggaaaatatggttccttccctcagaagaaacagcccatgctcctctggacacttataaaatagccatgcgcacgtctctgttccttctgaacaactggaattaatgtgtcctgcttgatgctaaactggagtttaattcacaatggcaaggacgcttcacctagaatatctgtccatgtgaaaggtggggagcagtgcagcttccatctccctgtctgttttttggtgggctttcagcttttctgtcccatgactgttagtgactgcagcgtaaccccaaatctttcaccagatgttgtctcaccatcttaaggaaagaagaaagttctaatggatgttttgaatgtgctcgacttttattttgttcagacccaaactgaatgaggcagaggttaaaatcttttcttgttccatctgagtaagcacgaaaacctatgatccttaatcttttagaagaaaaataacccttctctgttagtgggatttctgattcatttcttctgccctgctcccctgctctgcatttttttagtcaaatactgtctggacttttgtgagccaataacctccctcctcacctcattcccctctcttcccctcccctgtgatcacacaaagagcagagagccctcaa

SEQ ID NO: 74220 - DNA, 1054 bp, Homo sapiens
agaggcagagtctcgctgtgtcacctaaactgaagtgcagtggtgtgatcatagctcactgcagactcaaactcctgggctcaagccatcctcccgcctcagcctcctgagcagttaggaccacaggcgggcaccattgcacccagctaatttttaaatttttttgtagagatgagatctttgctatattacccaggctggtcttgaactcctggactcaagtaatcctcccacctcagcctcccaaagtgctgggattataggtgtgagccaccacacccagcatttttttttttttaagagtgaagtttctctggttaatgtgaatgtgagttaataggctctggcttgtgcagtgcagtgccctgagaaaactgatattaattgtacagttgtgaaatgtggtataatattgtcaatagcagcttgtttaaaaaatttagattgcaaaataaaataaacctgtgtttccatatataaaacaggcagcaataatagtacctacttcaaaggactgtccaaaggattaagtgagataatgtaaataagggatttaataaatgttaaagagaaaaaaatctaccattgagaatatgtttgtttgcacaagacttggtacctttatcttagcatactgtatcttagacagatacagtatccctaatacactgtagatacctaaatcatgcttctcatcgatttcagttaatacaaaatatagtcctatatctcttttcaacacaattctgattttaaaggaagggtcttcttaaaggaagaccattgtttgtttgaaacagaattactatatcctatacgtttcttttcttttttttttttttttttttttttgagctggaatctcgctctgtcatccaggctggagtgcagtagcgcaatcttggctcactgcaacctctgcctcccgagttcaagcgattctcctgcctcagcctcctaagcagttgggattacaggcacccgccaccacgcccagctaatttttgtatttttagtagagatggggtttcaccatgttggccagggtggtctc

SEQ ID NO: 74221 - DNA, 1027 bp, Homo sapiens
tctaccataattttaaaagattatccagctaggcatggtggctcatgcctataatcccagcattttgggagcccaaggcagatggatcccttgagcctaggagttcaagaccagcctgggcaacatgacgaaatcccatctctacaaaaaatacaaaaaattagccaggcatggtggcacacacctgtagtcccaactactggggaggctgaggtgggaggatcacctgagcctggaggtggaggttgcagtgagccgagatcacaccactgcacttcaaactgggcgacagagcaagaccctgtctcaaaaaaataaaaataaaaaaagattatccatgtgttctattttaattttgcattaaaatatagtttttcacaagtttataaatacagaaatctcattctggactaaccccaatcacgtgtcttgcaggaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaaggtaatggcatgattttagtatgagaaaaagaaaggtattgaaatttgcttctcttccgaatagtgacattgcccgctatttggaaagattctaccacactcatcttttgctgattattaacaattctttgatctgcttttatataggttctaaatgtgtatctcttttctctgagagaaaggaagaatcccaccaaaatatattttaaaatcacgaccttcagtagatgagactatgtgtatgtatagataaaaagatggacaatcaattttggccatgatgtttgccggtctaggtaaatgagtgacatcaggggtccccaatccccaggccatggaccagtacaggccacaatacaggcctgttaggaactgggccagaacccaggagatgagcagtgggtga

SEQ ID NO: 74222 - DNA, 1012 bp, Homo sapiens
ggattttcacttgtccaatatcatcctagcagaagtgagccaaggttccccatctcaagttgccaggcaggttgctgtggggtggcatcttggagagtcagacacagtagtgtagactggttgggtacaagcaaaagtgggcagcccacctactccatctagtcagtcaccacaccctaatgttatgacttacttcatacctgcttccctggtaggctcttggctttgtgaagagggtgccatcgtatcccccattgcttaccagggtgcccaagacatagtcatagtaggtattcagcaaatattttatgaataaatgggttacatgtgatcaatatatggtagctgttattaatttgctattatttcaacattgatagaagcaccatgttgtagaaattatagtccctttttattttatatttgtcatgccccactttgggagttatatagagttcagagtgcatcttagtctcatatagatgcatgtgtggagacagaaatgaaagaactcaagtcatgagttgaacgattttaatgcctaaatacatgtatgactgaatttttgttatatgttagatttgggatcttacagtatatttaagatttaagatcttatagtatctcaggaagatagttccactgacatgaaaataactctgaactgtctcttttagaggatgtataagcattccatgttaacagaacttgcagtggcagttagaaaatattccagtcaaatttctggttttggagctgagtttattgcctgtttgttgtttgatcttattcaaatcatgtttttgttgtgttgtattaatatataaaagatttctgtgtctgccatgttagctgtttgtgtgtgtgtgtgtgtgtgtgtgtgtgtgtttaaacaacactccacagctgagctcttggaggaccaggcctattttgacagctccccttagtccatgtatcaccaagctcattctctgccaatacgttccacgtgattttgtggacatgtgta

SEQ ID NO: 74223 - DNA, 1133 bp, Homo sapiens
ctttcccagcatgtgccacttcattactcttagtggaggtgggaatggcatgattgtggtggactctcaagatctatcccacttctctgtaaccaagcaaatcggtaactcatccaaactcaagggctaagtctgactagaccaacaaggggtaattcagccctccttgccagccctgacttttcatcaccagtgacagatgtggagtggccggctgaaggtttctaggaaggttttctttcctcttaagagaaggccatggcaaatcagtctttcctttctgctaacaatgacaaaaggatgtgttgctacagtcactaaggatagcttgccctagaacaaaggcaacattgtgggttggagagtaagtagagaatgaatgggcatccttgatgacactgctcagctgctggcttcaccagcccatcgctggatgttgtcacataaatgtcgttagtgtttaattaagccagtctgaatttgggtttccaatcttccagcccaatgtatcctaactgaaaaggaactgcagtggaaagcctatgggctttggtgtccaatacattggatttgattcttcttagcagtgtgaactgacctgactttcctaatatgtgtaatggagaaagtaatacttctcacctggggttgatgtgtggaacaaagaaaatatgtatgtaaaacacttaccagagtgcctaaaacacaaccaatgttgtttcttttccatttaggagatggttcacttgttgatctggggggtccagtgggttgaattgatcaacagtgaaatcagtaaactctctggtcctttgcacatgaactgtcaggtagttcaccgtctagtatgggagtcagatagacattcgcggtcacactaacagtggggttcgactgcagtcctaactggagaacagtgtccagctaacagaggttgagagtactgatcaaaccacacctgaaggctggagtgcaggtctcgtagccatgaactagagaacaagaaacagcggaagatgctgaggatgttaatactgaagaaaggacgaccagaaaacagaaacgacttcaaagagaaaagggagtggaatcgttctgtgctgcttcagagggtggagtgaggacagacccca

SEQ ID NO: 74224 - DNA, 1010 bp, Homo sapiens
tggcaactcccattctgctttctgtctatatgaatttgtctactctagatacctcatagaagtggaatcatgcagtatttgtccttttgtgactggcttatttcactccgcctattgtcttcaagattcatttgtgttatagtgtgtatcaaaatgtctttcctttttgaggctggatagtattccatggcatgtatataccacattttgcttatccgcttatctgtcaatagacacttgggttctttccactttcggctgttgtaaatattgttgccatgaacatgggtgtacacgtgtctgttcgagtccctgctttaattcttttgggtatatccccagaagtgggattgctggatcatccggtagttctttgtttaattttttgagaaattgccgtactgttaatagcatatactttaaaaacctatatgttaaccaaggagaagaaaacaagttaatttgaagagagtcagaaagcgtgagtgtccagagcctactgagccctggaagtcacggataaaaacaagaagtgaagtcaacactctcggtgagaaagggagcggtactgacaaacttctaccatcccagtgtgcccggttgctcccacgccctcaggatactaaagctgggaggaaggagggggtgggggaggggactcagagggagagctactgagtgcctgcagggattatttcgaggtgcttttgcatccattaacttatttaatcatcaaaacaactcagcaggtgcccttatttttatggacaagtcttgtcaggtacttaacatttttaatttttattgcttttaaaagcaatgaagaatatctttaagagggaagaaataattctgaatccaccaagctcacacaaaattcacctcagtactgccctattttcctttgctccctttgcagccataatttttacatggttgcgttgttgtcatttcattttctactttttaaattgctacagagatctttgtatttattattttaacagatg

SEQ ID NO: 74225 - DNA, 1007 bp, Homo sapiens
aattggcttgcctcctagctgttttgtccccacactccatcaaaaaatattttctgcatctctaatttcatcaagatatgcctgactgagaatgtcaaaaccactgagcagaagtgtttaatccaaagttggctccgccggtgatgatcagctgaggaaacaacctcgaatttttccctcattatttgttaggatgtcagtttttcactttatggaataggttcacatcctgcttctcaccccctgccccccactcttcattgggcagaggcctcccactgatttccaatagagctctctgcacccaagaaagacacatggagaagaaatggtacctggccgtctgtgggtatgccaccttcaacaaagatgtccataagcagacagtcacttcatggtttcttggacaggcagatcctggccatgttcatgtaattccataaggtaaggctggagaggctgagctgcccacttaacaagcaacaagccctgggggagtctgggcagcccaaggtagaactaggggtggaagatccttgcttggccctcggatggctgtacgacgtcaggacaggctgttaacccctctgagcctcagtgccgtcctctgtaaaatgggaataatatcagctacctcctagggttgctacaaggataaaaaccaagtaagtgcgtgtgaatgccctttatcatgaatgagaaggtgccctgtaaatgttgcttattagctgaccttagagataagaatcaaaatgacacacttttgttccaggtagtttttcccctttggcttagtccccttttttatgagggatgatctgctgtttaaagcatttattaatataaagattatgaagggaaggatttagaatgtaattagtggggaagggggcctgcttctctgggatgagaacgccatgacttgttggctcagtacagcacactggtaatcttgtttcctgaggctctgcacacgctgagagcacatcgtgctcacaggcacactt

SEQ ID NO: 74226 - DNA, 1035 bp, Homo sapiens
gttcccatatatttcaacacacacaccttaaacacaggttttctgagtgaagtcagtgatgaaagcctgtgggttaggggaattttcccatggtagcgacagctgttcccacagaaacagctcaatttatctcagagatgaaggtttcactagcttgggcctctcatcaaattgcatgcatgggaattatttttaagcactctaaaatggtatcatttcctagtggcaaattatttgggtgtattttgaaactaattaaaagggaaatgtcctattttgtaaagagcagcatttctacattttaaaaatcagatgttctcagtggggagcagggttttctcttcgtcagtgttggctattgctaagtgcgtcccagattgaaaacctaaatgaaataactacaaggaaaggcatggggtaagcttatgttggaaaaggtggagggagacacacatatataatacatacaccatttatctgggaatttagaaagccttttcatgtcatctttttttctttcttgctcattgcttgttatttcactgtgagccttgcaaatatggagggcggcagaggtgccaggctccatcacggtgtccaaaaattggctttgtacatatgctgaattagagattggctggcagaagcagtgtgcagaccctagattggcagggattcctcgtgacggaagacagggctatgaacccacgggatgtactctgaagccagcagccatgcaacgtgctgcatccccacatgccaaaacctgttttcaaatacattcagaatctgcatcaggcatcagatcccacccaggtaacgccctccaaaactcgaatcccctttcctttctcatgaggaagggaatgtgttgaacctgtcacaggacagagatttgaaatttttcacccaaggctccaggtcattttagtcaccacctcttgtgaataggcaccgtagcatccaaggaggaaggtaggaatcttgcagatgcaaaccttcctgttttttttcttccttggaaataagcaaact

SEQ ID NO: 74227 - DNA, 1042 bp, Homo sapiens
ggtctcacggggtggcaccaagggggccagcatgtcaagcgtaattcacaccggagcaagctttgggtcacattctgaatcatatgtgatgtagtgaacaagctctcggatgggcttcaggggatgtgcgttcaagtcctggctctccccccggcatcagagtgaccttcagtcatttgttgatctctctctcggacttttgtctccttgtttctaaaatgactagataattgtagagctttcttcagccctaaaattctgtgattctgaaactcagccagtcatctaaaaatgcattttctgcatgatgaaagatatttattaggcctaagtggaagagccagcattcttgatgaaaagaattactctatgcacacatcctaaggacagtggtttagatcagtgccctcctggtagagatgaacaacacaacgggaaggacaggcactgacgcacataaagatgaggaggctgagcgtggttccaggcaccactgcggtatagaaagtggcacctagagccagccaaggacataaagatggacttggagacactggagcagtgtgggtgcccctcagcccaggaatgttgcagagaggagtcatatgtgagattagggttgccccaagttacctctaagttctgtccaactcaactactctgtgagtctgtgacagtccctagctctgtgtcctaggacacagtgacacccctagagatcttaccaaagacctcaaatagtccaggcactgttcctcttaagggatgtagagaggagagggagagatggaaaagggagaactcacctttgttaacatactgctttctaataactcttttaaagaagtgttcattccattgttcatggaatatgcttccagtcgtggattgcattgaaaagataagtccatgtcctaatccctgggacctgtgaatgtgaccttatttggaaaaatggtctttgccgatgaagttaaggatctcgagaaaagaccatcatggattatctgggtgggcccaaaatccaatgacaagtgtcttt

SEQ ID NO: 74228 - DNA, 1042 bp, Homo sapiens
gcctcttctcagagctctgtctcaatagatcttttgataactgttttccaacacagtcttcatttcaatgttagaatatgatgttaatgaatttactagcttccagtcgaggatgaatagcttacagtgtttgcggcaatattggatgtatttatttccaagggaatgatttttaacagcacattgtgttcttatttgcttttcacaatccagttccagcatctgagaaactttgctttgatggttgactcccattagggaaacactgaaaacaattatcctgtagtggtctcggttcttcctggcagctttgcatttccatggtgcgagaccactgggtcgtaccacttgtttctccctccacgtcctcaaatgatctcttaaaagaacccactttagacctcattgttaccttccctctacttctttttcttcttattgaattcaattcaacaacatgtattaaatacttacaacctggtacccaggtagaagaagccaacgtatagacagggcatgtcattggatagtgataagatctgatggggtgagtatctaggcaacttagactgggtgtggggttgaaccagcatatttaaatttatgtaaaaactgagaaacaccctgaaaaggacttttattgttggacataattctctagtcctgaagttatcattcaagggagttcaagaactcatcccttaagtggactgggcaagctggccatttaccacttgtcacagttagaattaggaacttggctttcatattatccattggtgtcacagagtgggaggaaaacatcagtaatggatccataggaccaccagtggaggcaaattgaatttgggatatgttatatcaaatctgttaaagggaaaaaaaagaaagaaaaggaggggagagaaggaagaaaagaaaaaataaaagaaaaaaacccaaaagaattcattatataaccattatatgttaatggtacagtttaagagattttgaagtattgtcatatatcatttcattaagtagtatatacatacataca

SEQ ID NO: 74229 - DNA, 1049 bp, Homo sapiens
gggaagaaaacccaagtggttgtgcagtgcgcctgcctggcaccagtgaaggaatgaagctgcggaaaaagtcaatgtgaagagctggcaggaggagaaggtggaaagcgcgatggaaatcaaatgcggtgccagccacggcattgttttattagcatttgctcgaggaaaacatttaattatagaagatcggaagctcccagtgtttgtgagctaggtgacatgacgcaggctctgccacttgctccacgatacacatcttcagaggaactgtggcacaccgcgacaggctgcgaagagaagccacctcccgggggcctggtccttgctggggggcccttagctgtaacagcctctgttctccagcgatcctcagtctgccttttttaaaaaattaagtgtcctgctggccgtccttcttctccttcgttttctggtttttccacattatatttttcttttccttgttgatttttgaagaaaataaaattgacaaagaataggatggaaaagtactacccttaaaaatgcttatatatttgccacctaaaaaaaaaacaaagccatttttcagttatagttttctttgggaaataattaggaagcaaaacaaccaagaataaaaaaaaataaatgggggagcatgaggctgtagtgaactctgtttgtgcctgtgaatagccactgcactccagcctgggccagcagagcaagaccctgtctctacaaaatacataagtaaaataaatgatctaaaggactcagtatatatttaagcaacagaaatgaaaacatgcaaaggtggaaccaacattacgaatgttgatggatattaccaatattaccaaatattgtgtggagatttttttttttttttttttttttgagacggggtcttactctgtcacccaggctggagtgcagtgtcatgatctcagctcactgcaagctccgcctgtgtggagatattttttattcctttttgttttaaagccctgtctactttaaaaatagtttgtgaaaataatgatgcagtatcacgtacctgc

SEQ ID NO: 74230 - DNA, 2868 bp, Homo sapiens
attttccccttcccattgggaagtaatgctaatgagaaagacgacacttccatacagaagcacacccatgtgcactgcggtgcgtctcggctatgttatagctatcgcgaatgaaacctaaaaatcaactgctcacctttcagactggatgactcctttcaaatattatttatttggtggacaggaaatgtgtagatagaataatggtgctcagactctgaatccacataacagtttcatcaaccatttgatggtgctcccctcaatgataaaaataaacaataaactttttattgacacttacagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtgggtgagtagctaatgctttgccttaagactcaggagcagctaaggaggagtagcaggaagaagggatctgggtgccacaggtttggaaaatgcatgcagagagcagagaggaagggaattgagaaaaagcagtaagctcaagtatccgtttcttttacacaaggaaaactcgcctttgcccaaagtgttctatgaaacaactgcacttttgaaatgatgcttcgcttcctaattggatgtgtggtttggccagaacagcctcctcagtagccctcccagagtaatccctggaaactaggttgcccgagaatctcatcccttcctccaccctgcccggccctaagccaaggcctccacctggaagagcagtgacgtaaatggcccttactgagattcatctgaaatcatcccaggcagggagggcacatttgccgcatatgaaaaaatgaacccaaagaaggggaggaaaaggtcactctttagggcaactggaggaatgaacaggaagcttttaactagtggtttcaattagcactgatattatttcctgaacagttctctagtgcatcctttttaaattgctgacaggtgtgtttgtgtttcatgacagacttttcagccaataaaaacctgaaatgtaaagtggttggcatgtcaaattacttaagaaaacttttgaaataggcctaattacactatgattgttttaattgacaaagggtggaggggctagattttatttgagggtcgctattattctgcagatctctactgaataaaataacatttcactgtgttgttctgggacagaaaatgtgtcattctgggccctgtgaggtgtgaaaactggaagcgtttgtggtcggggcgagtgggcagtggtggtttcatggaagccacatctagtattatctctgaggctgtggctgccaccacagcaataccctgagttgttgtaacacctacgaaactgctcacctgctgaatgcacccgatgtgtgaggtctgcgttgcccagtgccacggccactatgacatgtggcttctgagcattgaaacgtggccagcacaaatggagatgtgctggaagtgcaaaatacacactcgattttgaagactcgggactcactgaggggacaaaaagagaatgtaaactatctcgataatttttatattgattacacattgaaataatatttgggatctattgggctaaatacaagatactattaaaattaaattcacctgtttcagtttaccctcaatgtagctacgagataatttaaaattattatatgtagctgctgctatacagtttcttttggacagctctgtgttggatccttcttgaagacccgtattcaaggaccagttatttattgactaagctggagttcttctctccagggttaccctcagaagctgggagatactagttaagagtatgttaatatcctggagggtcctgagcccattcagatatgtcttaagttgattgaaatggactctgaagtcactgttcccttttggtttcatagttaatgcctatttatcaccgttattacctttaacttaagatgggggagggggagacccagccagccttccgctatggcttctgttcactgttttaaatccttggaagtgagacacatacagaaatttaaatagaacttctagttaacagaagtccttttggctgtttattttttcctctccgtttgtatttatgcgaagcataaaacccagagcctgatgcacaactgaaagatgggcttacttgttttcttttgtgtgagaatctcttgctcgccttttgtcgctagtgtgggttcttgtttgactggcacggcttattggactataacaagcgtaaccctgcctcctttgtcatgggacaattctcccacaaatcccgaacagtgtgcattcttccaacacactattgggtgtgcactggaattgaaagaatcgctgagccctgctacttcatctcctccccaatctctttgtgatttctcccccttcttctcctccccctaccccagtcccctccacctcgctgaaatgaacactttaccaggccggaaacatttaatcgtctccttttgaaaaaattaattgaaacttctccactagttaccttttgtgttagtacttagtgcaattttttaagaaagagggggaggaggaggaggaggaggatgggctagaatatttaatttttaaatgcccctattggcttaaaaacaaaaggcattggggtgttctcactaagaacagggaatatattgtaaagtgttgacttggttttaaagtccatgatttttgtagttataactgtcatcacaaagaatggggcaagtcacttcac

SEQ ID NO: 74231 - DNA, 1044 bp, Homo sapiens
tgagaatataatcaaaagcatatccctaagatgcaaccagattcatccagtgatttaattttaagcactgcttcgccattttattccataatgtacttagaagcacttacaatgtctgaaattaatcaacagtgtccccaccggttcctcgtttctttcccacccacgtatattattagcaggttatatctccacctttcaagattcacggttatgtctacgacgaatggtatttgccttgactttcatatataaatgtcgaagttgctttatgaacacatcttggatgacttgttgcatttttattttcccctccggagttgcaggtttttgtgctgtctttaatcctgagaccatgtgcttgatcctaatgcaaataattcaattagtttgattttaaaattccttccttctcccctgtggttttacgagagtctcttaaagcaaaaacgaattctggaaagatataaataacttatagtgcaagcaaaatgagttaactcaaagtttctccaaaaatgagatgaactacaatttgaacattataactatattcatataatccattaaacaaagcaaatatatacaatatacttatcttggatgatattaaataccttttgaaaggggtaaatttgggctgcgtttttaggactgctttcagccaaactgtgttaagagtcaggtcgtcctgttactgaaatgcaccgtgcctcttccctctgacgcacgcgtttccgtgagacttagttctgttctgctcttttacaggcagtgtgtgaagaaaccctgaaggtcgggcctcaagtaggtctctttctagatgcagtcgtttttggaggagaagactttcgagccagcataggtgtcaaagacatctctctctctctttttctgtgtgtgtgtgtgtatatgtgtgtatatattttttctttgcccctcaaggatggacatttacataacaatgtatatttgccaaccatgacaatggtttttcatgacaatggaatggacactacttcctgataatttagggctcctcat

SEQ ID NO: 74232 - DNA, 1059 bp, Homo sapiens
atgaccccccccaattttttaaataagtgtgatctcgtatagggaaatactcttcaattatctgaactattaataaacgaattctccctgcgtttcatagcgactgaggaagaaaggagtcctctgccacatccatgcaattgtgcttgttcctgcctctttccaacggctggttaggatgtgacccaaatggaaaagttggagaaaaactccatgaaatttatctaatagaccctgatgttgttggcctgcaatgtatggcactggctgccaggtggccagatgttgctctgaaatgggaactaattcgataaaaaagagaaagcactgcatcgacactggcccctccaccatcacccagcagaatctgagtttcctctgcctcctctggggtaaatgtttgccccagaacttctctgggagctggagagtgtctccaagatacaggactgaattaacttggcccctaattcaatcgcagaagacaggctatttcaaatcaggtttaaatttctagactgtgcccagctcagcacgagaagcttatggacctggcactattgtttctccacgacggggagtattaaatcgctaaaaaaaaaggggggaagcgaggataatgggaaggcacagagggcacagtgcccattatatattcaagggaacgaggccataactagggagccacacttcgtaggcagtttgcaatttttagaaagtctttgttgccccaattatatttctgcataccaataagaggtaatcaatctgataataagatagattatttgtagtcattttttaaataaatgttttttaatgagtactttagaccactcaggatgtttgtcctagttgtttggcatttgattgccataccttgggccttgcacaaggagaagaaaaagaaggaaagaaaaaaaaggaaaggaaaagtggggaggagagagggagggatggaggaaggaagacatgtcttatctgaagcaggtggttgaaaggtttaaaatccaatgaaagtattgtgttatccataacgctggtaaggaagactaagtc

SEQ ID NO: 74233 - DNA, 1027 bp, Homo sapiens
aatttgagagaattctcatttaatttttttctacttcaactcaaaataatccctctaatttgcagacattatcctttaaagtcccagccaaagcagttattcaacaagctgcctagtcagcccacctgtaactaaaaataagagattatctgccctaaggtggcatttctataggatcggaaacacaattacttccattgttgtagttgtgcttctgtggtattctggaaaagcctgtctgattgcaggttttgtttgttttgttttgtttactcaataaaaagttttaaattagttatttaacatacagtctatgaggccttcaggaacctcacgcgatagaaacattttgtttgaacatctgttcgttgtttcgtggttccgatgttattaatattcttgtaggtaagcaggtgattcaccctaaccaaattgccgtggtccaggagcagttttctccttcccctgaaaaaattaagtgggctgaagaactgattgctgcctttaaagaacatcaacaattaggaaaggtaaatgttttgttaatgccttgggtgagagcagtattgaaaatattgtcgggaagaatgaaacaaatatgttgtgtgaatggtttaagaaaactcatcgtatctggagaggggggaaagggagggaacacaacattcaccagtgagaaaattgcttgagatagatttgccctgcccatgttcctaaatacttcactaactggctctcaagtccctcattttattcttttcataaaatatattggcagccttagagaaaatagaagtctgtttagtttttctctacagacttctatgcagcattcatatgaaaataatcctagatcaaagtgagaacaagttgtaatgaaataaacacagtttgactaaatggttcttgtggaggaaagaaataaattgcaagttattttaatttggggggaaaaaagtacagaaatctcctccggtttagtcatttaagagtgggaggttgtatatgtgtttgtaccaatttctgg

SEQ ID NO: 74234 - DNA, 1146 bp, Homo sapiens
aatcatctaatattgatatcaatagaaataattttatataaacacatatagcatacatgtttatacaacatataaacattcaagtatgtatgataacgtgtatttcctcaaatctatattatgagcttagtgctaaagtttttatctttccatattcatcactcttaggcaaaaatgacagctaaaggaaacagtcagttgcttttttaaaacagtcactaatcacaggaaatgttaatataggaatttactatttctttccaaatggagactctaacagaagaatgcgaaggaatagcacaatatattacgtgtgtcaaaattttaaagatactctgctagaatattcatattttgcagtatctggctacaaatatggctttgcttcattttcagttttccagacattctctttgattcatatcatggctgtacgtgctttgtttggttttggaaggattttgtttggctttttcaatatttctccttcgttatagcttcacaagttggctaaagactgaggaaggggaagtattcatctttaaattctaggttcaattaacaattacaaatgtcagaaacaagatcactacctggcctaacaactgtaagcatcacgcaaccaacattctcatttcactcaggagagaaaaacagtgcaagctgataagttcacattagtaagcacatcttctgctggaatataaactggaaacatctcttaataaagaaagaaaaaggaaagtaagagtttttttccttatgtaagtctcttcatctagaaactttacaaacagtaatacatccctcctcccaaaatattgaaagcccatcattttcataggtgtctgattgctgctcgcacacctttcatttctgtttccaaatgcaaggctttacaaaagaaatattgcttggtccagatggccttctagaagcctccctgagagaactcaggagaagtttctctagccaaaaatattgtttccgcttattcaagtgccagaaatcccactgccactctttcacgcagatcaaataaaccatctaaagacgtggttgttgtctttgtcaactgaaagggttgattccactattagacaacagtgtatcctcccacacccatccagcccacgacccacagcc

SEQ ID NO: 74235 - DNA, 1026 bp, Homo sapiens
gcttaaatttgatgtcaaacatttttaaataaagacatttaaacatttggcatgttacacatttgtcttggttttaaaaataatttttaaaaatctttaaagaagatttctggtttcaaaaagaaatctgagatggaggtgatagtagcggaactctacataattactaaaaaatcaatgacttatgcacgtacaatgggtggattttatggtatgcaaatcgtacctcaataaagccactttaaaaattgagaaaattaagcacaaaacctaatttgatggcaaatgtgttaactcccttagattttgatacacttgtaaatccaattgtcttcacctcaatacatagctttctacatagcatacttggctttatttttccagatttccttgtgaaaagatatcgaaaacaaagacttgcctactcttgcctgattattctgcctgaatatttttaaagagaaatcttgccatctacatgtttagaccccgaggaaagttttaaaaatagaaggctaccttggtctctcggatcagcgtttaaagtaagcatggctctggtccgtggagacccagacctgggcaagtagatgattcgggatggtcacatatgcagataactggcacacacatgcacctcagctctcctccctgttgttcagccgcctcgacctttcctgccctgctcctgccaaatccatcttccaagccttctactgcttctccttccccattgcacccccgacttcctggaactcttggtaaagtcctgaattagtcttgccaagaacaacacacaaatctttctattttctagccccatctttccatttatttagctaaagctaaataatttcatcctgcctttgtaaaaagcagaatgttaacgctgtctattcattttacatccactcaatttccacattccaagaaatgtcctcccttttgaacaaatgtgtctagctatcatctttgctacacctcttccttttctggtccatcatctgctgaaagaacggtgtcctg

SEQ ID NO: 74236 - DNA, 1010 bp, Homo sapiens
attacaagcgttgagccactgtgcccagccttcattacaatttttaaagatgtttatccataaaacaaagggttactgatattcagatgttatacaaggaccaaatatcactgccttcaatcctcctaacaactgctttaggtgtttttaagacttaaaatgtcactcatatattgtattattgaattctagtatttctggtattgtaataaattatagtaagaactttcaaatggaagcccaggatgaaaaatgttatagtttacttttgcccaaattctcttgttaaaattgcagtttcacgtatttgcttatctgcacattatctgtatgtatttttagcctcatcttatgtaataatatttctgaaatagtttagatatgctatttttataaattacattaaatataatttaaaatacatagtatatacaaaataaatatgtagctgtattagaactttataattatcccaaataccagttatcagccatactttgggttacaatgattaataagaagaatttgagatttggggtaaaaagccttagattctagtctcgtcctcttaagttcctttataagattaactagtactgaaccccattgtttgcacctgtaaaactaaataatcatgccttctgtactataggtgagaaaatgtctttgaaaatgttttgggccaggcgcggtggctcacagctataatctcagcactttgggaggccgcagcaggtgaatcacttgagatcaggagatcaagaccaatctggacaacagggcaaaaccccatctctactaaaaatacaaaaagttagccaggcttggtggggcatgcctgtagtcccagctagtcagctagtggggaggctgaggtgggaggaccacctgagcccgggaagtcaaggctacgatgagctgtgatcgtgccattgcactccagcctgggagacgggagtgagaccctgtctcaaaaaaaaaaagaatattttgtaatagtataaagtact

SEQ ID NO: 74237 - DNA, 1821 bp, Homo sapiens
tcggtattgctgctcttggctttgcattcagccttttccatcatcaccaggtcagcggtcacagagcatctcccgtgtacctggcaggtactgggtgctgggtgccaggtcctgggagtcaaaggtacgtgaggcctggcgcctccccacaggggcctcacagtgttgtgaaagacagcaatgtaaacaaatactctcactagatgggaacacaggctatacagagagctgtacagggaaagggtggagagggatttgctctaccaaggaggcctcaaaacacttcacagaggtgacaccttgacatctggaagcatcaggaggagtttgccagacagggaaagggccttcagagagagaacagggcatgcggcagagctgcagcgtggtgtgtgttggggtacaggcctcaggggactggcaggagatgaggctgaggggggagggtcccatcatgggcaggcttgggtctccactgaagatattgcacttaattctgcaagtccaaagaaaaccatggcagggttaaagcaagtggatgattccatcagatctgttttagaaagataacagcacgctcccaactagaaaagtgccactccctataaacatcctggcaccatgtccctgagagctccaggagccagctttggagccgggaagcctcactgagctgagggtgcctggcacccaaacggacatccttaaaatgaatgtcacaacaaaactgagagggaaccaagggcacacgagggcctttctaaggactctccaagtgggagaagttgcaaaataggaaagaagaatgaaacagtgcccatgagagtgtctccgggagcatcatcttccgcctttcctgaggagtttcagggcgctgttgacctcgtaggtaaggaggagccgtatcccaggaggccacagctgggctgagagatttagcaagtggaaggcacagccaggatctcgaggagaaatttgatcacggccaacactggctggaagtttaggaattccctgggaactgctgtgaggccagtcattcattcattgagcagaaagacttagcaccatatgggaaaagggtgataccccaaaaaaggactctagccgctgtattcaaatattagcgttaattctcacagagaactccctctcaggaagccacagcaacaccgtcatcagaatgtgccagaaggaaccccttcagtatccacagaagttaatttggaaacatagtgaatagggaaagacttagatcaatttgtggtttctagaaaattactcttttaggactatggagaaaaaagtcaagtactaagtaccagaaatgcaaaatatatgacaatttcccatagatgtgattactattgtcatcacgccatcatcatcaccttcaccatcaaattgtaagtcagattatgtcagtgcttatctgatccacgggcaatggccgaggtgtcagaaaaactacagttcgatggtgactgtttccttcctacgcggaagacacgtgtgctatggtgatactggccttcacctccaggagtctgaaatcatagacatatgtatagtaagatgtgcaaagcaattgaccagtgatttattacaacaaataacgccataggtaactgtcaaataaaagcccattgcgtccggagttccacggcaacgcgtggagatgcctggcattgctctaggtacccaatgtcgtatctgtgtgagcagtgcagtctcgcaaagatggccctgattgggaagaagtgcagccatggcaggccctcagatcgtccctgtgctcaccaccctggccttttctccgat

SEQ ID NO: 74238 - DNA, 1041 bp, Homo sapiens
gagccacaaatctggaccaaagtcccattccctgaacagagacccaaacgacgagggtcccagaagagagttcagtcctgatcagaaacccatggtgccttagtccttgaagaacaaaactctaggaagaagatgctggaaggcaaagggtattccccctctttccccacccgcgtctctgtggtgccatgggtgggcccaggtaccctgggaaaggtgggagagcagtcaagggtgggtgtgtgatctccactgggctcactgggcacccccgacacggggaagtgagagctgcccgactcctgagccaggcgtgggtgacaggaagaggaccttgcagctaatctgattcattagaaaccatacctgtttatgttttgtgtagctcatcacaagccgcttagccatatcacccccgttattaattcttggggtctaaattatgggtaacactattaaaacattatcagaactaatgagaaacaattacttagaaaatgagccgggacaagactgagttgggaacatcagtggtgatcactgtagattagtttaataaatcatcaggtgcaaggcaagactgactgtatgtatgcaaagccccgtcacgggaaaatgaaattgagattttttttttttgcataattttttcattaatctcaataggacccgtgtggtgtagattgctttattcccctaataccttgcctgaggcgggggggggggggggtgcccaataatgtcttcattgttttactgaggtcttaatgacaatctgtgacaacctcattttaatgtatagaggattatatcaatacagtcatgttttattgaaatggtgaagggaactccagtcagagtcaggcagtgtctgtgagcacaagttaggaagtttctcggcatccgggagcgttcccgtctgatgtcccagtgttagtcctcccggccgccctcccctcctctcctccagggacggctgggaaaacagtcctgcgggatgaagacttcaccgcctccgatttgaatttgaaagtaactcct

SEQ ID NO: 74239 - DNA, 1007 bp, Homo sapiens
aaggcttctgcggtggcttcccagcaatgcaagccatctcttaccaggaagtgctttggggtattgtctgctgagaaaggtgttacataaattgaaactccttttgctcagagctgagtcctgaaagttcatgcagtgagaaacatttctcaccgtgcacaaactgtgaattgtatatcaaattaaactttctgattaaaatctgcattgtcggacctcctgctggttgccaccattttgctgaaataagatactatttggggtaatggcagccagggaaagctgttatcattgattgtaaactggcttcactccctccacttgaaaatctggtgggcttcattgtgcaaacattgcatcttccatacaaatattacagagcaaagctccgctactgatccatcagctggagtaagcaggtttatagtctgaccccaacagctcttacgtctcctacaccccaacactgggctgcaggaggatcctgcaaggtgggagacccagcaggagaattcaagaagcatatatcaaagtctgctggtttttaatttaaaaaaaaaaaaaaatacagggtctcactctgtcgcccagactggagtacgccactatgcctggctaattttttgtatttttacagagacagggtcttgctatgttgctcaggctgctctgcaactcctggactcaagcgttcctcctgccttggcctcccaaattgctgggattgcgggcgtgagccaccatgcgcagcccagtttttaattttaaaaatatttgtagctgagcgaggtggcatgcacctgtagttccagctactttggaggctgaggcaggaagattgcttgagcccaggagtttgagtccagcctgggtaacatagtaagaaccctgtctttataaaaaattaaataaaataagataaatattttttcttcacaaggacattattatttgagagaggaaaggagataaaggaaaaaatgaggcctagcaggagttcaaattcc

SEQ ID NO: 74240 - DNA, 1304 bp, Homo sapiens
acattcacagtcaagtcttgaggaggtgtgatgatggcatcatgcctatttttttggaaagctgttgtttttaaaacaggccaacacctcttttatactgttgtatcagccttttaaaaagtctatttttcaatgcctgaaactgcattttaatgcattttcttccacctgagcactgagcacaccaaactggaatccatttgaaaatgacagtgtgtgaagtgtatgatttacattaaaagaggggagggagttgccatacatattaaaaatttttaaaaggtttatagttaccaccaaacactgatgaatgtgtgacctttgccagagctgtcaagctaggataaaaaaggtcaaggacctaggacaataactcttagtcgatttattttcggttggtacaacacatctcctgtgcaaaatgtagtccatcagaaacatcctacagatacactaaagagcactaatttatccttagagaccccgaagacaccccctccccagggtttgtagaaatttgttttgtgtgctgtgagtggttgatgtagtcttgtcattgttaataacttgtatgtgaacactattatttgtacagttgaattaatttattttcagacatcatcctttttttttttctttcctggaagagttcaaagcacaccaaagaattatattatacattttggtgaaagattgtcatttatgatccatggtttatttaaaaaaaaaaggaaagaaaatggaaaaatatatttttaagcttacttgaatgaacaacgtaatgtgaaaaccaagactcttcctgcatgtcttttttgcattgtgttgataagattatatatagtttatagatatattatattactagtacagtgcatggtgctgtcacttggaaagcctttcaatgttgtcttcagattgttgtgatgaatatgaaacatgcagaccctcctttataaagaaaaagaccttaaaacttgaatatgagataattttacattttaaaagtttatttgattttcatattattcactttcaaagccctttcaaatagaaaaggtatgaacttttggggggataatttatgtatcgtaaacttattagaacaaaatattcctgatgtataatgagttgttttatttatacaactttttcaatggtagtttgcactattctttattatgctacaggtttatttattatgaaacaaaggaatatgtattttatgtattttaccatgcataggttaactctttgccacagatttattggttcttgatacacctaaaataaaaaaaaatgtg

SEQ ID NO: 74241 - DNA, 2039 bp, Homo sapiens
atctgctgtgctcttaactgccctgcaagtagtgaggaaagctgtagaatgcagaggtcaacagcctgttctctgcccagctagccctgtaaaaatcgagtggtgggagtatgtttcacaggtgcctctatttctaaagaaaaacattgttttgttttacctctttccctttcccatctccacgttctctcctgatgcccctctccttcaatgaaatcctggagaacactgaaaggaaatgccattattataatttgactgtaccccccagtttacttttaatttagtgtatgtgtttgcttttttctctttttcttatacgcttacttccgcctgtggctttggaagtatcattttgtgtttattttgacaggaggatctcctgcttgtgtttttgagtgtacagaccctgaggggagtgtgtctgtcgggggagggggtctgcgggtcccaggtgggtttcagtgttacattctggcccttagctcagcactagggatctcaccctgatccctctgggactgcagggcctgacagcctctcaggagcccaggtccaggcaaagccaccaggtcagcagaatccaggcccatccctgaagcatcccttcccttttgtgaattaggaagaagaattaggctgggagttggtctctgggagaataggaaaaacacaaccttggttctgcttcaagatttctgtcaagagaggggtcttggaaagccattgttgacctttcctgtgtttccttgcaggggaaaagcctttcaaatgtgaatttgatggctgtgacaggaagtttgccaatagcagtgatcggaagaaacattcccatgtccacaccagtgacaagccctactactgcaagattcgaggctgtgacaaatcctacactcacccaagctccctgaggaagcacatgaagattcactgcaagtccccgccaccttctccaggaccccttggttactcatcagtggggactccagtgggcgcccccttgtcccctgtgctggacccagccaggagtcactccagcactctgtcccctcaggtgaccaacctcaatgagtggtacgtttgccaggccagtggggcccccagccacctccacaccccttccagcaacggaaccacctctgagactgaagatgaggaaatttacgggaaccctgaagttgtgcggacgatacattagaatttattattaataataataagtgaaataataagtgggagtccttggaccacatcctaacctgagacaatgccgagcctgagacaaacccgtgactcagacttgccaccgggtctaattagccctatttattcagtatgaaaccctatggtgtttgtacatttaattaatttaattaagatatttgggcttttttttttttttttcttaaaaaacaaacaaaaaacaaccaagctggacttgtacattgcaggaggatggggctgggggcaaattgtaccaaggaaaatgaatggagagattagttaatggcgatacacactgccgatgcaatatatatatatatatatatatacatatatatatatattattttttttaaaagggggagaaaaagagcattaagtcagaacttaacacagcaccaaggccctctgcatttcccagagtgcctctcaaatgcctttgacaccataccatgggctgcttttgagcctccttgttggaccctaattctgccaaggcctcttgattgtaaaccacacacctgctgcattgccaacagatcctgttccgtacctgtgtccaaaaacatttgtaaaaaccctttgagtttaatatttgtaatttttaatttccactcttttattactgatcttagcttaatacaatatttttatacaggattatttcttcagtatcctactgtgtgattttaaaaaaagatgcagcaaccttaatatatctccatatcttgtgctactgtgattgttcaagcaaaagtggagagaagaaaagctgctgcaaaagacaactgtgaaactgtgatattttataaaat

SEQ ID NO: 74242 - DNA, 1030 bp, Homo sapiens
cgagtaggttggggaggtgagaggcccagtaaatggccagctaaccagaacccaggttggctgagttaaccgcgctcagctgcctggaggccacgggacccgatctctggggatgctcgagctggcgcttgcggcttcccgctgcgcgtagtgggggactgaggctccaccgctcccccggtgccctctgtatgtcaccgaacacagccaagtttcctgcgaggggtgtgggcaattaataaactctaagggaagtgaattggacatttcctggcttttgagcctttgtttgattgtttctgcaggcggagggagggggatctcggggacggtggggtggacaagaaaggagctgggggacccaccgaaccgccctttattgcccctgcaattgctttacgactcgctggtcccgcgtggtttctgtgagagcggcctccctgcagaaggactgggtgtcggcgggtttggagcatctagtgtcatttaggccgcgccaggggcgggttcaagggcgaatggggcacccaaattactaggggaatcgaaggacctttgaaccccagcccaagggcgccaatgggtgcttaacaggcgcggaagtagggggttgctagcagacactggaaagggcctgatggtccactgagacctttcgtaaaagctagggcggggtgggcaaaggcaccggcacagctgtattttagtagagcttcgccagggccgtaagtgatggtgactttgggttcaagggttttcccaaatcaggttggccaggcactaggcagggagtttcagggcagcctctcctggccgcccgccccgtctgcacgaggcagggaccggatcccccatccccaccttccggccttggcaactcgcaatctgacttgcgttgggggctgcgactggcccaaggccttggggtgctcagaatcgctccgcaattggcagccctcccaggggctctcggagggttactgccctcctgaggtggcgctgagtcctgaggctccacggatatgtgtgg

SEQ ID NO: 74243 - DNA, 1011 bp, Homo sapiens
agggagggaggccggggcgggagactagggggtgcggggggaggggagaggaaaaggaggagacaaaaaataaaaaataaaaggctgccgctgcagcgttggcggcgcccatcgaaatcaacggaggcggtggcgaacgcagcccaccgcagccgagacctgggagcccgcctgggcctcacactccctcgggtcgcggactgcgctgggtccacgcggcgcggtcactagttccgggcccagcgcccaggcccgaccggcgggagggaggaggcgagcgagagatcacttttttattgttgttattgtttttcagcccagcctccccctcctcccctccccctgctcgctttctcccctcccacatccccctcccccctactcccccgcctcctcctccggcacaacttaaagaaagggggagcggcgcggctgctgccttcatctggggaaattcgtggccactgcaagtttactacgcgaggcgcagccaatgccaagcgccgaggccgaggagggctaaacactgcggccgcggctccgaacaataaccgccgcgcgcggggcggcgcgagtagggccgcgggggagggagctgtcgccgcagagcgccgcggagaggacgcctggactccgcctgccgccccggcgcccccgccgcggtcaggtggagccgctggtgcgctggccccgggtgccgagcgcggagctcgcctcggtcctctcctcgcccgtctgcctggcgtgcgcacggccgccgcggttgtgactgcattctaccggcgctgctcggtgcggccgggctccgggtccgctgggcgtgcgagtgagtgtgtgcgtgcgcgcgcgggtgcgcgcaggggtgggggctgcggcgcggcgctcgccccccggtagcccccctctcctctcggctccccacacctccctccggctccctcctcccgcccgccctcccctgccctgcccgcccgcccccgccgcagctcctttaatacactttggttctcc

SEQ ID NO: 74244 - DNA, 1031 bp, Homo sapiens
tgtctgaatgtgcttttctgctcggagtgtatgtctgtctgagtggtttgtgtgttttcccacttcttttactcggggtccaaacgcccttcccgggactgtttcccatgaaatgagtctggtgtgagccgaagctgtaatgcgtttctcatttttaaagtgtttttaaagcccgtctcggggtgggtcgcgggggctttactgtggtttcgcagcagtttgtgaaattctctaatgggcaccacagagtttgcgattcccaacttggacccaggtcagctagagccccaggtcagctagagccccaggcagcgcggccccgcggggggatcgcgtgagaagagagagccgcaaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaagtggaacgacgtttgagttctcgcacctctaaatgactccaagcatttggaattctggcaacaggatgcagagacagccagaaaattaaacggggaggttttgaaaggctttgctgactcccccaaccctcgcccaccagcttgtgcctctccgcagtcactagatgctgccttatctctaatatttaccttttcttcaacttatttttttaaagacgggaggtgagactagaattgtggttaattcaatttgcagaattttggatgaaaaatactggctcagtcactctccacagcccggcccccaaacaacacgtagcaactccaaatgtaattgcttactggccctggc

SEQ ID NO: 74245 - DNA, 1376 bp, Homo sapiens
gcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacatactattttttctagcaaagttattaaagaaaatgggggaagaggcagctgaggattgacctgggtacgcctcagcgagcctgagtgggcgggaggcacacgcgttctggggaggaaggtgtgtgtctgcatagaaaccaagccaaagtgcccgtttggcagaaggtctcaaaattattttcttcggcctttgtttaatagctgaga

SEQ ID NO: 74246 - DNA, 1097 bp, Homo sapiens
attgaaggagaacacacagacacatagagacatagtgttcattttagtgttgaaacacaccagaaaacttcccacttccattcatatttggattcctgtttggatgtctagtttttactataaaaaatatcacaaaccaaacaacaacaacaatgtatcattaaaaagatgctgacagttatgtattttattcaccaacctacacactcctcattcctacttcatttttcccctcctagtgtttttcttgtaattatatctttcagattgtaactttcaggggagaagtatattttgaaatattttctaaatagaaaacaaaaggtctcagtaactcagaaataagttaacaattcctaagcatctctgtgggtctttggcatgtgtgtgtgttttctttttcctttcaaattaagatgaaaaaattataagggagaatcactccatctcagcacctaaatcctgtaaagtggactttaactgcagattttggtggacaagctgcccttctgcagcacactctctaactgcatatttcagcttctcgatgctcccacttgaaagagacatagacctcagccacctcctctctgaggcaatttactcagcttctccaatcacacagttctttaacggggcagaaattgttgggttgtttttaatcaagtttggaagctgaatctctttcccctgatgactgtgcccaggggtggatccggctgaatgtctggcgctgcgggcagcgggcttggccacccgtttttcagacacaacaccagagaatggcactgaaataatcgcgtgtagcagaaatgtttaaaaacattaacctctcttattttctatacttgtgaattaaaaggcaaaagaagctgaaaggaaatctgaaatgatactcatttacctactgaaggcagaccaagaaactgtaaagatgcttgatgctttgaaaatgtactctgtaaaatctttcaaattagatgctgcttaagatcaatggcagtaaaaatatttttatggtttgattggttaaaacatttttagatattagtgatgataaattaacagatcagaagtttctttctaggaacaatttg

SEQ ID NO: 74247 - DNA, 1111 bp, Homo sapiens
ccacaaaaatggtaaaatatattgtcacatttatatcaaactgctaaaataagttttgatattttttaaaaaatgagatctcatcaggttaaatgaaaagagttgagaatcttcattcccaaagaggaaaatgattctgtatatcaacagaatcattcaacctttgactgtattctctatctacgttcctaaattgaacctatctatacatattttgttgctttgtctgtgtacagtcatgttggatttaaatgagaaatatctgattttaccacgttgaaacaagaacctaaaattagggaagtattcactgtgactcacatcttacccaggcagcctgctgttgaaaggatgatccctggtgcgcactgtagtctcagcctcaggattctataatgagattgagtggggtttcctgtgagcactctggggtgattgacagtaaggtgagggcagtcatcactttttatgcctacccttgatgatatgtccctgctgtctggggagggaccgaggacgaataggacttggtgatgtctaagtaattagtgtatgttggttccagctgaacaaactggagggtaatgatcaggtaaatggaaatggaacacattaatgcagactaaggtataaaagaccttagggttaaacttttcaacattttatgggattattagaatatctttatttcattttttatatttacatgtctctgtatatacatacacttatttatatttttgtcagtgtatcttcagttttaccttagatgtatatagagatgaaagcaacttaaatgtgaaaacctcaaacgcattttttctcctttacatgatttcagaatattttcaaactttttctgtttggaaaggagttaaggttcttaattaaacattttctttttaatttcacaaaaattgttaatggacttgtttggagctgatgcctatcactgatcctcaaataggagcaaatgactaaagtcaggcttggaaaacttttttggggtgttaactgaaaagtatcaggtgaccttttatttgtgtgtgtgtgtgtgtgtgtgtgtgtacttgagaatgttatatttcagtaacattttcttaaactgcct

SEQ ID NO: 74248 - DNA, 1048 bp, Homo sapiens
ttttaatctcctagttttctctctacttctgtggccctcctctgtgtcccctctacaggaatcactcaaggtttgattggtgggctcttcttaaaattgttttattttttgtactttctctacccttaccctgaaagatggcattctcttccacttctgtttctgtggttttaatcaaccctagactccaactctgttttctctctctctgtgacgtctctagttgaatgttttaccactacctcaaacccagcattacccaaactgaactttgatccttcgggcttcttgtatctgaatcctcctgcagaagcacaagatgtaggaatttatgttcaccatcattctttctttcatttctcatttccaatttatgagcaagtccttttcataaataattttggaatctagtcacctatcttcacttcgttattgcttctttagcaaggtcttttaaaatcttctagtgaatcttttaatcttttagactgataaaattaatttcatctggggcagtttatctaatgtgaactgtttcagtttctgaagttttgtttgatagcgaatgctttcttactctgttttggaattttagttcataggctcttttttctggtgaaagttaaaaatgtttattgctcttcatgcttcatcttctcccttccctttgcttccttgaccttcctcttcctctctctttcctagtttctctctcaccccggccattgctgcctcccaccttctccctgaccagtagttttgtgggtgcccccccgccggcattttggattcctaatctacatccaggtcttatggtgatagtttggacacatggcagattagtcccagcagcttgttcagattttgaccctgaagctgtggttctgcctccctaggtccacagtctccaggagttgtagtgagctgtagttgcagacaatacttggtggcctcctcttcaggccaagggcagttcctctttggcctggtcttcaccagtggctctggctctcttctcagtcttgtgagaacattctcgccatctgta

SEQ ID NO: 74249 - DNA, 1061 bp, Homo sapiens
tgaacggaataggaagctaaaattgtttgctgtgattttacataaagagataggggatattatggaaattatttggttagacaatgaattaggctgtaataaatgaaatcatggttaatagagttcctgagtttatttgttgcattgttgctttttagtgcatactcaaaaagaaatacgactctataaatgataggcagaacaatcagatttgcaattttgtgtgtatttgcagatgatggtaattctttttgctgggcgcatctgttaatgcagaaatttgtctcctcaggttcatgtgaaaatggcggatgaggctgtctgtgttggcccagctcccaccagtaaaagctacctcaacatggatgccatcatggaagccattaagaaaaccagggcccaagctgtgagtctgaatgaatctatctactgcagctgtttcatatgtagtgagcagaaagctagagtttgtatttaaaaaaaaaaataggaaagaatgattgaaaatgctgttgcagttagttcatgtcacatgagttaaatgtggtcgaattcgctactggaaatcaaaggctttgtagcatctggcagtgttggttgctgatcctgcaggtggctgctggattcagctttcacaccagggagcagtttcagttcatttccaaatttgctaggaaaaaagaaatcccaattagttttgagtattaaccctttccgtgtaataagagcattttaaaaaattctgtgttataaacaggatccaaagactgtgttcaaattccattttaataatttaaaaattacttatacctagtacacttccagaaataaaaacagcacatttggtaattattttagtttgttaatgtcagtagaatgctcataatttacaaggataaatcattctctccacccccagttctgtttgaatagagtggaatccaaggaaaaaaatgatttctgatatcagaaacagtgttttttcttctattttcttttttctttttttaattatcagaactaattatatatagtgttaaaaactatgcaaagttatctct

SEQ ID NO: 74250 - DNA, 1081 bp, Homo sapiens
gtagctgggattacaggtgcctgccaccatgcccagctaattttgtatttttagtagagaaggggtttcaccatgttggtcaggctggtcttgaactcctgacctcaggtgatctgcctgcctcagccttctaaactgctgggattacaggcaggagccactgtgcccagcccgagttcagcatttaaaagtcgctgatacgtagctatttctggattatgatactggttcctttagaaatttgactctctttttagcagaattattttactagaagtatgttcaacactggctgatactgaagtggcgaaatttatgtttggccagtctgggagagccaaaaattacttgattggatcaggctggtagattgtagcaatgtggcttgtgggtgaggatagtataaagtagttgtggatggcaaagtttggggtgaggaaggaaagaagagtagacattagaagaaaaaaaattcagagcacaaaataaaagtaaaaccacacctccattttagttcagtttgatagaaacggcttgttggtagttgccgagtattattaatgccatcaggaataaaatgtgttagctgtcctagtagtctgggttttggaaattaccagttcgtgagtactgtaaagaaaggagaatttagagtttttcatccatctttgccaaggttccttttacataattctttgatgcaccagccattgtgaaattctccagaattgtgggcaaagttagcctcaggaaaaggagagagagttttgttgaatagtgtagacaaatgccagtgggcaggaagctatgtgggcatatactccccattgtggttaggacaaaggtagtgtgtggaaaatgaatcagttaggacaaagggagtgtggagaaagtaaatataagaggcagtttcttggaatttgattctgatcctagaaatgtgagttagaactgatcagtgtataagagaagtgtacttattcaagggctcttgaacagtaaatattaatacataaatgcactgtacattttgcttataaagcttttgcaatatgataaaattgaaagtgctttttgcttt

SEQ ID NO: 74251 - DNA, 1012 bp, Homo sapiens
taatttttgtatttttagtagagacggggtttcaccattttagtcaggctggtcttgaactcctgatgtcgtgatccgcccacctcagcttcccaaagtgctgggattacaggcgtgagccactgtgtctggccaaaaaatgcttctttaaagtctgtttaaggcctttgagaaggatatattaataaaaatgaatccaatctggttcccgcgcagaatgctgcagtccatgggtgctatgagtcctgggtgctcatagtcatgttacggaaaataagttgatacacaaataacttcacttcagggaagaaaatactgtgagataagatcaatatctttgtaaatgaaagtaagaaggatgatttccatctggggttctacattagagaaaaacctgtagaatatacaacctcctcctttctttcacacgagttttctttccaaacctatttccccatttcccttttatcagtgctgtgcctccacccagcctgactgtgcgctgctcccatgcgtggctggctctgccctcagtgctttcctcactctctctgggtgggtgtgcctggcctcccacccaccgtgtctaactgctgcctgcccttgaaggcacagttcatatgcagcctctgcggggaaagggttctagatccttctgttgagaagtaatttctttccttggactttttgtttcagtttgattggaatgtttttgtttttggaaaaatgatttgtgctttatctgatacattgtttttacttaatatccaggactaaaatgattttttgattttttttgcataactgctgtgtatttgctttagaaagtgtacaataggccaaattcccccaatgtaaaaacacaccaaactttacaagactgataattttttatgctgagtttacgcgaagtgggattggattttatacagtccctgctgtccatgacttgaaaaagatcatgtgggccgggcgcggtggctcatgcctgtaatccctgcactttgggagg

SEQ ID NO: 74252 - DNA, 1032 bp, Homo sapiens
ttttaagatgtaaaacataaggacgaaaaaaatcatcaccttcaagtagtccatgtaaaaataactcaagtcttcaaacattctcagaactaaaaaagaccaaagaaaatattcccatcatactgattatgtttcaattttctagttactaaaaattagaacatggcactaagtagactatataaagtatgtctttaaaaattcaactgtgaaggagatcttttttttttgataatcattaatatgaaagtgaagtttctcttttccctgttataacagttctatgtagtagtagaggtagaattctgaattgaaggtggttaggacttatagcaacatttctgggatgagtttttcagtattcccagacttcaatttaattcagggtttcttttttgctctccacttatgaatatgtgataaatattttatgtagtcgtgtacttttgctatagaaaatcagtggattatttaatttgattcaggaaatctaccctgtatggttatttcgatgttgggtagattttatttcaacttaaaacgtagaaaagatgcttaggcaaatgatctaatagttttagatacatttggtaacttgtatcttaaaccccagggccaagtttagcagtcttacacatgtttagaaaatagttgaaaaatagaaaatttaggtctttttaggtaaactatacaaaacacttttatagtcattttgatgcctgataacttcagggttcattgcccctgtacatttttcaaattatttgcttctcaatccataaggctttaatttaccccctactgacaaatcccaaatgggtttttaagaattttgagagtggtctgctgtagttgtgcttcagcactggcttcaattgctgacacagaatctcttaagatgcaccaaatttagaaggataggaggttcaggcagcatttcctctggcaaatactaagattttatttgcggagggtggggacggagatacagaattactgttttctgtaatatttttctttctttgatcctgt

SEQ ID NO: 74253 - DNA, 1033 bp, Homo sapiens
caatttgggtagaacctgtgaattgcttctctaactaatagaatatggcaaaggtgatgtgatattactcccttaattaggttgcattatatggcaaaagtgatgggatgtcactgcattcaattacattatgtggcaaagtggttgggtgtcactcttgtgattatgtttcattatatagtacttgatcttaacagactagagaacaagattctttttgctggcttgataaagtaagcagccatattaaggaagcctacttggcagtgaatggtgggcagattctaaggatctatgtaaggacagtctctacccaagagctagcaaaaggctggggtccttcatcatgcagctacaaggacataattctgccaactacctgaaagagcttggcagcaaatttctccccatttgagtctccagtgacaatgcagcctggttcactccctgattgcagccttgcaaacccctgagcagtgtatgatgaaattattattattatttccttatgaggtcttgtcctctttacctttttgttttagacatttgtgtgaatttgggtaggggtttggatgtgtcattatgaaccttgatctactcagcctgaatatttctaccagtataattatatatttttttgatgaggaatgttgcctttttgatatcttcaatttggacttgatttattcccaagaatactgatgtgtcactgtccaaattatttctggcttgatgatgaatggtggagtcctcaagggttcaaggaagagaccatcaggagagtgtttgatctggaaattctgtttacacgggagatttttccttatgaaattagtgaatgtagtgtctcctaggaagggaatgtttcttggctaaaggtccaaaggtgaccgttgtgtgctgggacatgggaaatgtgacgggtattatccatatctgtcaactgagtagtttgttgattccgagggagagcttgtggaacaatggcaggaattaaggtaaatatactgccacccatatcaataaaattttt

SEQ ID NO: 74254 - DNA, 1067 bp, Homo sapiens
aaaagttttcttctaggtttattataatccagtcttcatcagccatcactcttcctgtattttgttcaagaggcactaattgttcgcatttggcaggtttaacacttcctgacagagaggctattaaggggaagtattctccaataactgtcactggctggaacaaagaaccttccaactcaatgtgtggaaaccactaacattcttaaatgacccttttcatggattttcatccctttaagctaaagtttggagaatgtagggtcagcgaaaacagcaacgtgtaataaagcagtaaaccttgattttggaaggcatagggtgggagatatagatttatctctgacttgaaaacaattgttatttggaaaatctcattagcagatgtgactgcttggagtaaaaaaaaaaaaaaacaacttaaaactgatgtcgctttcaggacccctttgaacttaacaagcacctatttgtggagcagactggctaatgaaaggaaattaaatttttctgacaacttcccctgccaacctccttattcaggggatgttattaggtactgaagaactttaaagaagatttttttttattagacataagtgaaccagttataaacatccccccccgcccccttctcggaggattctgacatggttgctctacattttaaacgtattagcttaaaagcttaaaaaacactgggcttcacttcagcattttagtcattttctaaaaattcagtcacacttaccagctgtggtttcaaaacaatattgtcagtctttgtggtagtttagtttgtgtcactgaattacacaaacacacacacacacacacacaccccacacatacccacacacacgaaggaggcttagatttcaacattatctttattgttatttggggaaatgattcagcagtgtcctgtgttggatgtgttaggtgagggttaatgatcagtgaaattacttagattcaagggaagtttttgtcttttcatcttcttagaggtagaagtggcattggttaatatttagcaataactaatccttaaatggataaacttt

SEQ ID NO: 74255 - DNA, 1036 bp, Homo sapiens
tcatagaaacagacatgtatgtttttaaaagtgaaatgatacctaatttgggatttactttaaaaacaataaagggtgggcctggtagagaagtgggcaagtagcatagataaagccagagtggctatgtattaataattgctatatattggaggcagcttcatgcaagttttttatactattccataataaagcttttatagcatgtcatctcaatcctgctcatttgagaataattttaatccacaagtagaaaagtagttaatgttttgtttctcagagcctttctttcatagaagcaaaatctgtgaaaatgcaaagtggtttgatgatatttttttcagggtttgttgaagtcattttagcttaacttgcctgcttgaaggtgggtttggtatcttgaagccaaacgtgcaggatttagtggatgtattgctgattcttgttatttgtggcagttatgttctctaaagtcaccttgattactgaattagtgaacactgaataatttcccctaggggaaatacagggttaggttcctgcgagcctttgcttataacattttcctcagtggattaatacataattttgttttttgtgtatttctcatttaatatctgtggttgattcattaacagtgaactcacaatcctggccaacaagactataacacgtgcctgagtaaagcttatcccacacacattttctccagacagtacttcatggccttcttgcacatgggaaccccagacagcacctaaggacaatgcttgatgggccatttcacaccatgaaatgacacacacacacacacaaatgcaaaaaaagtgacactaaacagaccttgaaaaggatgcttgttatagtatgagcattgaaacgagaagggagagcatcaccttgttcagccttagcatactggagtctcaaatttttcacctctctgcacttgttcacaaaggaccatgaaagcgccttaagtattgattttggggttacaaataaatttcagcaagtaggcagatttgtaaatatg

SEQ ID NO: 74256 - DNA, 1050 bp, Homo sapiens
tttacccttccttctccacccttttttgttttataaatgttaaaaaattaactccataaagtgttaaataaagatttagtttttatgcttgtgctaagacatctgttaggaatgacggatagtatccctctaaagttcaatgtctagacctctgctttgtcactgttaatactttatgttggaaataccactttgtttttttcttgaacctttctagatgaactgtatttgtcagtgtgtatgtgctgttaagaaaaattactctagatattacaaataggaagtgatacagtgattgcaaaatctttggaaggatggaggaaggaagggtacccagagtgaacttcggtggtgactcccactgctgtaccactcagccaggctcccagaggaaccggcacctctgccacagtgaggacgttgagaatcaagtggctgcccttggaactgttggctttgggggacataacttccttagttctaaccaaatctcaggaagcgactggcgttgtaaccggtggctttatttccttccttcttcccttttttctttcatttaaattgtgaactatacagaaacatacatagaacacaggtgaataattgaatgtattattataaagcaaaaatcaatgtaaacatcaactgggcctagaagtatttacaaaacagccagctctttttacactagcctcattttcttctccttctcaatgattctgattccccctccatcttccctagagctgtctcctatctgactgacttctcagaaccttcagttttcatatcattcttcctttgaattacgcatacctaagcagcattattacttttgtttgttttttaaaactatattaatgggatcgtatagtattcgttcttttgtgcctggcttcttttttcagcatggcatttgtgagatttgtgctatttcatggaactcctgtatgatacattttctaagaaaatgccactatttctttatctgttagatttctgtagatagtttatttccagttttatggaatttgtgttagtttgctagga

SEQ ID NO: 74257 - DNA, 1051 bp, Homo sapiens
atattttaaactacctaataagatctttatttagtgtcacatttacgaagggttgatgcttattttagtgatgatttgtcattaaaattatgtcaaaatgtcttaaaatgttgttgaaactgtaagcaaactcaacacgcacaaagctaattatgggtgccatctgtttatttttacaaagctttttttttaagactatggcattgtctgcttatgataagcttcaagattattataatgactaagtcctgtccttcaattagtgtagttgaagatgggaagataattcgtttgttcactgaccttttcctgtgtcagagtgtatgaaatatgacatgtcatgataaagaaactattgtgaagtgcatttagaagatacttaatttttatgagaaaaaaatgacatcaaagcagcagatgtggccaaagttttgtttaaattcttagaacttattcaaggttttagatgaacggtagacttttccagtgacttaagtggcttcattttaactcaaggttaagaatttctaagtgatcgaccaagtttatgttgacatgtatccctgtttgtgtacctatatgtcagcacatgtttttgtacatacatatctcatgtgttagtgcagaaggccaggtacatgcatgacagcatcagcccaagtagttatcagcaatctgctgagagagcagagcgatcgcactggctctgttttgcaattgtgcatgctaagcattacccaagtcagtgtggagggaaagcaacctgaaggatccatctgctcccttctgctacactgcctcgatgcaagattacactaatctggctgcttgtcaggacaggttagtgaaagcatgcaagtgggtgagacttagggtggactagtgctttggaaaatcataagctgcccctgtagatgccacgttaagtgcagcagaataggttgattatcggccacattgaagattgccgtgaaataaatatatagctttttggttaagaattagtttcaaaattaaaattcttaaatattgttggaccacagataaatca

SEQ ID NO: 74258 - DNA, 1085 bp, Homo sapiens
actatcgcttgtcttctgatgtcaccgtataataaagccatcattataccctcatgtggatatcctagacaagaggttctacatgtggtcccttgataattgcctaaattaaaatattaaaggcctaacagccgctgtgttgacctttttctgccttgctgcagacagatgagctgctgtttattaggaaggcttcttcccacaggtggaaggctacgtgagcttccgctcttctcttcccacccctttacaatgttgggcatcaaagtcctgctgttccagcagctttgattcagttcctccatcctcaagacccctaggatgtgcctgacagtctgaagtattttgattagcttttaaatacttcagattccaaaacttctttctaataatttaataaatgttctgtcctcagtaactgctcatttttaaagttttgcatggctaacctccgtgccttgctgctggtatcaaactgggaaatgaaaacaagaatcagtgatgtactaactcactcgttggctggttaacagcaatcagcctcttcaaaagaatattttgaacttgtgctatccccctaccccccaccccaagaaaatcacaaaatcagaactctaattggggctttacaaagcaaagccataggaaaagctgtgtaaacatgaaagcctcaggggagcaacagtaacagaaaaatagtgttttacagttgagagggtgaggcagaaaaggaaagtgttacagacatgaaaggcccaggcccacattcctatggagctgaggaccaggcttgacgaggggcctcactggtgggctcagaagggtctggcagggagtgcagttagcaagggcatcgtccatgccatgcttcagctggaagacaccatcagagagccacagcatcctggcatagtgatgtaggaagtcttcattttttattttttatttttgctgttttttagtttcgtcattcagtggcagaacaaaaaatgtgttgcattacatattaacggatcaagattttagattgttttcctattttccagaagttgaaatgttatttgagattgaaattctctatccat

SEQ ID NO: 74259 - DNA, 1025 bp, Homo sapiens
ttatttcaaaataattttgaatttttttattttgaaataatttcaaaatttaaaaaatttaaaatttaatttcaaaataaaaagttaaaaaaatagggaagagcaagaacccccactctccactaatatttaaagaataaaagcagagatgcatttgggattttgaacttacatattactcatctggctaattctgaaggataggcaggtttaaaaacttgctttatgaaaggcagaaaagggaagacaatctactgtcttgtttggtaactgcttaattattcaaatatgaatatttttttcctgtgctgattgtgaacttttgttaagatagagaaactttgaagcaaaaatgtaattcggttaaaatgaatttcaaaatcctcatgaaataagagtgcttttggcctctgtttgatcctggcagcatgtctagctgatgtctgggcagtgttttggaaccagcaggcagtcaggggaaggccactcctaggggcctcttctctgtggcctggtggtgatttcccatacagatgggacctggtgaactctgccagaggtcatccttgactcccagtccacacctcccagtcataatttttatgagtatgtgattaataatatccttgaagttgtaaactaactctcaaagaatacctctactgtccccataccatttaaacaaggatctgttcaaatagtgttgtctttcctgggatgtgaaaagaaagaaactaaatgcaaaatggtaactttcaaatctgtatgatactgtttagtgcttcagtgattcttcccatctagctgatcttttgagctcttaggtataaaatacttttctgattattaccctcttttggctttaggattaattaatggacagtagtttcgggaacagttagtcgaggcatagatgtttgttgtctgccatgagccattatctcaccatattggccttaggaaagaaaaagagataacgatttagttttgcatagtcatatataatattttatttagaaaacatt

SEQ ID NO: 74260 - DNA, 1030 bp, Homo sapiens
ccctagcacaaaacatagtaggtactaagtatttgttgaattaatgaaaaaaaaaaaatcttagccataatattgatgagaaaggattactttggatttttttttttttttttttttttgagacagagttttgctcttttgcccaggctggagtgtagtggcacagtcttggcttactgcaactctgccttccggtttcaagcgattctcctgccgcagcgtcccaagtagttgggattacaggcatgtgccactacccccagctaatttttatatttttagtagaaacggggtttcaccatgttggccaggcttgaactcgaactcttgacctcgtgatctgcccgcctcggcctcccaaagcgctgggattacaggcgtgagctaccgtacctggccgctactttggatatttttaatcatttatacatgtatccagataaccagttcattctattttgatcctaacatttagtttcttgtccttcctaaaattttaattaaaagttgtagtacgttttgaagtggacttaggacttccatgtttttatgtctgcctggcaattcagtgatggtgataagataggaaacagtgggcagaaggagaaaacagggaaaaactacagagaacctttagaacaaacattatatgcatgtatgggtatttatatatatatacacacacacaaatacacatttatatataagtttgtctatatgtatgtatggtgaagtatcccagagaagaagaaaatggggcatttaaattttctaatcagagttgattagtatgtgctggacgtttagcaacaatagagaatatcccaaattctgtagagaagggatccccttcaaactcagaaatgtacttaaacctagatattgcagttttctgtgatgcatataatatattacatttctttttttgtaaggaattaacagcttggacaccacaattttgttttttatgcttagaccaatttttaaaattggcatacattgcttttagcaattatttagttgcagcctt

SEQ ID NO: 74261 - DNA, 1048 bp, Homo sapiens
atttttattttgatcctactataagagctgagggaaaggcagaatagcctgattattgctggagaatttctctgttccctaccatgattccagaagctcttgcacacttcatcagtattattgtaattctttggctgcaggatatttggcagctgttgcaccccactggcaaatcctattcatacttctttcccattcaccattgccattggagaattgatttctctctcctctactctaacctttcccaattcattttggattgttcaatgtgaaacattttaatttcatatcatacagctattcagcttacaatcccttttttaacctgtcaccagggtaacagcatagcatgctttctttaggcaatcaagtttttatttcacatgcttaatgttgcattaaatgtttgcattttgtttaacccccttaaatagtttgaactctggatatgttttatagggtaatgaaatccttgatttttgaattgaaactaaatcaacaccatcagtgcatttataataaaatgtcaaaagattaatttccataatacaaagattattattaaaaacgcaagttagctgatctgtgtaaggcaattttctgtaggtaatggaggaatatttgtatatattatatttgtgttcagccttgttccaaaaaaagatttaaaagtggtttagagattgtcagtgagataagtaaaaaacttaaaaaaggaatagatttggtgcaaatgggaaaatatatcttttgaacccattatttgatttttcagtataatgcttttttctctgttcgtatatatgaagatttgattacttgatttttcagtataatgcttttttctctgtttgtatatatgaagatgtgattacttgatttttcagtataatgcttttttctatatttgtatatatgaagaccataatgatttatgcatgtggagatgggtgaagtaacgagatgtactagaatgagattagacatcttttctaggagaccagtgtgggcattgtgtgctttaatatctcttcatcagtttact

SEQ ID NO: 74262 - DNA, 1006 bp, Homo sapiens
gggagcaacagagtgaagagttccatatgtgaattcaggttctctcaaattgttggttgaccctggaaatgtgcgtaacaaagaccccagggatcccagaagatcccagaactgctggaatgctgaatgaactgagctaaaatttcagttgcctaccatggttatgataatgttggaatctgaatctcatcaatttgaggtacttgtaaacaccttgagctttccattaaaaccctggaaggaccatgccttgggagaaaagactgtttctggaataaatggtttggactttttatttattgagagcaaaaccaaatagttcctagtacaacataaaagtgagcctccacaacttcaggactggtaactagcaatgtaactgcctgctgtaataaaaatcagtacttttcagagggagataacatgatgagtgaagtctgacaacatctccacaatacagtttacttggcatgcaatctaagaataaagacaactataatccagaggaaaagcagtcaacagaaatcaaccgtgagattactaaaatgtttgtttcatgggcaagagctttaaagtagctattaaaatcattttcaagtattaaagatgaaaatgagggaaaaatgggaactatcagcatagaaatggaaattaaaacacactactaagtggaaattccatatctaaaatgtcctatatctgcaatggataatttgctggataggctgaaaagcatactggtgatggcagaagaaggaataggtaaccttgaagatagaagaatagagattatgcaatctgaaaaaagagaaagaaaaatgtgtttaaaaaattgaagagacacaaaaggacaaaggaaacttttggaggtaaaacatgtttattaccttgattgtggtgataatgtaatgaccgtatgcatatgtccaaactaatcaacttgtgtgcattaaacatgctgttttttaaaatgtcaaatacacctcactaaaggtgtttagccgag

SEQ ID NO: 74263 - DNA, 1028 bp, Homo sapiens
agaataatgcagatcaagaagtggtaggtcaaatacaaatatgtatttaaattaataatattaatcagatattgaatctagaggtgattggattagaagcatagtttttgtgactctgatttttttaatgctgaatacacagagacttcttttgaaaatttggtgggtttaaatgaaaacataacttggaacattttttcagaactgtggtttaagctggagcccagatactacaaaatgctgatgtttagtacttggtaaatattacttcacaagtataaatatgcaatacctaaattaggttaattctgaaatcattaaattttgttactttaaaaagtcgtgggaaacatttatattctaaaaacacttttgtctttggctgcttgatacggattttctgaaccatgtaatactgataatatgcaagaaaagacccgtatgataagactaacattgttcatagatatggagtcctttctggggggttttaggtgatggggaaaaccagggctagaaaagaaataatgtgtaagtttccaagatgaggactgtgttttatttctctgtggtgccccacaatttagagccaagtgcttagtgtttgttgaactcataagtcatttagggttttgtgtgtgtgtgtgtgtgtgaatgtgctttattttagcaaaatttagatgttgtcctattatataataacataataagtgggtatctgagtaatgtttaaattcgttttttaaatttcgtgaatttttagtaataacattataaaataagtatagttttttttttgtttttttttttttgcaaaaaataattatatcggccaggcgcggtggctcatgcctgtaatcccagcactttgggaagccgaggcgggtggatcatgaggtcaggagttcaagaccagcctgaccaaaatagtgaaaccccatctctactaaaaatactaaaaattagccgcgtgtggtggtgggcgcctgtaatcccagcctctcgggaggctgaggcagaagaatcac

SEQ ID NO: 74264 - DNA, 1012 bp, Homo sapiens
atttttataggaacatgataagaatcatgtggttcttttaaagagttaattttggaacatcttttgttcaaaaaatagaacattattatatgtattcttttgcctctattgtcagtttttaggataggcttttaatcttgaacatgaaaaggacatcagtaaacaaggtgagttaactattacatttatgcctattataggcttttagtttaaaaattacctatggcttaaatacagagaaggcagacagaaaaagaacctttttttccctgagcattttaaagagaatactacagtaccattaggggtttataataaaggactataattctatttagaaaactgacttacagtacatgacaaatgatagaaaattgaggtaagttttttgaagtcatattttatatttattttttatttttcattaatttgtcttttgccagaattaaatgttatgatcattaaactacttctcttcttaggtaattttttcacttagtctttctacccctctacctttaaaaagtatactgaacaaagcagcaaaagatattctctttgaggaaaataccttattttctgtgaatagttttttaaaattaaaacataatgcataaacatagaaattcttttacattggcaagaactttttccttgataaaattatttttccatttgaaaaattattaggataataagtcaagataatgcttaaaaatgtaaaaattttctgcaaagaatgtaaaactgtcgtaagtgaagccaacaggtaagccaaaaaaccagagagaaaatttgcagttcattttagtcacaaaataagggatgcccttcatatatgcagaactcttacaaatcaatatgaaaatgaacaaaagccctggtaaaaaaatattcagagacagtttacagcaaaggacatgtggctcctgcacatatgataaaaagtgctaaaagccacacacacattcaagtgaaaatcatgatgagatacgattttccatgcacattt

SEQ ID NO: 74265 - DNA, 1071 bp, Homo sapiens
ccatctcctgacgtcgtgatccacccgcctcggcttcccaaggtgctgggattacaggcgtgagccaccgcgcccagccctgtgtgctgctttatcaagtgacagaggcaaacgacattcattggcataaaaaagaatgtgtgtgtttgtgcttgtgatatccacagaatatctttggaaggagccacaagaaactgggacccatggttgcctgtgagttggggagctggagggctgactccataacaagtgagaaggatacatctcttagatcatatctttttagtattttttgaattttgaaccctacatgtgtattacctattttttttaaaaaacatttcaaaattgtgcagtggaagggtctgtaagatggagcagtgttgaaataatggagccttaattacctttcaagaaacttctgcagtgacttggccatccggggaagcaatcagaaaagcagctggctcattaaatggagagtgctggtcccacaggtgtaagtacacaaaacgcaatcactgaaattctttggctagcacttccaactcggagacagttgctggagatcacttaataggctctggttacaggttgatctaatctgaattaagaaattggaaaaagcaaagaaagagcagtaacataggtcagagtaaggaagctgagtccgaacagttcctccacagcctcctgtttccccttctgtaggtgtatgaactacccagagagattactgtgaatgtagaatagttggagagatgtgtttcccaatagcaaaaggcagtgtaaaggtagttcactccaaaagttttgcttagggttccagagctcatagtaatttcactcgtcctaagacatcacaaggctattttagagaacagtatgtttttccttactcttggttcaagcaagaacatccaaaagtaacctgatgtaccaatgtgactccttatcccaagctaaagaatatcctttcaaggcaaattcatccaaatcagcttgacatctgatgggagggggttggataaacaaggttgtagagaaatcaagtctgaagagtaaccttgc

SEQ ID NO: 74266 - DNA, 1065 bp, Homo sapiens
tcaccatgttggccaggatagtcttgatttcttgaccttatgaaccaccacacccagcctctgttccatttttatatgaaaggacaaaggagcgggtggagatgaagggagagttggtgacttattcacctgtgatggctgctgtgggggaagaggtgaggtgagactgggaggagttgattatggcattagaaattggaagtacgtggaatgttgttgaggctgggagcaagaattgacttaaacacaacagaagggctaggctaaccaagcttccatttgaagtcgtggagcaggagttgatggggtatcaatccatgtggtcagatagtgcaaggcagctctgcatgtccaggaggccaggacacagggaggctaggcggagaggtgccagtgagggaggtggagataggcagatcctgaagggcctttaaactatgggtttcgattttattgtgacattattcattatctagccagcttttataggagcagtttataaagtatgttctagggaatactattgatcaacacgtttttcaaaagtctaaattgtgttcaaattggtgtcttgtgagaattaatagaatacatatttagatcactttcataaataaatacattaacatcatattttcagtaagctcatatttgatatctaatcaaattcttttagtcatgaatttgaatgagaggttttttgggttattgttactgtttgttttgtcttctgtgtttttatatttggaagcagaattagcttttggtctcttaagtgaccccttagtcacttaagatggtgttcatttccatcattgtgcttatcatgcacttgagttctcgtgtttatttctttgtccacttgtttaatttcagcctcttcacactaaaataggagctttgtaaaggcaaggacctagtcttgttcactgtcacacttcttgtacttctcaggaaatattcattgggggcagggtagaggagttggggaaggaaggaaggaaggaagagagagaacagtgaagcgggaaggaaggagttccaaaaactgcttccctagtggtc

SEQ ID NO: 74267 - DNA, 1094 bp, Homo sapiens
gtcagaggtctgtggaatggatctctgtcagactatcacagcagctgtgtgtttgcagattttgcttatgagaggcatgaactgaaaataggcgtaaacttgagtaattccctaaacccaaaatataagatagaaaccagtaactgaatctggtaacagggtagttgtttgtttcagaagcttatattaaccacaaaaacaaagtgaatcaactaacaagggttaccatgacccaaatagtaattgcattttgattcactttgcctacagtgcacaggtcaggtctgcttctcaataaatatgttgaaagaatgaaatatatccttcatagtaaaattatgttttttaaaaaatatgtcctactactaatattttttaaattatccctaaaccttcacatttcattagaatagctacttcaatttactctgaaaaaactgctttcttgtctttccagtttgtgtgtccagggtctgacgtgctccatcatcaaggcagcttttatcttctgtgtccgtgattctaattacatttcagggggttgtgatctctcccagaatcccgttcatgcattgtgtttaggatgaaatgcttgagggggtttggggctgtacactcatgggcacaggtttgcatatctaaaactttctttgctctaacatcctgatttgtataaaaatcctaaaagcaaatttcagacttctaattattctttgcctttaaggaaagacaaaattaatttagactgttcaagcttaaaattatcccaaagccacagatcacactgaaaacacatagtaatatagcccacaaattattttggtgtcttgtttccatattccatccaagagtctgtagaatctgtaggcttatatttctgtcttgtttcttagccataactgatcttttccatcttattcaccagactcagcactgcgtaactgtggcaatttctgaaactcagtggcaagggatataccaccattgaagagattaaaaataatcaacaaaggctttaaaaagtttaaaaaatgtatttggagcaataatagcaataggtcagaaaaagttttcacggaaagggccaatataca

SEQ ID NO: 74268 - DNA, 1057 bp, Homo sapiens
tttaaaagaagctaaagtagcttttactttgcaagcagttcttttccattgtatgaaaaattcttggaaagttttaaaaataagacaaaagggagccacagtggcccaggcctgtggtcctggcacataagcagccgaggctaggcgttcgaggttagcctgggcaatatagaaacctcttatctatataataaaaataagacaaaaaataaaatgtgccaacatatattagcaaggtttgtcagtactgattaatatttttacattctaatattctttgttagaattgtatttattttatgaagccccttttgaatctacagcagactacctgggaagtagttatagaggtcatcatcgtgtcttggtgattcactttgggaaattttgttgagtgaggctggtgaacctagaaagctgcttcttctgcctccccatttctgtccccaaggccctgctgtggttcaaaagcccatataaacctgcagtttccctttcttccacgatagggcgcgcacctacactgttagggtatggggccgactggctcctgccctgtgggaggtttgatccttgtccatttagaggcccttccttattcatggacactctactgagtgtctgttgcaaactccctggtataaaccccagacgtcatggatttaccacactaattattagagtggccattatttgcaataaaatagtgacccttgccactgtgttttcctaccaaataaacttactgacaagtatctgcattggctgggtcgaggtgtcatcaaatcagcctaggtttggatgtgctgttttgctagctgtagacccttgagcaattatgtaacttctctgagtgtcagatttgtcatctataaaatgtggttagtaacgtctccattgtaggatcgttcctaggattctgtgagtgtgatgtatattaaaatacctgattgatattagggcctcagtcatgttcctttctttgctttagactcatttctctgaaaaagtaatacgatgtttatagttggggaaaaaaacccaaagagcgttcata

SEQ ID NO: 74269 - DNA, 1127 bp, Homo sapiens
tccagcctagtttggaggtgttgagattaatacagtaatgattgtaatataaggcttactctgataagtacattgagatataaagtgttacagagattcagagcaaggaaagacccagccctatttagcagtgggcaaggggtggtatgggtgggtggtattggtaggggcaggggggatgaggcagaaaatcaagagcaaactgaacaaaatgaatagaataggtgtcaggtcatggaagatggatggtagaattctgttaggctgaattggctagtccaaatttaaaaaatagtaggactaaagtttaggatatagtgcctgtgcacatttgctgaatgtaagagaaagtgggaagaaaaattgaaatgatagttagattgtgaccattagtacagaagacccagaggaccatgtggagaacttaattttttttttttttttaattaagcaaccagaagccaagaaggattttgaactgagaaaacttgtaagacacagtaaagccacatttgtaactggtctatcgaagtgaatacaactgtagcaggttggagatggggctttgggaaggttttcttgtttgatgggattgtcagtagtaaaagaaatgggaaggaaaagagttcacattcagcttagaagttgagaacaaaatttggggagatagatgagagagatgtcaggtaatagttgggggttgggaagggccaaacaaacaacactcagttattggcatgtgtgttaggccgtttctcacactgctgtaaagacatacctgagactgagtaatttataagaaaagaggttttagttggcacatggttctgcaggctgtgtaggaagcatagcagcatctgcttctggggaggtctcagggagcttccaatcacggtggaaggccaaagaggagcaggtgcatcacatggtgagaaccacagtgagcgggggtggggatgtgccacacacttttaaatgaccagatttcactaaggagatggcccaagtcattcatgaggaatccacccccattgttgcaggactttttcttggtttagctaaggatggggttctttgtcccatggccatgaaaattcaggcccacagacaatttgaatggtgagtaa

SEQ ID NO: 74270 - DNA, 1044 bp, Homo sapiens
attatgtgtaattcctcttgatgtttttgtcattattacatatatatttgggagagaaataaaaggctgtttccaaggtgatggtgataaagagcaaacttataaaaatggttgcctccttttgtttgtataaaacaaccatctcatttccctctgggaggtcactagaggtatgatagctctgttttgaaataatattttagtaaataggaaagcagggtaaagaaagcctcccctttttgtgttatgttaaggtttaaaactgtgttacagtttatactaaaacattaagaatcaattattataagagcattaaattgtttgagttttgtcatgctttgcctagaaatcagcactgaagcgagtgacttagcaacgttattagatctattaaataattggaaatttatgtgcttattgtcagcatcttggctttttagaattttaaagtatgtttgtgcttcacatctctagttgcagtttatgtagaatttagtgaactataataacgttggatggtggtaatgtcacagtgtaattaactgcatagcatacaaagttctttgttaatggggaatgggatatacatcatctatttgatatataagttaataatcatactttttgttagcagtagttaaatgataagaactaaaaagaagcaataaacatctccatctctaaaacagtcttgcaaatatgcagtgagcatctactgtatacaagcactatatcttcatatttagattacatttgctattttgcttttcacatgtgaacttaagtgaaatactctaaggagtattgcaaggtaattgcccctataaattacataatttatatggctctttaacttttttagatgtaaaatgggaggaggagagcgttgagttggagtgtattatttctaggattctttctagcccacaagtcgaatcagaaaacagtggctcatgcctgtaatctcagcactttggaaggctcaggtgagaggattgcttgaggccaggagatcgagaccagcctgggcacatagtgagacca

SEQ ID NO: 74271 - DNA, 1034 bp, Homo sapiens
cagtctgcctgagagatgcagtggccggggtttggtctaagatgttattggtggagacggagagaatttgcggtatttgagagccactccagcctccattatttctaattctatgtcctctacccttctctgtcatctctccactgcctcccagccccttccactgtgccccctgtattgcccactttcagaccaacagccttttgtatcagccttttctggaatgttccactaattacttaccctaactaaaaccttagggtagttttgttctcataccacacgcacctccaagacaggaggtgggattactttcctccttgtgtcattcaggacgactgctccgctctttcttgtaagccctttcttttttgaaatcacatcatcagtcttcactacctcatcttcctcttggcaaccttcagctccccttccctgtatccctctccctgcacgtgaagaccagcagccagttcctggtctgtctgtctgtctccatacaatcattattccctgtattttctctccatccacagacaccactcctgtttttacatcctttatccaatccctggcctggcattatagtcactcactcatgaatacccttaactgctcactccttcattcttccatcagtctcaaacttagaggaactctgcctccaccttccctatgcctgcgcatgagcaccttaccatggctggtgaacgtcccataccaagggcacagttaacatgcgtctgctggtcagggccagctgagcatcctacactgggcagaagggttgctgtttctctgataacttctcctcccttatcctcagtgattccttcctgtcttcaccactgtattcacatgtcccacgctcctgctgcagctgacactacttctgaatgtccctcttctctataccaccagggctctagatctgatcaccatgacttttagttttatttcctctaattcattgtccaagctatagcctgcatgatctttcaaaaatggacagtgtggctcacacctgtaatcgc

SEQ ID NO: 74272 - DNA, 1093 bp, Homo sapiens
gaaattacgtagtgttaggctagtaaaacttgtgttattcaggttgactttccacagctcactgatgtcctttaaaaatttagtaatcttaacttattaatctttcttttcgcctcaatataaaatgtcctgccttgaggagatgccttggaacccagagtcgatagaacattttttgtaacctgtgacttccattttaaagtagaaagttatgaaaagagattctgccaaaattcttcaccttacctcatatttgaggtttagcgttttaggaaaaaaaaaaaaatcatggaacatgtggctatcacaggctaataaaaatctagccccacccatagcattaaatgctcattctttgttcttttttatgaaaatcatcttaacttgattttacacaggaaactggttttaaaaaccttgagaaatcaggataatcacagattaagactacttactccatacctgattcttatctacctctatgagagaccgggatagtggacatcagaatccacaaaaactatgtgatgactgaactgatttctaagtcagtttcaattgatatattatctctatggttccaagtaaccttgaactcttggtaataagccctatattttgactttggttttgtgacttgtcccagtatattttttctcatttttttaattttctaactcctgtcttttctcatattttataacttaactcatattatataactttatataatattatatcagtataaattatgagttgaaatagtttaagactcttgaaaaaaatatcactacataatttcacattacttagatccatgtattattatgtctttaaaaactgtggtgtctgggcacggtggctcacgcctgtaatcccagcactttgggaggccaaggcaggcggatcacctgaggtgaagcgttccagaccagcctggccaaagacagtgaaaccctgtctccactacaaatacaaaaattagccgggtgtggtggcgggcgcctgtattcctagctacttgggaggccagggcaggagaatcacttgaatctgggaagcagaggttgcagtgagccaggatcacgccatt

SEQ ID NO: 74273 - DNA, 1853 bp, Homo sapiens
gttactttcatcatccttttcagtgagtgcgcagatagttgtcttgatggcacttttacatgtagaatttatagctagattaatagggatacatatgtagaataatcaaaaatattttccctagtgtagggatcatgttcggtaaatccctttttaatcctgtaagtactttgctactaaaagaattaatgtgtctgaaataagtgaccccttaaagagagatcccttgactcttaggaagaggtcgttgcatcaagttaagtactctctaattggaaggaaataaactcagagaggtaaatggtgtactaggaaaaacagtcgtttacctaaaaaaaaaaaaaaggtaaggagagtttttccttgtgaaaggggatggattttatttactttctgtaggcattagcattatatcgactctttccaaaaatgtaatgtggcccctatgaagataataacaattgtagtaataataaataacacacagtgcttactgtgttatcaggtgtagttttaagcatagtacagatatgaacttctttgatcttcacaattgtatgaagtaggtgctatttatagttttataaatgagacaactgaggctcagagaaaagtaagtgacttactcaaggtcaccagctagtaagaggtaaagccatgattttttttttttctttttaaatgagacaggatctcgctctgtcacctaggctagagtgcaatggcacaatctgggttcaccgcagctttgacctcccaggctccagcgatcctcccacctgagccccccaggtagctgggactacaggtgtgcctgccaccacacccagctaattttgtttattttgtagagatgaggcctcactatgttgcccaggctggtttggaactcctgggctcaagcaaccctgcctcctccccgaccccccctaccccccacccccacccccaccccccccacaccctcagcctagatccatgatttaaatccgagcagtcttgctgtaggtaggatccttgccatcaagcattgcaggatgctgaggcaagctatgtaacttcctgggcatcacaaagctaggaagaagcagagcaaaaacttggtccgtggcagtcatgtgtgctttcccccactatgctatagtactttgcgatttttcctatcacattcttcttcaaattataattacctgtcattcatgctttaaaccagagatgcttaaactttaatatgcttcagaatcaactagaagccttgtggaaactcaagttgttggacccacccatagcttactctgatttagcaggtctgggctaggtctgcatttctggcaagcccccaggtaatgctgctggtctgggccacatttggacaccctctgctttaaacctttgtagtcagagaatgagctgaggagtggtgtgccccagcaaggtgggtaggaaccgagtcacatgagccttattaaggacataggagaggctctactttatccctaggtcagtagggacccgtggaagagctttcagtaaggaagtgatgattgaacagaattgtagcttacgaggtttttttggtttttggctgctttgtggagagtggcttgaagaagcatgaggtgaagattggaggcaaagagagaagtcagcagatgttagggattcggaggtaagaagtctcagcagctgtggggatgagggcactgtgtgcagaagggatctgcaagcgtgacaggagaaagaactggtggctttacagtcatctgctgatttctcttctgaccactgttagcatgggcaaacctccaaattctattcctgactcccccttttctctctctgcttgcttcctg

SEQ ID NO: 74274 - DNA, 1043 bp, Homo sapiens
aaataaaaaaaaaaaaaaaagaaaaaaggaaaaagaaaagattgatgtaaagaaaaacagaaataaaatttcactcagaactggaatttatttcaatcttccctagcagtaagatatacttttcctagagcctaggattaagataattcagttttagaatccacaaaaaacaaagtattcaatgcctatcatgagtctaatgcatgccaaaacaaatatgaactgaccacttgatatgctaatagcaaaattcttcataaaaattaagacttgtatttgatgaaacatatccacgcttattaaaatattttctgcaaatatttcatcccttttcctattttaaatggcactccaaagccagataaaaatgttctccttttcttattttgatagtctgctccaatgtttacataatatattcctttttatttctttaaaaaatactttagaagattttgttaacaaaatgacttcaacatttgttagaatcaaattcatacaaaattagcaaagttattcacacaaaggcaaaaacatttgcaaaacaataaatcaaatgttccaaaaataccttcctaggataataaaaccagaggtaatttcacctttaaaaataatgtcactgaacagtaagaggaagaaatagtaatagttttctttttcccctcactgatttccaacttggtaatatgttttaaaggccattactgtgggatttgtcttatcggtctgcagtgcagctgtttgtattattttccacatttactacaatcagtgtttatactactcaaaattctcttcctcaggcagcaacgaaaatataattttctagttaacagaagaggagaaaagcttgtatgtgtgggggtgtgggaaggggaagttcagaaagacattttcccattcggttaaattttaaaagcaactccaaattataaaacccagaaaactgctaagcttctaggactacattacaaaagcaggtagccttgcatcaaaattaatactttataccatagctgtaaatacatcccagctgttaa

SEQ ID NO: 74275 - DNA, 1020 bp, Homo sapiens
gcgaagaaaataaactttacccgtcctgatactggatttgctttaggaacatgtttagcgaatagctgtttggaagtgtgtaaggggtactttttctttatcttcctcatattggatcatgaaccaggtctaccatggacagccattcatggaatttagggcaaagtctagtttgtgtgattgcattgtgttcatttgggttctttttaccatttgagtagatgtactgttactgcttaccaaagacacattttgggtatacagtgcgtgtgcagctcaataccttattctagaagctgctgctcttcattttgtcttcagttttgtaaaagccccgtaatcctgctggtgagacatattagagtgtgataagcatcacttcacagtgacatctgtgaagttcttctgttctttttgcagctactatttaattgtttggctatttaatattttgtggcgcttccccccttgtgcaaggaagtatatggcaggatgcctgacaagacacgtaggaagccacacagtagtcagcatctcaagtgtgtgttcctgagaaatagccttcccaagccggcatatgttttgtatggtgtaaattctcaagattgtgaggggaacagctaaggtaattcctaaggtatccgtgttaattacctaaggtaattaccaagcatcagggaacatagcaacactgcaaagtcaaagtaccctcgtttgaaatagaatctctacctgatttaggggttagggaaagaattagtggataggttctaacaattacccttctgaggtcacgagtttgagaccagcctggccaacatggtgaaaccccatctctactaaaaatacaaaaattagctgggtgtggtggtttgtgcctgtagttccagctacttgggaggctgaggcaggagaattgcatgaacccaggaggcgggggttgcagtgagctgagattgcgccactgcactccagcctgggcgatagagggacagtccgtctcaaaaaacaaaacaaaac

SEQ ID NO: 74276 - DNA, 1139 bp, Homo sapiens
cttagtttgcatacccatggaagtttgtgatccatttactcattcatttatccaagtatttgataggtacatattttgtggtggacaacattccaggtattgtggaaatggaccaatttcaataggacagaaatctgaatcacaaataagcatccagtggcaaccagctggtgtacacactgcacctaaatacaaattcataggtatcaaaatcaccttcatgtgtcacacagtcacctttcttagttcctcatagcaaaactgggggactctgaggtcagtccccagagtacctggttgaggggtggggcagggcagttgaataagggagtagaatgaatgaaaactttagactctgaagctcgtcactttattctgccatattttagttttgtggtattaaatctctacagaaattaattatcttgcttcctttcttgaattccttttcaaatgttatagttactacttcagtaattctatcccatctgtttatatacaaaaggtaatttaccgggtaatgaccgagggcacctgctttaaagtcaagtgcatactaatttactggctatttgcttggcctcatttacgctctctcggcacagtttctgggtctgtaaaatgagagtgattgtaccatctacctcattggcgacagtgagaattaaatgagttggtgcatgcataacacttagtacagttcctggcacaatgttaccactcaataactagcagtgtggaaatatttcacacctaagagtaaagttttatttacctttaggagacaggatcctgggaactttctggttgccatagctgcttcctcaaggcaactaagttagatgtggagtttctaattcctgttggaaattcagtgaataagaaaatactactgaaagttatactattttctgcatgttaatgatttgatattatacagctttaagttctcagtgctcattcgggtagtgcaggtgagagacggcggctttaggggcaaggcagtgaccctgtggatgatgggaagagagttgttaagaaataattgtttaaatcatccagagagtactgtagcaaggattgttcctaaaaagaactgtggtaatccttgttgaatagcaagtttggacagtatacgg

SEQ ID NO: 74277 - DNA, 1063 bp, Homo sapiens
cttgatcttgctgtctcaagagcagcggagtcataagaaaatgcacatttaagtggccccatgcagttcaaatccatgttgctcaaggctcaactgtacaccgaactgaaaaatgattccatttttagtaggaaatggcctactctaagtcctactgcttccctttgcacttgatggcaagggtctttaactgtgtcagtggagctggtttggctccactgatagagactccctgaccatctgataggccacttttgttagaggagaaggtacccccttgcctacctgttcttttcttacttcatgggtcttgattcctgactcaggagcacccattacagaaaagccctgggactagatctaattttatttaatgaaaaacctatggagcatttactcttgcttctaataaattaacaagtcagggctttcttctgaataggagggtctcttgactctttgatatttgacttttgaaccagactagatgaggcagagcttcagcacatattttaccagtgtcttcagcaaatgcctttctctttgcaaagctccatattactaccaaaaattaacccaactaaattgtaatttctactcacccacatttattgagtactgtgtttccttgaaagatctcaaacaaggcaccttcttgcaagatcttcaccaccagaccttcatgatagtcacctcctcattaggctgagacgcatacacagtgattacgttcagacacagggactcctgtgtcttaagaccttgtgtgacccttgtaattaaagcattacactttgcaaaggctgacagtggtataggggctgtctgaaactattcagccatagcctggtctctgctttctttttacaaatgggaggttggctaaggcagacacagggatggctaagagggataaaggacgtgacttccatagaaccttttgttcctagaggaacctctccatgaaacacacagtgaaactagattaaaccaaaaaacgccctcagctccagcagatcctgagctacaaagcacctcttccctaccgagccttctcacccat

SEQ ID NO: 74278 - DNA, 1035 bp, Homo sapiens
ttggcgtactccatatccctgaaggttaacaagagataaatttggcctagactggtcttttcctgaattcatcacttaaaaaaggaaaaaaagaatggggaggaaaagccacgttttacttttataatttttattccatcattaaaagtacaacttgctttatgatctgaagaaataccatctaagtctttctattaggaacaaaagtgagcctttcagggaaaaaaaaaaaaggagctgggcttaatctgcattagccctttgatgtattcccagattttaaaaagcttcccactgttctcagccacgttgaaacagacccagccatgtgtccggcgctgtccttttctcctctcagcacacacttagccggagacaccttttggccaatgggccaggattcttccattgcatcttcagcatgtgaccgtttgtgctggctcattgggagttctgctgctcagtactccttccccaggcaaagactcttaagttaataattggttcagaagaataaactataccgccctcttggtcttcttttggacatttctttaagatgaggctcttactggtatatctggggtactttattgagaaatagaaagtgctagctgaaataaggcgtatcagtctagagttaggaagtgagaaatgcaatcggtaaattttgcttttaaataaaaatggaagccccattttaattgttgccatttctagtcattttatcatttttaacagcctggttttctattttagagaagttgctgaccaatatttagagagcacctccctaatctgcacatcctcttgtgtgtgatggtgaagtgatgggttggaatcgtttttaatgctgtttccattgatgggacattattaccagaaggagtgctttgtgccagctggtttcatggatggaggaaaacaatctgggtttcagtttcacaaatagaaaaacaaaacctgagaggaaaaggaagtaattcgttagcagtggccactgtgcagagtaggataacctgccttcaaagattt

SEQ ID NO: 74279 - DNA, 1089 bp, Homo sapiens
ttctctgcctggaattgaaataagtgtttgtcctaattcatatgctatctgatgtgaagtgggcctgctttgtaccgcactacaccattaatctaattatagatagctgcaaatgaagtgctgtctgagctgggagattgaagaaaatagccttttgtcatttagcatgactctgtgaagcaagatcacactttacagggcaatactacaaaatggaaatctcaataatattgctgcctgttgcatcttttctaattacaacaatattgtaaacacaactgggcgctgatataaatagagctgtagatatgctgtcatgtgggttgtaggagaaagtcctccgagtgctgttggattaaatgatgcatcctgattgacagctaccttgagactgcactgatggagttgtcacagcattatgctaacaggctgctccagcgactgcagctgtaggaggctgtggttcgccctgcgccttagctgctgcctgtccatgtccgctcctttgcctgggctgcacctccaaaggaaggacggccgtaggcttcaattctgtgtattgtcactgttgtgtcttggagatttgtggtggtggtggtgtagctcagatatcaggcgattgggccctgtgcagaagtagagggaaattattttgtatggctcctaaccttgctctgcttttcctcaagtgataattgtgtaccctacaaagaatttaggagagtagaacgtggttgaatttcaagtctcattccactgaactgttttaactcatatctagtttttctctgcttttcagccacgccagtgtttttaaagatgcatcatttttgcatttcgcgctttccatcactttaaaaacactgacactgtttctccagctctgagttaggacagtagacctttaggggaatatttgagtgttgctctcactgccacgctgcggaaatgaagacagagcttaatgttggagacctttggggccagaaggtgtaaaaccttgactaggaagagagcctaatctttgaagaagtgtctgcctccttacttagtgaggggtgcatggacagtatttggccagtgcttcaa

SEQ ID NO: 74280 - DNA, 1040 bp, Homo sapiens
acgctgcaccctgcttgggccccatcccggcacgcgccccgtgcagcacagcacaggccagctgagaggctgttttaagaaggcgtgtttgtgtggtacactcacgggctcaggacaacatcaaaggtaatcttaaaaagagaatctctctctgtcttctctttttatattcagaaaggtcatttctaaaccaactatttgcaccaaggcctctctggaggagtttaccccgttgttattttttacttgctattacaataagtcacttatcccccaaacagatttaagaacaataaacaaatacaaaaggaaaaggaacatctcatcagtaacaaagactgcatctaaaggcattgagtttgtgattcttttacatctctttccaagcaaagcaggagtcctacagagaaaggaatctgaaagatgaaaattataaaaatagtaaaaggatccagtgttcgtcagaatcttgtaatttctggggagaaatgaagctaaatacagtcttagcgcttcgttcatatgcaggctgatctgtgatataactaaacttagtttttggagtatatccactgtggggaaatgtggtaaatcatattctcagcgaatgaagatacttttcctgaatttaggcttcatattttgaagtcgaattctgcaaaacaagaaaaaaatagatctgtgtgctacactgaaaactgaacaaggcacgtcgtaagtcagtcacacagaaggcgcagctcagggcgataccaactagaaaagtaacttttttgttgactctgatgcctctagtgatgttggattttttcccccattgcagacagcacagataggaaaactgtgcaatttggtccaattatagtcctctctgtccctccacaccttcccccattgatttaatgaaggacttggaggtacaattcactgataaatagtccctctgcccagaatgtttattagactgacagcagcgtgcactctcctcgctttttccctcaccacttatgactcagatgaattttaataggagcaaaaag

SEQ ID NO: 74281 - DNA, 1056 bp, Homo sapiens
gtgtgcagcaattgagaaccatttgaatttaaggctcttactgtaatttgaatttaaaagctaaaaattgatttagaatgaatgctacttttgaggaaaatttcatttaaactcatttatggtttggttttgtttttcccttaagtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtaagggctgtgtgtgtctctctgcaggacatgctggtctccaacttccccttccaaagcgacggctaacggcacagcacgattcggctctttgcagttcttacttaaccgacgccccctaaacagcaaaatcgattgcgtgtgttgtcgacctgtttcacgtttgcattacgttggtgccaggaccctcagcgcttcccctcccaaatgatctgggagtggagcagaaagaaggccagatgcattccatcattttgcaaatgcagtgttttgggaagtactttccttaaaagtgctgcttactctctagtatgctgtgctcaaagcatccattgaagtcatgccagggaataatactccgatgaggaactttttgcatgattcctggaacaaatgtctaattgggaagaagagttgaggaaaggttaattctgcaatctgtacagtaccagagcacttccattacttggtaaataaaatgtagcatcacagtttgaagtttttcatcttgatcttgtgacattaaagcacaaatcaaagctatattatttcctcgagataacttacatggatgaattgataggatgcacacattttcttagaacatggatagaaatctctactgatgagcagcaaaagtgaaaagaaaacaatttaggaggcaaccagatttccaggtacacttaaatacttgcatttttattcatgtgcaggaaaatagcatccggacatgactgtctctcatggatgaggtggtgattccgttttgt

SEQ ID NO: 74282 - DNA, 1037 bp, Homo sapiens
ccttgcttttctacattcaattattaaccaggaaatggaacgtacaaaggccaaaccctttcggtatgtgggaaagtcagatcaggagccagcagctgttaaagaaaccagaaggctgcgctgatctggccttgggagcgccccgtttactgcctctgagcaacctccttgagggccgtgtgaggggccagggctgcagtctcaccctcttgccctccaggcttgaggcaggagtggtctccctcatccctgcccgccctccctccactccggtttggattcaggtgttagaaaaggatttaaggaaaacacttacttgaaacacacacacacacacacacacacacacacacacacacacacacgattttataattaaagccacacaattaggagtggaaagctcaggctggcagtatacagactagatagatgccttccagaaaaaaaacttaagaaaaatgaaaaaaacaaaacaaaacccttatattgtttacgaacctacatatctagtcactagaagattccactgacagctctgataatgtcacgtgcaagtgaacgattcttaatgtcaaggccacgagactatcctcttacgaccctaactctggagaaggaagatgtcctcccctgaattttacacacattacacacacacacacacacacacacgtaatttttcttatggcctctcccaaatccttaacacgtgggcattagacagtcttaaagagggctttcttccaggagtatcaatgctttcacagcaaacaacaattcacagccacgtagcctcttttatgcctttctgaaaaagtggacagttctatttctgtatcaccaggtaaagcagctgttaagtcggttttctaacttcgcatattagtttcagggctggtcattcaaacaactaaaactgatcatgttttcttaatattcacatttattgcaaatacttttctagaagccaatgccaactacctgattttttcctcaatgttaagcagatattttatctgtactattgagaaatc

SEQ ID NO: 74283 - DNA, 1138 bp, Homo sapiens
ccctggcgccacgaggaccactgtcccatcctctgcaagacacagcgagtacccacaacaaggcacaaggcagcttccggaaaaccctccagacacaggaatgacttccagagctacatgcattccatgctaggagactgggagcgcccacgggcctttgctcagactgcgttcagaacttgcctttcatcctgaggggcagccaggctgagctgggttaagcccactggcgttaagcgtgaggcttccctgcaggagtgagctgcagctgaaaaccatgctgcgcactcacttcgctctgccccgatgggtcagcgtcctgagccggccaggtttttctttggcctcccagtctttgaaacgggcaagtccaggttcctagggcaatggctatgtggtgtgggtgggtgtcctggcatggggctcctggcccctcacaccactgtggccatattcgtccaatgcctcagaagcgcctagagaatgttctttcctgaaatccccagatgatctccaagtccccctctggcccccccgtgtggcgcaagctgtcttgctggcactctggagcgcctgagccgatgtactcttttcctctgctgttcaggtggtgggctgcttcttcctggcatagaaatataggaagagagacgatgccaaggctttggcgctggcacggaggagagacaccgcgctgaggagctgggcctggaagcgctgcccgcgctgccctttttgattcattttcacgtggcatctgcattccagggagagcgaagaatcagcctcgagggctgtttgcagggggatgggaggggcagcgcagagacaatgcagaggcccccatcaggggtgtcagaacagtcactccctccagttggcattttacagccttttttctctcttcaaaggcaggcaaagaccagggaatccaggagcaggtccagttcactgcagcacacctgccagccagctccacacaggggaccctggaagcctggccgtgtcctcttagaagctggactcactgcgactgactctgacctaggactgagcactcaggcaacaggaccggggactctctgggaagtggatctgagactcaacagaacatagtagaaatgccatccaaaaatga

SEQ ID NO: 74284 - DNA, 1065 bp, Homo sapiens
accgggccccgggcgcagaggagccgccagcgcccaccgcggtgcagtgcttcgtgtacagcagggccaccttcccgccggagtgggcccagctcccgcaccatgacagctacgactccgaggggccgcacgggctgcgctacaacccccgggagaacagataagggggacgggcagggtgggcctaggtttgagagccctggggctccaagatgcgcccagcccatgctgggtgaaggcggaagccgaacagggccctttccaatgaatctgccggaaaggaaccaatctttcagtggcagctgattttacaaataatgttgagatacgaatagcaaggtgcttccctcccatctttctacctggtaagaaaaatttaggattttaactcccctaaatgacatttagagaactcgtgttatgcctaattcttcttcctcctcgtgttgtttctgctgttggctctgctttgagctcaagataataataaatatttaggatcagtgtaaagacttggtgttgccgctagattttagcagccctactatactgattctggcctgtaacccctgagaaagccgattttacacggctgggtagaatttgtagaaaagatccacagggcaagcatgctgtatatcagagtgcgtatagcaccattcttcctaattttcagatcaagcttcacagcaaatattaaagattatttaaatttgaagtcgatgttttgggaaatcagatataaaagtgttggtactgtgtttgacccccacgttttttggtatacttatttggtagaaggttctttacattctgatctagcaaaataatgaacacccacttgctggtagacacagctgagcgcccggacttcaagtggaagtttatctgagcccagatctcagtagccagaccccgtccctgccccctgaagggagagcatttgggggtgagtcctttcaaagaagagccaatgcattagtaatttgttcttcaggcctgacagaagcttagcttccaaatacaaacagcacttaaaataattttagcaaggcacgaagtacc

SEQ ID NO: 74285 - DNA, 1056 bp, Homo sapiens
gtgtgttgttcaaaacacaatcagaaaggtaatgaagtttttcttatgacagaagccagaaatgcaggctattttcttttctattgcataagtagtgttctcaaactaactttatgttatgaaggatgctattgaactcaatacataaaatgtagaaaattttagttggtcattctagcaggctggattatttcctagaaatgaaggttaacttttattgcctggttttattttacagaaataagctatcatcttctgcagaagacaattactgaactgattttccagagttggaattaaccttctgtggcctaatcaccttcatttctacgtaatatcaccctcccaagcatttttcttggttttggaaaatcattaaggccacaaccactactcgatatgcctgatgccctctcccacttataatgtgttcatttttatttttgagaagactatagctagtagatatttctagaagatgttgataaaggatggagttaagtggagacctgaggagggagcagggataaggaagggccaaggggaagagggaattcacattcatcaggtgctcatgcctgcacagtcggcagtcagtggagggtaactctttggggtaaataggaggaaatggaagctcaagaacttgaaatcacttgcccaaagtcccacaggtgctcagggatggaggcaggaactcaagtcaggcctgttatggcacagtggattgtttgatacttgccctgcactctgtccctaaatgcccatctacagaattctgaggttgcctttcctgatgctggccctgcaagggctgggctcacactgtgtctgatgcagcagggctgacttgggggcaattacttcacattaaggtagagaccaagagaaatacttgttttaatctggaaaaactcagatggcttgcctacagccgtttcttaccattactcattaaaccaagcccttacattttatctgagaccctgactctaaccctgtgccatggaaaaacaaacaaacaaacaaaaaactagcatggtgagagggggcagg

SEQ ID NO: 74286 - DNA, 1003 bp, Homo sapiens
taaattagtttaagaagagttaaacactagccctttccttgttcggttcacctggtctgcgtatgcatgcttttaaacgtgtaccaggcatatgaagtggttgtgatttgtaaactatcatcataaactcttaaatcctgccttttacactcttgccaccaggtggctaagaaaaaagaaatcaagaaaaaaatctaacagttatgcaaaggactcgtaatcactttcaagttctgcttcagtggtgaaatatgaaactatagacggactgcgtttcaagaaggagaactgctgaataagtgacaggcatttcaggcagcgcccgaccagatggacagctcatgagtcttcttattttctcaaatattggcaatgggaaaccagattttgctgatctaaagcttttggagactctctgagcctgttccacctccatgctgtcccctggatgccgctattgtccggaccagttagctttgggacagaggttcagctttggcctcttggatttccagagtggaggatgcctgaatcctgaccacagcagcaggccgcccttatccttaacacatcagcatcagggaacgacatctgcagagatgttcagtgccctcagaattggctctaggaacccaaagtaaaattctccaaactgatgttaaggtctcatgcatgtcattctttgattctgtgtattaacagtaagatgctatgaggaaatccgtgcacgagggatgacagcgtggcaggctggaacacgctttttagatttactttcgtggactggatctgttaagagtaaggccagcgtcctagggcacaaaccgtgctctccccaacgtttccacagcgtcatgaaggacgatcttgtcccatgaaacaaaccctacccgtcttcttgctgggggggtcagcggctgctctgcttctcctgtgcacccggggttgctcttcagttctctaacttagtaagttggactggcagcctcttggttgtacacca

SEQ ID NO: 74287 - DNA, 1049 bp, Homo sapiens
actgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatattttacataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagcatgaaaatgtcatattgccttcttaatcaattattttcaagtagtgaactttgtatcctcctttaccttaaaatgaaatcaaactgaccaaatcatcatttatgtggcttctgtgtgacttggggaccatttcatagaatggcactacagtgttttccaagttcagagaacagagcgagtagatccacactgagaggaatgtgattctctggactcacgtgttgggggcaggtctgtgtagtgtttcagtcagtgattgtaacttctggtgtttgaaatgtatcaagaaataaagtgctgtgtttaaaatatttctttttttttttttgagatggagtcttgctctgtctcccaggctggagtgcagtggcaccatctcagctcactgcaacctccgcctcccaggttcaagcgatcctcctgcctcagcctcccgagtagctgggattacaggcgtgcaccaacatgcccggctaat

SEQ ID NO: 74288 - DNA, 1128 bp, Homo sapiens
tttactgtaactatcattttagggtcagctcttgatatcagaggccttttttctaaatggacccaaacaagctattacttccccaaatggtgtaaggaaatatttaaaataaacagctgaacttctgcatagtcagggctctgggcagtgcctagcatccatcacccccacctcccatacccagccttgcttcctggaaatttcatggcagcactaagacattgcatgtactcttctttttgcttctttatgtaataatgttactataggcagatgtatcttatctagtgctatgaagagccctaggagtaactggcagtaaatggataatcatcagggagtgtgattacaataaatagagttttcagtacaaacaatattgtttcatacaattgacttttgaaaactgtttgcataggatctgtaatatttctttgtccaagagggtaggaatacggcacgttactcagaagcattcccagtgaaatttatctcctgctatttcagctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctct

SEQ ID NO: 74289 - DNA, 1104 bp, Homo sapiens
tggaagaaatgcaaggctgtgcaagaatcaattcacacccatcaggggcatttggtgatggtcatgtgcagtactgtgacaatgtagttgacaggtggccattccttcctcttttctgcacattctttccagatggatggggctgcttctgggcggcccagagtgttgtaggttcttgggggagaggaaatgggcctcaactgctaccccaagagctctggaaatggcattggcatgggtatgctccacggctcagccttctcctgttccctgggcctcctgtcgtcatcacgcaccctgacctgggcgacttgcataacattacagaagtccaaccactgcagggaggcaggtggtggcactcacgaacatgttcatcccctctctgcggccaccactccctcccactgctccttgtcagcctctctttggcagagcgtggccccgctgggccttccgagtgtttctggaggaatgcattgatacaaaaggaggaggttaaaagtttgaaaaccgtaggtgataaaactgggaactgcttttgcttcatgtacaataaatatcttcctttttatgtttctcattttttaggaatctgaagctttattcctcaaggcaattaaagcaaatccaaatgctgcaagttaccatggtaatttgggtaagaaaaatgttcaacttgaatcgtgttgaaattttgttactttaatgaagtgggtgcatgtctataaaattaatgttgggagagtagttttttcaaagctagcctggctttaaaatgtggttctgttattgcattaaaaagatagcaaagtgatagccacacttacaaatctcaattgcatgaccagaacagccccaaagtttgcccactctattaccttctcatgatgaaactcagattgtccttctttgtgttaagctgagaagggtgagattggatcaagagaatgaggctatggttgcgaagagttctcctagtaaattaatcgtaggtactttggaagcttgccattgaacttacctccttttccttccttcttacagagtagaccttccccttccagcctggtcttctgctttatatcctcttatgccttggct

SEQ ID NO: 74290 - DNA, 1048 bp, Homo sapiens
tcactatgcattttttaaatttctagattttactccagaaatagctttttgaagagggcttagttttagtttttatgaatctacttgtgtagcaggggaaggaggtgaggtttacaggtttcccttctaatgacctttccagccatctgtcagcctgggacaggtcccaagtctcagttctcctccagtgacccagctacagcgagtcttcttgaagacttggcttatataatcgttgtattgatttttctgtcatcccacagtctgtaaactgctggaatttctattaaggggataaaacccagagttcgtttggcttccagttcatgttgttcttcctcccccacccccaagtaaagtagaaaatactctgtaaagcagaatggagaaatcagcttcctctttctctacacattttgcattttaattatcaaggccaaagcactgggcctaacttaaggaaacagaaggtgaaatctgaaacacagaactcacgatgagatcttcaggagctaccaagttgggggacatgatgtgacttcctgagccatggcatcagccaccaagcaagcattccatgtatttttttagttaagggtttgaattttaagcaactgtttaggttttcctcttctaatgcaaaaatgataccggttgctaatggtcagctgcatccctggcactgcttgtttcaggatgtagtgaggggacgtgtttcctcgcagagcactgggcaggatgtcccagagaagaggggatgtggtgagtcgcagggctgggtgaacagaccctccagcccagctatcttgatggcagggcaggtgtctgctccctgacaactcactttttacccaagcacttgctgttttatttatcatgcacttggtaaatctcctcagagagcctggaggcttcttgaggttggagccgagtctttggtcccagttttgtatctccattgctgtcgggcagttacgaagcacccagttaagtagttgtaaaatgatcaaatgcatctctcatttggccctgaaacgttcaggcttcc

SEQ ID NO: 74291 - DNA, 1032 bp, Homo sapiens
ctctcctagtagctgcccgtcactgcagttccttgggatttggaaaatagaggatttataataaatgctccttctgtaagaatgatgtccaaagggaggaacggagaatataaagtaccagcttttatcatgtgctgtagtccttgggattcattacactttcacttggaagatcatctgtagcattgaacacattgagaccttgtactgcttttggtttatattgtttactaattacactgccgtgaaatggtcttcctgtattccattccgccaactgttcctgcttatttaaggcttttgctttcccttgtggtttaattatccagctttttcctctttgacagcttaaaagcattaagagcttaatctttaacaactcaaccaacccatttatatactggcaaataagaacttaatagcttaagagggttttttgtttgtttgtttgtttgtttgttttaagaaatcactctctagtaacaggagacagcgatttgttttgatttctagaccccaatatggagagaatataaggcagttctcttgtggaataggaagtcaggaagagcgcaattactgggacatattactaatcttagaaagttatattctaagcaataatggctagagggattgcggaagacaatgcatgatggaaggactggatgtgtccaggaaaacagaaaccattctaagtgttttagatagagaagacttaatataaggaattggttagactcattggaaggctggatgagcaaaaatgggatggtaacatgaactcagagattaaagggaatcctatatgttttgggggaacagacaggaggcactaccaagatttaaaaactcacaagaggttacaatctctggagctaccacagcctcaagagctgtgatcatggagacagaccactgcttccaccctgggacggtggaggaggggacatagtcacttcagagacactgccaggggaaggaaggagagagtgagagtaagaggaaaggactgctcccctctccccacca

SEQ ID NO: 74292 - DNA, 1132 bp, Homo sapiens
aaggcgggcggatcacttgaggtcaggagttcaagaccagcctggccaacatggcgaaaccacatctctactaaaaatacaaaaaatagccagacatggtggtacgtgcctgtaatcccagctgctggggaggctgaggcaggaaaatcacttgaacctgggaagcagaggttgcagtgagccaagattgcggcactgcactccagcctgggcaacagagtgagattctgcctcaaaaaaattaagtaagtaaaataacaataatgaatcacccaggtgattccagtaacctgcccttggccctgcagcagggaagcagctctgtctgaacttggataacagggtaatcatgtcagagcagaagccatggtttgtggggaacaatcctagaaaacactgactgctttacatttattggaaaaccaggctttggtttttaccataatgtgaatgtctttggtcttactgtctttgtttctggagtgggtagccatgattttgtgagttgtggagatagaatcttatgaatggagaaaacaagatagcaggaacgtctggctaactaatggtaaaatgtgaccttccccctctgcagaagtccctttacgtggacgagtaatgcttgtgttagaaatatatacatatgtaactaacctgcacattgtgcacatgtacgctaaaacttaaagtataataataataaatttaaaaaaaaagaaatactaaagtgaagtggttgcatgtatgagtccattttcataatgctgataaagatatacctgacactgggtaatttatagagaaaaagaggtttaatggactcacagttccatgtggctggggaggcctcacaatcaaggtggaaggtgaaaggcacatcttacatggcagcagacaaaagaaaataagagccaagcaaaagaggtttccccttataaaaccatcagatctcatgagacttagtcactaccacgagaacagtatgggggaaaccacccccatgattcagttatttttcaccaggtccctcccacaacacatgggaatgatgggagctacaattcaagatgagatttgggtggggacacagccaaaccatatcaccgcatttttattactcaaaaaatgcaaa

SEQ ID NO: 74293 - DNA, 1032 bp, Homo sapiens
agcccagctttgtagttttctggttgtctctggtgaggtctttagttatttcccttctgttgtgctttagagatgtatcatgcctataccccctttcttctgatcctcttacagggttggagattaaagcacaagcaactcctaacccctgtagggttttagctaaagttctggtgggtgattttttttcctcgtcgctttaccttttgtcttcagttagaagatgtgatggggtccaggctctgaacaagaagtctgtctgctgatggcccaattattctctgtctgcaggttcactacaacattggcaaaaacctggctgataaaggcaaccagacagctgccatcagatactaccgggaagctgtaaggtatggcgagtatgtcttacagaagaattatgtacacagatcgttttcactttctaatatgaaacacctgttcctttaaagaccccaactttacaatatctttaccgattcctgagagtttagtaaaaacttactattgagcatttaatggtcagcttggttttttctcaactttcagattaaatcccaagtatgttcatgccatgaataatcttggaaatatcttaaaagaaaggaatgagctacaggaagctgaggagctgctgtctttggctgttcaaatacagtaagcattgtttttataattatgctagtgacaaagaaaggagctcctgcattccggcatctaagcctttcatcttcttgtttatctttgttaaaactgctcctctaggccagactttgccgctgcgtggatgaatctaggcatagtgcagaatagcctgaaacggtttgaagcagcagagcaaagttaccggacagcaattaaacacagaaggaaatacccagactgttactacaacctcgggcgtctggtaagcgcggggtgccctgtgcctgtggaaggaaagatgggttatttttcttatttataataaaatgacatagtgacacccacctagcccatacattttataaagttctttcacatgtttctatc

SEQ ID NO: 74294 - DNA, 2018 bp, Homo sapiens
cagcctcccgagtagctaggacaggcatgcgccactatgcccggctaatttttgtatttttagtagagacggggtttcactatgttagccaggctggtctcgaactcctgacctcgtgattcgcccatcctcagcctcccaaagtgctgggattacaggcatgagcctccgcgcccagccaagtgttagcttttgtaggttcatttcagtttgggttttgcattatgttgggaagagaacgctatttgctcaaaatgggggccaaggggttaggttagaagaattttcttttagtatagattattatcatgaaataatgatcattctctcttaggtcctcagcataagagctgcctagattgcttaaatgtaatcctcctgggtggagacggggagctctctggatctgtttcatgtctatgttccatatttaagggaaagcagtgatttcagacaaaattatataaacaaaactaatgaatagttgacatcttattatgaaacttaagtaaagaataatatataagagatgctggctacttatctttttcttggattaaaacctgtcattcatattttagttaagagacttagataaaatagtgaattactttcagcttttatctttagtttgatttgttgacttatcaatttattttatgctaccaaaaataaattgcctgtgatttaatttcttaaacgttaatagatctgctttatttttcctttactgtttgaatcgcagtaattgccccttctatgtgtggagttcctcaccacaaggagttcagatttctttacagaggctctataattcatctctattatcctctcactcagctttttagagagacagcgtattattttctctgttttcccagatgggagaaactgaagcatagcaagattaaactgacattatctaggttagtaatgtaggtggctacagagagacctggtatggtgatgtgcccaggtgcctctagtaaataagggggatggaacataggtgatgtctgaacccaaaaatctgcccgggaagtgatttcatatgttacaggctagaaaacacagggcgtgtgcttgtgggaatgcacgtaagtattaggagaaagacagagagagagagagagagagagagagagagagagagagagtgtgtgtgtgtgtgtgtgtgtgtgtgtgtgtgtgtgtggtttcctcttaatttaaggaatacatataagacctcatcttcaaaatggacccagtggtaatagtcctttctcaagaacatttttcaatgattctattcaatataagcaagattgagatttttgggagtttctttttaaattgaagtgtcataaaattatctttacttccttttttttgaaaaaatgtaagttaattttaggaaagtaatctcacttaggaagacactggtttccttcagtcccattatttcaggggacacattttctatactggtttcatttgatatctattgaatataaagtaagaaattggcaactggctctaatttagggccagatgtgtgagctaagactcatcttttttgagagattgcaatgtcagtgtaggtagtgctggtccctggtctgcatgtcaaggcacagtgccttgcatatggtagacaatcaatattagttattgaattcagccaaagggaagttgaattcactgagactactgtggatgagataccaagtatacttataatcatttttagtttttaaggcttaaaagtatgtcacaccatcaactctgtgatacaattctataataaattcttttaacaatgaaacagatcatatgccacaatgaggtattttcttaaggagtaagtgacccaggatgctataggatttttatgttttcaaaacattttaagtttaacattagatgttgccagaatatttataacaaattagtttagccctggtattaaaggtgcctttcataactgatactctcactttcttgcatttacatgttactgggttgtaatgtttgtt

SEQ ID NO: 74295 - DNA, 1057 bp, Homo sapiens
aaggtctttagcattaatttaatgtggagtaggatgtttttcttgagaagtctggaaatagccatttatttaaatacttttcatcatccaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaaggtatcaactgagagtggtgccagctgatgaacagaatgaccggatgcatctcactggtgacaattaccatgtctttctgttcttaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggtacctagctgccagatttcttttaaagggaccttactagggtatctgttaagttcttgggctgaataagaacatttcctgtcgcgcagtatttagtgtaagaccatgaccgaatacttgggtttttctttgttatgtatggttttttttaatgattttgataagattcattaaaattccactcagccaaaattgaaaagaagtcatttaaaagcagacagtatcaatgaaacagatgactctaatgaggtcttaatcatcttccagatgatctactcaccctttgaagtagcttcaggggaggtgacattgcgtattcagactgagggtgggcacggcacagattctgatgtctagagcacacttttcaaaacccactctctagtgatagcattaactagcctcctccaagctggaatttaaaggggtagtaatgcctacaaattggcaataatgtagttcaggaagtttatgctatgtgctgcacaatagtacacatttatgtcacctttgggtgccctgctagtgattttttgggggtcagattaggtaaacataaatgtacatacagtcat

SEQ ID NO: 74296 - DNA, 1049 bp, Homo sapiens
aagagatctccagagctccattagagattatcatgtgtgttcatcccatttctaaagatgccaaagtgcactggcacttaaggttcacttacatggctgggtttttgaggttgatggctgcctttatcttccagtatgattactgcccaggaaaacactctgttgcatgaactaaaggactgttttatagtgaccaaaaaaagtggggagggggtatctctcgagggcttttcctaggaatcccaaatttctagctatcctgaatcttgtagaactcctacacgcagactgtgaaatcattactatcaggggcttactaaataataaatatgatctattaccttgagctaatttcatagaaacgtacggctgttatgtgtttttttaaagagctgcagaggtcttccgtgattctctagtctatgtgttccttgtctagattgagtaatgaaattgtgaagtgtaattgctgcctaacacagccaagctctcccgtggctgattgtcttgctttgctttcttagggtttaaatgcggtatttgacatcttggtgataggcaaattcaatgttctggaaattgtccagaaggtactacataaggacaagtcattagaggtgagtctgtacttttatctccagcccagacatggaaaatgtcaagtaccagctgatttaaaatgccattctcaaatattccttgtgattttgaattctacaataaccagccttttaaagcacagtgttgaagcagttcaggcagaattgctgcacatctgtacctggctcagccacacttttatgtgaaaatcagccacctctggggctttgcgatgtccttgcagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggtgagttctgagcctgccgccccctggactcttttcttcc

SEQ ID NO: 74297 - DNA, 2173 bp, Homo sapiens
gtaatgctatttaatgtttaaatttcaggtttaacgtaaccctggtctttgtacttttgggatctgaacataaattcaaagaaaggcctaatatcagaggaacaagtttaatattataagggaacaaaaaattaagtactctgaaattaatgattcaactagttaataaattctttcagagaatactttttttggtaacatcattaactttttttatggatgggacgtctttattataaagctctggacgatttttaactgcttgagtttattctgtcctaacctctggaatcctagtattttcagaaaatgaaaaatgtactcacataacatttctggggctctgcctttttttttttttttttttttttttggtgcataaatagaacatctagcaagatctttgcaacagaattttttaaaagtagatgtcctcataaaggaagcatacattttctttaaaaaaacaaacaaacaaaaaacactagtgagatgaaatcaatggcacactgggtattacttctgaatgcccaaaacaaaaagtgttattcttacaatgaggcatcttgtatttacatctctcttaaagcctggtatttcagattggaaacagatcatctctgcacattaaacttgctagaatagccaaaacaatttcgtttctaaactgataccttaaaatacttgtctcatgggagttaagaccaaaagaagaaatttattctcatttatagtggggagaagagagtcttttccagagggggatggattttctatatacctagaacaaccattttaagttctaaattcttactcataatatcaaaggcaggatctcaaatctccattgttcttaagctatatagctccccttaagctgtgtagttctatagctgtatagttcaccttaagctgtatagttcaggcactaaaatgggataaatcttgctcttgggatatcattgcctcatattttcattctgattaaagacacctgtttttctttgacttagaatcacactgcttataaaatagggcagttggctaactcatgtccgataggacgcttggttttcaatttggggccattgctgactgcattctgacggtgggagtcatgcagattctcttttccctgtttctttggttgcttcattgcttgattttcccccaaatggacccgtgttttagaccagcaagcctgacttctttcattctgtgcatagaagcacggcttggtcgttccagcttttggaacgcgaatctgatgctcattgtgttgctctggcagagagagagtcgcggccacctgtcggggtggcgtggttcccacacacaacatgacgtgccagttttgagcggtggagatgccaggcatagagtggtgaagaggggtaacttgtacaacgtgatgctttttctgaaaggagatcttcccactggaaaggagtgccaaatccgaggcacgtgcttcattaaatggatcacatctgctggcacttgtgggtgttagcactgacaagtgtctttctgtcattgcatttttttccctgtgcccccttcactccattagcctttgcctccatttacctaagtgagtgaattctcttagatgctagagacaatatactgaaacgagaagaacattgcctaggcatgtctctggtcaattctggatcgtaaactattgatgtttgctaatgctgcataattatcctagagcaagttgtcttcttaaaagatgagagaggcagcatggtgtccaaatggtttttgtttttttttttcccatcctctcctgggtcattggtatttaaaatgtaacagtcttgatggagaggagatggagaatgctggggaagagtgatgtcctcagatgcttacatagagccatgcacaagttagaattttaaatctggggaagatttttctgaataaaaatatttataagtgcagctgtgttggaggtgacatctgccactcagaatttatttgtactgtttttaacagttacttctaaatttaaaatgaaaatattgatcttctccatagtttttaaatattaagtaatttttatttatttatttatttatttatttatttattttgaagaagaatatcttaatgatggcgattcttccagtgtgaaggggttcaaagattaaattaaaag

SEQ ID NO: 74298 - DNA, 1042 bp, Homo sapiens
ccaccacatccggttaatttttgtatttttagtagagatggggtttcaccatgatggacaggctggtgtcgaactcttggccccaagtgatccacctgcctcagcctcccaaagtgctgggattacaggtgtgagccactgcacctggcctaacatgaatttctttatattaacatttatattaatatgttttaggtctttaccactctccagcatttcacactgaaaatgatttttcccactgcaaataagcacctgaattttccagtcttctagggtgatcagccatctagtgtgcctgagattgagagggttctgggactggggattttccattttaaagcaacgacagccgggcaaatggggatgacttgggcacctcacagtcttgccccctcctggcctctgcttggtaatgctgtaattgcagtcggtgttttgtgctcctcaactcatggaatgtctctgtttttctaatgaaccaccgcacattgcttcaagtggtttgtagacacccaaaccctctgacaggccagtccctactgcaaggaggagagcctgggagggccacacagcccctggtctgctggtggctcttcagctctgtgtggccattagcaggaggaccccagcgcttccctgaggacagaagtggcttgtgtgggctttcctttttgttttcctcaaagtgttggggaagatttcactttgtctgaattccaacatcaaggagagaagctcaggcccccttaagagttctgcctgtagccaggtgtggtggcgcatgcctggagtcccagctacttgggaagctgaggcaggaggactgcccaagcccaggagtttgaggctgcagtgagctatgatcacgccagtgcactccagcctggaaaacagagtgagaccctgtctctagaagtaaaaaattaaacaaaatgtttaaaaagagttctgtctgtctaatgaacccagacgttaacccagaaggaatcgggaggggaaaccttccccatccccctaattccttttcatggcccccatg

SEQ ID NO: 74299 - DNA, 2388 bp, Homo sapiens
gttgtatgtggaggccccggtgtctgggtgtaattctcgttccttctgtgaggtgaggcagatgaagccatttcgtggttctgctgagcatggtcttggcagtgtttttgggagcatcacactgtgccccttttgttaacttgctagccctccctttttcttttcctggttaatgaaaggcactcctccgttcattggcactgtgcctacagtaatgtgaaacaggctgttactggattttagtgatgttagagactgttttccagatgcttccttgcagtgtggagttgccttttttgttccttgagatgatgatcttctttgagacagtggagttagggggaattttagacacaatacatcttttccataaatcattatgaggaagaattgacctttctttctgtagcacaccctgctgtggaggctccacttaatcaaatatttagaacctcgttggtgttcatttcctgttcaaagggaggaaaagatcctctgccgaagcccttcacagctgaccgggtacttctgtaagagtgtagaagaaggtaggcttccaggcttgtcactgagtcaacgaagggagcaggtgcctcacatgaccttcacagaatctctaacctgctcttggggagtggtcagtgtgctcctggcttctgaagccgatgcccatggaagcaaatgtcacccttaacagtggacatcagtgaccagctttgcatctgtcacctcttttcaagcctttccctttgagtcagcaagcacttaagtcgcaggtgctaagtcgcatggtggctgtggacctttgttgctctttggggccacccatcatttgacccatttctgtttggggcattcttaggtgctcagaagatgatttgattagggagctggtacagacgggctgtcccatcaggtgcgcccacctgttggaatcaggaactggtcacgcgaggtgggggcccagaggcagccaggcagtctctgccaggtgcccggcgcatgatttgtggttttgctcctgccacgtggccctgccctggctttccaggccacaggagggtctgtgagctgcaaactcccctttgaagaattccctttttgtttaaattaatcagagtttggttactgcgatgaagaatcttgatggacaacccggggaagtgatcagcatgttgtaatttctagtccctaaaacactcctgtttaattatgctctaaagagaaagttaatctgtcatttttcttacttactccaccacagtgccttgtttgcctctcttctcattagacacaatttaagccatctactttcatcttttgaatgtaaaacaatgcatttttaaacatctgtagtatagtaccaaattatctcagcagtaagagcggtacagtgttttttttaatatttagtgacttttgtctggaaaaattaaggttttttttctgatttcatagtctgcttagctcatgatcaaaaatggaaacttaaaaaaatatgtttatccatacttaactgggacattttggtaagttaccttatttaatagatgtgagaggttaatagtgatcttatttagctgtgtggtccacttatttgacacgtattaagcaccttctgtatacagccagcaaacccagatgtggcccagtcctcatggagcccagtctagtggcacagaaaaatagtcatgtgactgtaagttgccagggtgccacacattgcttgacagggtgagatgtccagaggcctatggaagagggatgggatcagctcaggaagggcagagccaggcagctgggagatgaatggcggaaggagttgagccatgaagagttgagggtgactgtccaggggtgacccgcacgtgcagagcccctgggttgggagctggcagaagcacagcaccagagctatgggcctgcagagttcgggggaagccagggtctgcaacagccccttcagcatatcagctatgtcccaggagggtgaaagctgatcggtgtttgaagcctggtggggtgagcccatgtgtatttcgagatatcaacatagagaacatgttgggcacagcatccccgctaggaggcctgactgcatcccaggtgagagatggaggagcttggcttagggctgatgggagacccttgtccagaacatcccctttgtgaccctgcaggacctccaagcagaaacgcccctgggggacctgtggcatcatgacttctggggcagtagactgagcagcaacaccagccacaagtcctaccggcctctcaccgtcctgactttcaggtaagctgtgacattgaagggcctgggaaggtccctcccagcttgtgtgtgacattggatacaggtgtgtgtcaccaggttctcagcattca

SEQ ID NO: 74300 - DNA, 1033 bp, Homo sapiens
tgtaaatctgagcctccttctggcccctggaaggggacagcatcaccatggaatggtgtgtcccgttgcctgttggatctgtctccatcttcactcagacagaaggctatagaaagatgcctgtgacttcaggtggcctatttggctggcttcttattgattccataatctggggtatccacttagagatccagaaacaaatacatccaaactgccttcccaatcagggggctggaattctctttcatctcagcaggaaaagaacagggtccaggtcccttagtaaagacaggagcctcggtaccaatcaaccagctactaaaagggatttcccacagaaaatcattctgtgcctctgctttcagccttctggaagaaagtattagtaatagtagccggcctcccctgagccttcattacagccaggcagtgctgggaatcctatttaaccctcatgacaactctagaaggtaggcactcttaccatccccattttagtgttgaggaaacaggcccagagaggtcaagtaagttgccagaggtaccccaggtcagaaccgagcagtcttacccaaacctgatcctggtaaatccaaagaaagcacctgtccaggatgtggtgggaatggggacagataaaaaagtgcgagtttgggggtaggttgagatttgttttggcgaattccaaggcgggaagctgttaggcaccgctgaccactgggcgttaagatgctttgcagagggccgcagggggtgggctcagagaggaaaggggttgtgcacaggaccgcacaactaacacatggcaaggatgaggcacaggcatccccggcgagaaacattatgcccatttgaaagaaaagttcaaaataggatatatttttatcttgactctttcaccaggattgaaggtcatatcctcacacagaatagcctcccttcctttcctttgtatggctcagccttttctgggacaagatattgtccccaccagtcatttcctctatctgtcctctgtgttgagccagtagcc

SEQ ID NO: 74301 - DNA, 1087 bp, Homo sapiens
gagtttccgcacccgggagggagatgcggccggggctcaggctccttgcaggtaacgcgcggggcggcccctgcagggccgagcgcgccgcggggcgagcggagttggacgcggagcgggcgcgggttccccgctgccgccgtgtcccgagccccgcacggcggcccgggccagagcggcgctgctggaggagttggttccgggacctgagctgcggcccgggccggggtcacgggggacgcgggcccctgtgtgagccgcacatgggacaaagggcgcggcgtggaggctgcgcgccccgcccgccgcgctcgggcccctgagcttctccgcccgggcagaggtcgccgcccccagcccctgcctgcacagccgcgccggcgctccctcggcccgggcgcacccggcgcctgcggcgcgtccccggagcggccatctggccgcggggccccgcgcctggccgccagctggccgcggcgcaggcgatggctggacacagccgggccgcttggccgcctgccctgggttccgcggcggctcccccgccgcgccgcgagcgcctgctactccacgctcggctgcggagcggagcggcgcgagcgcggggccaccggcccgggcgcccggggccaccgagccgccgcttcccggcgtgggctcggagtttggggaagccgagcaggtggcgcagccactgcccacctcctgcgaactctgcggggcttctggtcttgttgatgttgtggctatgggctgcgtgtgtgtttttcttttttttaaaccacacacaaaagaagggaggagttagaggaacgatctagccactatgagtcatcccacacttcgctctttccccgggagagcaaataaatgcatggggagaatgtcttgagaaacagttatagtagggactgactaggtcccctccctgtcccttttctctgcagtcctgtctgcgccgggcgcgccccagatggagtggggtaaaatcacggccagtgcacctagataggggaaatggctacaagctagcaaactggaaactttctgggacagtggaactgtgaatatcaaaccacacacattc

SEQ ID NO: 74302 - DNA, 1086 bp, Homo sapiens
caaataatttaaaattttcttcatttgaaaaaaatacatacacataatgcatctcaagttaatacatttaaatatgtactaaacactctctctgtttattttcttctttgctttttctccaggttaccatgaagatcatagcaatgtcgcctgctggcttctggcaaagcagaagaaaccgatacgatctcctggtgacgtcgcttggcgttgtatgggtggtgcttcactttgccctcctggtaagcatagaagtcaagttgatttcagctgattatttcagtttggttcagttctgctcagtcctgtttccagtctcattttactccacatcaacctgctctgaggtgttagatggacctccctaaagcccagctttgactgtgatgggctctcagacatgcttgtgtctacatgtacacacccccacactcttcacacaggcaaaacctggcccctcaaagacctagacgatgcaagctagaaagagaaggaccttcaagatcttctggtttagcccctcattttaccaaaggggaaaacaagaaagagagaggaagactgcaacagagactgagaactgtccaaattcacacaagctagtatcagaagactatagtcctgttttcctgttttctcagctgaaatatagcatttgttccactttgttataatcagtatttcacaatgtgattctcaagtgcttccactgtttcattttctataagacatttagcctccacttctctaaagcatatgattctccatctctatatctgtgttctcactattttacctaaagtgccttcaccctccattcagtctgagatcccactcaaaatctgcagctatgggtgtactgaactgtaatctagggccatattgtccaatgaaaataaaatgtggccacagatatcacttaacattttctagaagccacaataaaaaagtagtggtttagaaaatataactattaaattgttaataattattaaataaataataattaattatttaattatgtaatatattttattatttaaaatatgtattaattaaaagatgcattatgtgtatgtgtatgta

SEQ ID NO: 74303 - DNA, 1045 bp, Homo sapiens
gtccacaggaggaaacaatgaaaacttctctctcctttgggaggccaaggcgggcagatcacaaggtcaggagatcgagaccatcctggctaacatggtgaaaccctgtctctactaaaaatacaaaaaattagtcaggcatggtggtgtgtacctgtagtcccagctactcaggaggctgaggcagtagaatcgcttgaacccaggaggcagaggttgcagtgagccgagatcgcaccgctgcacttcagcctgggcgacagaatgagactccgtctcaaaataaaataaaataaaaataacaaaaaataacaaaaaacaaaaaaaaccttctctctcactaacaaagagatgtgattttggagaaatgtcttccctctctttcagttttaccaaatctaacttgggtatctttagatccggtgtgccctcttttctttgatgacacgagtcctaactcctatatattgtcttatatgattgttttatgtcatccaagctggcacttatatcatctccctggtctcataggcatttaaatctgggcccctgcactagaccctgacaagatctcttctagatctaaaattctcatccgggaaagagtcgagagctgtcattactgggacacctgtagctgtatacttcattatgacagatctgttgtttatgtccagtgtctcttctgattttggggtgttcatgctgcatggttttctaatatacgtagttctaatatgttctctgttcattactgcgaatttctgctccgacccctggccacctacacaaaccgcaatccccagcataggcaacatgttagtaaccacccggagggggcgactgcaagccatgatgaagagctgggtctaccatgtacctgacctgtgctgcaagctctggcactagagctggggtcacagggccctagataagtaatctcctctgagaatagtcagattttgtcaatacatacaattttctcttagcagaaatcttggttgtattaataaatgctgtcattgacagcattgctttgtatttg

SEQ ID NO: 74304 - DNA, 1046 bp, Homo sapiens
ggttgctggctgattcttaattttgttagatatgttaacaccatttgctacagtgctacccaaccttttgccattgtggtatgcatagagaatgatatttgtacaacacgctgaagtcaataggtaggaagcaaaagcagctggaaatatcagatatcaaggattcctgatgctccagggaacagctgcccaggagcgagaggaccgtaccctgaagaacctataaatcattagtggctgagagttgaaaaactctgcatttcactcaaatctgttgatgctacctaactccacttgaagccattctttcaatcttttggtcagagatgactcttttgaggtcagtttattattgcccataactttccatgatgtaaatctcaaaagatcagcttatagagcatttgatctgctatttctgaaatagctacttacttttataataaattcttacttttataataaatgttagactttttataataaattctctgtcacactaagacataaacagcaataaaattggtttgaagaaatgaaatggctaagacagaacagtttagatcaaggtttaagccaagaagtcacaacagaggctcagaatttgggaatatcaattatcaacataaaaacaacagcctaggaatctagaagtcattcaaaaagtagaaatatgggaggccaaggtgggaggatcgcttgagcccagtagttggagaccaacctgggcaatatagtgagaccctcatctctacaaaaaataaaaattatcgcagtgtggtggtccatacctgtggtcccagctgcttgtgaggctgaggtaggagaatcacttgagcctgggaggtcaaggctgcagtgagctgtgattgtgccactgcattctagcctgggcaacagagaaagaccctgtccccccaaccccccaagaaagataaagatagaaacagccaactggatttttacagtcaaataagtataggtgggagattcaaaaagtcagttcaaaacagaagtacctgttagaattgatgttctcctgatat

SEQ ID NO: 74305 - DNA, 1028 bp, Homo sapiens
aaattactttctttagaaataactcaaaaatccaaataatattatctatgaccacgtcccaaaaaatcatttcaatatgagtaataatattggaatcaattctttctaaatcttgataatagttctcaaaagaaaagtaacaaacagtatattttttaacctctgaatagagttatgctatttgctgtagcatgtttaaaattattaggggcacatgactcctttgtggtaaagtttgcttgaagcacagttgttcaaaagaatggccctggggtttagatcatgactccactttatattagtgtgacagccttaggaaagtaattaactctcttgcctcaatttccccatctaggaaatggggtaagtgatagacctaccttatacagttaatgtaaagagcaactgagaaactacacttagagtacgtgtagcgtagaacaaacgcagaatgaactagaaattgggatgcacgggcaaaatatgaatgtatctctgtgttatttgagggaaaatggtgtaataataagggagggcaggacatagatattttcacactcacacactgcatctgatatgattccctttgtttacagacattaactatgcaggttttccagtatcttattcaagggagaggcattggggcaggggcacggtgttttttgtttgtttgtttgtttgagatggagtctcggtctgtcgcccaagctggagtgcagtggcacaattttggctcactgcaaactttgcctcctgggttcaagcaattctcctgcctctgcctcccagttagctgggactacaggcgcccatcaccatgcctggctaatttttttgtatttttagtagagacggagtttcaccgtgttagccaggagggtctcgatctcctgacctcgtgatccacccgcctcggcctccaaaagtgctgggattacaggcgtgagccactgtacccgccggggcacggtgttcttaaccttgcatcttgcctatgttaactcatatctcccatttcattttat

SEQ ID NO: 74306 - DNA, 1030 bp, Homo sapiens
tcctcatttctcattcttatatgtaagccaaatgatccatcttcgcttcagtcttaactgactctatatttcaaagtgtgtggtacaaatattattaacctcatcaacaatgcttgtcatcagtgatttggtatctacaacataagagcaagaaggtctctcaaggtctctctttctctctctctccctctctaaatatatatatatatatatatatatatatatatattctctttgctgtactcttagatagatagatagatagatagatagatagatagatagatagaaagagcaaaggtctctcaaggtcttgctctgttgcccaggctagaatgcagtggcatgatcatagttcactgcaacctcgaacccctgggctcaagggattctcctgcctatgcctcccaaagtgcaacgattacaggcatgagcaacctcacttggccagatacatagatattaatgaagggtaattacattattcattgtaatcaacatttatgattgttgaaattgtctaacactttcatgtgttgttcacaggaatgtaacctggaatagtttagctattccagacacacactgctcaccagagctagaagaaggctaccagtgcccacctggatttaaatgcatggaccttgaagatctgggacttagcaggcaagagctgggctacagtggctttaatgagataggtctgtcttactggtaaaatacgttttaagtttctattttgtgatgtttatgaagtggacagaataattaaataattgatactaatattttgactggctgtagtatagaagaaatacaaatataaattttaattctatgcctattttataatatattctacccgacagtgcgtagcatacaagctgtgtatgtatatgggcagcagtgtttgtatggagttacagatctctcatttttgactatttcgattctcaataacagcatttaagcatttaaaaatatttgtttgttgaacagggttctgggttgttgactcaaagataaacaa

SEQ ID NO: 74307 - DNA, 1014 bp, Homo sapiens
ttttctacttttctttctacttctttatggaattttaggagttcagatgtttggaacatttacttatcactgtgttgtaaatgacacaaagccagggtaagtttatctattaactgcattttaatctagttgattaacaaagatatctctgtaattttcataagaataacctctatgtcagattttttaaacagtgcttatgtcctctttgttctgtgtctctgcttcctcggtattgtttttgtccagtttttattttattttattttattttatttttgagatggagtctcgctctgtcatgaggctggggtgcagtggcgcgatctcggttcactgcaacctccgcatcccgggttcaagcgtttctccttcctcagcctgccaagtagctgggactacaggcgtgcaccaccatgcccgactaatttttgttttgtccaatttttaaagacaagtattcaagacaggacagattggaaaatgtaacctggtggaaaagtagattaagcaaatgcaaagtgtacatttagaaaccttagtgtggcaaaatggggagtgtgctaacataataacataaacctagagcttcactgtggaagcttttcatattagaatgagttacatgttcgggaaaaaaagctcatttttattattatttacttttgtcatcattccctaaaatagtttcctaaatgattataacatcatttctagactaaacactattatctgttgcatttgactgttgtagggttggtgggtaagatagaatgtatgtactttaattacctattatgtattatgcaatagagcacctgcctcttctacttggctgatcattgttaatatacaactccagggatgtgatggcaggagagagcagagtgggatgttggcccctggatggtccagaagtgtcccattaggtgttagctagatatagagtttggggttccaagcacaacccagaagtgcaacagatatgactatgccagatttcagggcagcagg

SEQ ID NO: 74308 - DNA, 1382 bp, Homo sapiens
gagtatgagtgattgtatgtcctgtatatatattcatgttaacacacacttatctttaattctttcttcttattttggggttaaagaaaatcttcagacagcagacatgcctgtagtgttgcacagaaagttattttgtggaattttgaaagatgtctgggctaaatttgtataaaatgtgttctccaaaataaagagaaaaaatctatgcatttttttcaaatgtaggatgagaccagatttttaaaaagtttctttgtatttttatacaaaggcattatatatcagatacaaatagaaaggaaattctaaatatgggatgtgttatatatcaattcatttaaaaagcatttcttaactactatgataggcccttgtgctagatgctagggaagttatggtaaatatagtatgcccctaattctaggtacttatagtacaaaaatgaaaaaaaagtaatggcacatcaagttcctatgtgactaaattacaaacacatattttaattgaaccagaatcttcctatattgtagtctgatgcccaggaggttatcagatgtttgggagagcctgatcaggttccgtctatgctttgggtctttgtaacgcatggccacagaaatgcctccacctttctgtcttagtgtgtttatgtggaaaataggtgccttgagaattaaatgatataaaaacgtgaaaatatttgtagcacattatatgcacttagtgttagatttcttcttcttcacctccacattagtaaactattttaacctcagtattatgttttccacttagtgtggttcataatacaagtttgagatatcagttatggtgccgtgtagtaactctggaccatcattgcagtgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaaggtgagcacttccatgtcatttaaactaagaacctaaatgtgttgaaagtcttaatccctttaatcatattttcttgttcatttcagtaaaacaaaacatcattttatcttatacatatggaagtcctttttaaaaaggcataactccagagactgggagaaattgttgcatgagactattttaaaagttaaataaattttgtaagtcacaaactcttggaatatctgagaaggaacaagatggtttgactaatgactgtgtgaagtctcgagtagggttattcatgccacttagggctgagcccacaacccagcacaggggctggcccagag

SEQ ID NO: 74309 - DNA, 1034 bp, Homo sapiens
gtgtgtttatatgtgtgtgtgtgtatatctatctatatatatatataggtgtgtgtgtaccaattacaaagatgattcttcccacctcatagtctcatactttaacagtatatatatatatatatacatgtatatatatatatatatataccattacaaatactaaaattggtctaccagatattaaataacaaattaaaatttttgagtactgtgaacacatggaaacaaatttccatttattctttacttaatgatgtctaaaattcatgcattcatttattcagtaaatatttagtgagatcctagtatttagccatcactgttcttgatcttgagaagttagaataagcaaaagttgacatagtttaccattttttgaagtgtacagtctaatgagagacaaatgtttacactaatgatcgtattattacaaattaagaaaggttcttataagaaaaggaatgatttctatgagatcacatagataaatctggcctagcttgggtggtaaggaaaagcattgaattctgaactgagatctgaaacaccagtatgagttaactagactaagagcagcgtgaagaatattcctggaaagggtgatataatatacaaagaccctggggcaggaggagagacaaggcatttgaatgaaaaagagaaaacaacgaaatcagaatgcagaatgtgaacacacagcagtaggatttgggatttgggtattaggcatgagtgaaaccagtggtcacattaagggtgagggaagagagagacgctctcatattgttttatactcagtacctgttttaagaaaaaaagaaaaaacaacaaggaagtaaaaccaaagacaggcagcccagcgccaggcctgaaaccaggcctgggcctgcctggcctaaacccagtagttaaaaatcaacttagaaccctatgcctggcctaaactcagtagttaaaaatcaacttagaacccgatgttacccatagatttcaggcattgtataaaagaacattgtgaaactccctgctct

SEQ ID NO: 74310 - DNA, 1085 bp, Homo sapiens
agaaaataccttaaacttcctagtagatttggatcttaacactgtcttttcatagagctgaaattaaaggaggagtttttgtttggttttcacaaacatgtcctgaagcattaacctgaaattttaaaactggtttgaaatattaggttttctatcccctgcaaagctgtactataaaattaaaggaaaccaaaaacaggcatgggaatatgatagttaggtggtgttcctgagtgtggtattttaaagttttgactttcagtttcctcatggcattcacttgaaacctggttcattgagggctagctgcaaaccttccagatcttgtccttctttgcagctccaggtttctctggcctatggttctccaggaccctgcagttttttttttttttttcagaggcctgtgccacatcagttacacacacaaaaaaaggcttttgggtaaagggaaacttcatgtactgagcaagaagcatgaatgtaaaaatatagaacccctagggataaggaattcagtggctacctatgccattcgaaaggagtgtgccaaaatgtgcgctgagtagtgcctttcccagcattttctttttttagaaattaaaagtatggctctgatgccaaagctacaaaccataaatccaattaaagtgaaggacttaaatgtacatttgggagagtcgggggaaagtggaaagaggatctgtttctgaatcacctcgcctctttctcttcctccctcccaccctccaccctgaaaacatgtccacacagtgggattgcttgttaaattaggacactatgactatgtaactatatttgtgaaatagagtcaaattaaaattgaaagaaaacaactgaaatgcaaaaaatatgaaaagaaagttgaatccatgctctagtgcaaatgttcttccagctcaaactacctctaaaatagccctggactgcgtgcaactccacatctcacagtttgctttatgaagtatcaaaacattctcaaacttttgactgcaataggtttccatgtttttaaacttttgctctaataagcaaggtctgtctgttttcttttaacaatttta

SEQ ID NO: 74311 - DNA, 1555 bp, Homo sapiens
tcaccgttattcaagatccatctcccagcatccctgactaatcctactgtatgctgatctctcgttgatcagcccctggctatcttatcctcctttctacactaaacactcatcctcctccccacaatgtcccttcccttctggatcctttatcgtgctttctgattattgaggtagcattttggaagtaacgagggggagtctggccgaatctgcttagaaacccctgggaatcttgattcctggtgtgtgttcttcagcaccactctggagtacagcacatcttttgtgaatcagaagaggatcaggtactgaattccctcccggtaactggagttatatagttgtcgttgtattaataacttaaagacttagaacaatgacagctatcaactcatttggggctttattacaaagtaataatgcttttcattcagctgtggagtgtgtttactttttataggatgagtgggaggaaaacagctgggataagtggttcaccggttcttttgtcaggataataagagggtcagaaaagtttggagaagtgctgcttggtagaatttgttggtagaatttccagatctgtttctcacattattctgttactctctctaaagtaacaataattttcaccccacagccttgttgtgaaaattgattataagaggactggctaattacatgtgacttttttaaatgctcaagaaaaatattaaactattttggcaatgatatttattcttttttgtatatataatttcaacttttattttagattcagaaggtagaagtacaggtttgttacatgggggtattgcctgatgttaaggtttggggtgtgattgatcctgtcacccaggtagtgagcgtggtacccagtaggtagtgtttcagtcttatttccaccccttccctttgggatccccagtatctgttgttcccgtctttgtgtccatgtgtactcaatatttagctcccaccataagtgaatagaagtttatgctggatctttcatcaccaactatttggagggtaaatatatgttagatatttgcatgtaataaatattcagatgataaaatattgaaataaaatgaaagcataagtcttctcttttaacaaccttgactcagatattggcctaaacatagccagttaaaagaaattgggtacggtggcttgcaaacgtgaggatttttttttcctgtacctttaacagatttattttgtagatatatgtgtacatcattaagattagaggatggatagaaagaaaaaggaaggaaagaatgaaataggaggaagatgaggctgaactggcagtttggaaagccgggtggggtctgaataaaggactagaggcacaagtgaaaacgtggaagaacacagtgggttgtctcagtctttggtgacttccttgggcccaattcttttgtgacaggtctgtgggcatgatcaagtggaggatgggtggcatgagaagagtagtagttacgtaagtgatttcatatttcctcagcagatattcaggcacctaccaggtgcctaagtt

SEQ ID NO: 74312 - DNA, 1123 bp, Homo sapiens
tgatggggccaagagtggaaactgagggaccacttaggtaattcacctcatggaggcaagagatggtggtggtttggaaagttaggatagtggtagtgaaaatgcaatggatttgagctctcttctagacaaagaattaacaggatttcctgttagcttcgctgtgaggagtcaactgaagtaaagaatcagaggaggattgttaagtttccagtgtgaacagctgggcgtggggattcctgggatggcaaagcctggagaaaatcaggtggtggggggcatgttaagcttgaactttgttgcgtttgaggtgctagtgtggcatccaataatggtgccattaaatggtaccattactactaaacattttttccccctaaagctctaaacttgtccagcccacagctcaccatctttagatcttttctcaaatgttaccatctcagcaaggccttccttgaccagccaaacttatgttgaaaaccccacactgaccatctcccttccctgcttaatttttctccatagttaattttcaccatctgacatgttcttttttttccctaatacccagtgtgatagcacatctgacatgttctttattttactttgttattaactgaactgctttctcgctataagatcgtcagggatttttgcgtatggatcactgccatatccccagcacctaaaatagggtgtggtctatagtaaatgctcagtaaatatttgtttattgaatatatgaaacgacttgaaggattctgtagtgtttccacgattaaattttcttactagtatttgttcaggcttttggcttaaaacagttcagttctcttttttaagtgaatgtagattttgtatatacacacacatatatatgtggatttgcattgtttaggaataaaaacctaaaatctaccattcatattttaattttcttaattttcaggttacaactgatggaaaaccaaaaatcgttgatatcattgatacaacaggaagtggcgatgtgaatactgctacagaagtagagccaaaggatggtgagattgttggcctttcaggaagagtgcttaaggtgagaccttttgtcttctttttgaatttttttttttttact

SEQ ID NO: 74313 - DNA, 1033 bp, Homo sapiens
ttgagacggagttttggtcttgttgcccagactggagtgcaatggcgcgatctcaactcactgcaacatctgccacccgggttcaagcgattctcctgcctcagcctcctgagtagctgggattacaggtgtctgccaccacacccggctaattttgtatttttagtagagacagggtttcaccatgttggccaagctggtctcagactcctgacctcaggtgatctacctgcctcagcctcccaaagtgctgggattacaagcgcgagccaccgtgcccagcccccatgcatttttaaaccattagatcttgtaataattcatcatcacaagaacaacaagggggaaatccacccccatgatccagtcacctcccaccacatccctcccctgacacgaaggggttatatttcgacatgcgatttgggtagagacagagccaaaccatatcacctgttctttgctttgttgacatgtcagcttttctctggttcagcttggttggtgaagtttgggcaggatgtgggatggggcaatgggagtgctcttatacaaattttccgccagtcttcttagtcagaactctcttctccatccatccataacatgtactcacacacatgttcagtttaatttttttcagggatgtgcaggtgtttagatattttgcagtagtcaataaaaggaagaattattaatcactgggattctgactagttgcatctctgcaactctttagtacatagttttcagaaagcagcacaatgaagtcttcaagtttctttgatgtagtcgtgcatttatttatttatttatttattcatttatttatttatgacagagtcttgctctgtcgtccaggctggagtgcagtggtgtgatcttggctcactgcaacctccgtctcctgggttccagcaattttcctgcctcagcctcccaagtcgctgggattataggcacccgccaccatgcccggctaattttttgtatttttagtagagactgggtttcaccatgctggctaggcagg

SEQ ID NO: 74314 - DNA, 1031 bp, Homo sapiens
tttttctgtcagtttaagatcaactgttaagttaggtgctttgaacactttagtagcctcattctctaaggatgatattcctaggcttccttgagaaaccagtggtaagctacttatgacctatggtactcccatgagcagataaaagtacaaaagtgaatagaactttaaaaccttttattgcaaaatatacatacataaaatacataaaacacatatatacagttttatgaatagtatagctaacaccattgtacccacccagatcaagataaagagtattgccgtacatcagaaacttcctgcatcctcctatatcacagcctatttcaacttttgtgataatcattcctttgcttttttgtgtgtagttttaccatatctgtgtggctacataaaatatattgtttagttttgaactttacataaacagtctcatttcattcataaaatttcatcatacgtcatttttcccttggtgttgtgagatttcagattcctgagacttgcccatgttgtcacgggcagcaatgatttattaagtttcattgctgtgcaatatgccatggtttgtacctactacattctatccattctgctgtgatgtgtgtgtatcctgtgcacatgtgtgtggatgtctccagaatgtgtgcataggagtagaattgctgaatcatggagatatgtcactaggtcatgccaaacagtttttccaagtgcgtgtttgtttgttttttaactggacaggacatcttcttgaccaagtgtctgtattaaaggacatttccaggccgggcacggtggctcacacctgtaatcccagcactttgggaggccaagcactttggatcatctgaggtcgggagttcaagaccagcctgaccaacatgtcgaaaccccctctctgctaaaaatacaaaaattagctgggcatggtggtgcacacctgaatcccagctactagggaggctgagacaggagaacacagaggttgcagtgagccaatatggcgccactgcacagcagcctga

SEQ ID NO: 74315 - DNA, 1028 bp, Homo sapiens
tattctcctatatttctaagaagtgtcacagcttttctcttctgtttgttctagaattcacctggaagtgattttatatgcttagtttgaagagttctgtttccttttttctgtaaaaagacccagttgtcccaacaccatgtgttccacaattttcactctaatttttaatgccttcttttcacttggcacccttcaaaatgtggtgagcttctgaagtctctttcgtattctctttgtcccttcgtttttggatgcttccccgacttcctttattctaattttagtagcattttggaaggaagcacagtacctttttcattttaccacatttaactggaagtcattttaaaaatcaacacttagtcttaaatatttttggtttttaaaaaaaataaaataaagataaatccaggcataatgaatgacttggccagattcagcatggtacttagatgcagtgacagccaaaggaaactgtgcgtgtgccctggcctgtgtgatgaggctggcaagactgaaatcatttggaagcaaaagcctctaagagggcttcactgcatggtaccctaacactcagatgacacttagcccgttaagaaaaatgtttgatttgttaggcatcctctctttaagagagtcagagaaatgaggtgtaattggtaattaaaaagattacgtgtatcatatgacaatcagtcttaatacattgtagttactgtgttattagaaccatttttaagataccaacctaaaatggtcaaatgtaaagattttattcttagaaaaaataactttgtttatgtagaatactcaaatatgcaaaataaaatttcataattgcctcataaagttagctttactctaacttggctaaagttagatcagatagcccagattataacttttatctgatttttttggtgtaatttttgtaactagtctgccttcgtggtaaggaagatacatagttgtgatttgagaagtatctggttccatggaccgtgcagactttgatctcatttata

SEQ ID NO: 74316 - DNA, 1017 bp, Homo sapiens
ataatattgaacttttaatgatgttcatttcatttatgactttttgaatattaagtgtattttgttttaatcaggctatcttctaaagtgttcggaatataatttaaaaactattttagttagtaaaatggaaaaaacatgaaggaagacaaccataaagtaatgtagaaaatgccttctgtgagaaataaatttaagtctgttataactataggactgaagctcagtaaaattcacctagtttcaaagagcttgtgtaagccgttagattcttgaagccattactaaaagaagcagctggaagttagacctaggccatgtgtctgaactatcctaaactgctctaaaactctaagccaagttttagctgtaattcttaagagtccaggtggtttttaacctagagttttgtgaaggagggtatttttaaagcactttgtgcatgatttaagaactggttgctgtaagctatcttacctaatccttactgcccactctaagaaacaggctaaaccaggcagtcattatatttatatttgttgtggtagaggtagtagtatagtaaaatagtggagagactatgttacatgatttttagaaaggtaagaaaataaattttactgtctccatttctttttaattaatagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggtatcccatttcagattgaccaatgagatatagatttatgaggtgataaagtggtacgttgcgatagctcacagcaaccttctagagaattttaagctagagatcgtagctaaaggactaggtccagaatcataaaggtgatttgatttacctgcaagatgttgttttttaaggtcataaccatgtgggatccagtccaagaatat

SEQ ID NO: 74317 - DNA, 2478 bp, Homo sapiens
tctttgtaactacaactcaggtcaagaaatgaaacataatgaaactcccatcatgccccttcctaatcagtaatgtaccctcccacctcctacagttaactactatcctgatctccattgccacattagtttggaccatatgatgttgctgtttttgtgatcggaaatgataaaatagtggcagtttcagatggttcagcctttttttcatttatatgaaaattcaatatccatttttgtatgtgacttctttagttcagccttatttttgtgagctttatctcatagtacatagtagtagtttattgctgtataattgtcagttctatgaattgatgtacatgtaaccatttactgttaatgaatcttgtggtggtttttaagtttttgaattttataaacagtgttgccatgaacatttttgtgggtgtcttagttacatgtgcacacattttggtattgtgtgtacctagaggtaggatggctggctcataggctgtggcagtgttcagctttcactccagccagcagtgtatgatatgtacttccatccacacttgctttgtcagcctttaatattttggcaattctaaaaggtacgtagaagcatctttttgtggcttaatttgcgtttcctagatgacgaatgaaattaaacatcttttcgtgtgtttatttgccctttgggtatcttcttttataaaatgctttttcaaatgtttgaaggggggattctccctttttttattgtgaatttgaaagatttttatatattctggatataaagctctttgtcagctatacatgttgcaaatactttcctttgtgacttgagtttttgctctccatgaacagggtagcagagtaatgtgtattctttttatcatgattaataatatgcaaattgaattgaataaactttcagtccatgagaatgttttgtcatttccccacctttgtgtctctaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctgtgagtgtttgtgagttgttgattcagaagattaatgattaatgatcttggatatttttaggtttataagtgctcctagtttaccaagaatacattgaactatatatagtgtacaggacttttaacaaagcaaaaatatttactaatttatttttaaattatttttattaaatattattaggatttggcctaacctttgtgaaaaaattacttacttcatactcgtcatttctagcaaatctcctaacaagcaattttgagatacttaaaaagaaagacctcttagccagctttctccatcagcctaagaggaatttaaaacctcagctaacattctgtacgtcattttaacgtaggaaagtatatttaattttagtgattttttaacctaggaaggaccattccattccctctacctctgtccccctctaaccccactcttttctagaaatgctagttttttgtttttttttttaatgactacttttttatgtgtctcctcctacctttttgtgtttatgtgcttatatgtccaggtatatggtgatatgcctggaggtaacttataaattagaatatgattggctaagaaactataggattatatatatgcccttattttactggctaatctgtttctgtaaattgctgcctaaactagagtcttaatctctttaatagatgatagaagttataaatcataagtgtgatcttgtcaactacagttacggagaagcaactcactggccaaattctgggtgagtgttccttgacagttgtttagccatagaaccttagccagtgaagagtatgagatgtttttcataagtggattgagtgtcacggtggaagaaagaacagttgcagtggttagatgataactgtgttcaagaggactttcatcctcttgaagtcctgtttggctcgtaggccgcacacccccgttcctgtgttcacatctgtgacgatgttaatgctgttcactgcaccatgcctgaagtctcaactctgagcatgcctgtgctgtcctttgtggctcttccttggttaggtctccctcacagttcttctgagatatgcaacccacagactctggtgttttttcactgtcagatgcactgcatcctcacttctcttcccaggcaatttagatctgacaatctgtctatcattataattactagttccacaagcactctgaagccatcctcagttgtatatacatacccgacagacgcccagacttgctgaaattttgctattctctttagtgacttgcatctcatctgcaaaacttactgttggttgcgtatgttcactaactcggtcagttttcacatctcctcaatccattc

SEQ ID NO: 74318 - DNA, 1030 bp, Homo sapiens
tgcatgcttttaggtgcattagcatatttagtctaaaatatcctgggataaataatcctgggagataggtattttgtatccaaaagcaaagttcttagtaaaatgtatggtacatagtagactttccttgtttccttattaaattttattcttccatcgtattagagagaggactggtgttgagagattaggcagtttactcaagtgaacagtggatttggaatcaggatccccgtttgttttcttttcttaatgattaaatccatcccacaggtgttggtgcttatgtttctcctgatatgatggttgctgagtattcactgagagagaaattacctgcaaatcaatatacttggtcttctagaggacctaggtaggtgcaggtagaacgcggaaccattacgtatattcggttaaactttacactgttgagaagggcagagttttagataagtttgctagtttttttctgttggtttttacttttttttcagtattttcattttgattaacagtctcatctcagggacagataaataaaataaatgaaatagtttcattgttacatggagaacatcactattctgagtataaattcttattcctatatccataattcttcatttataagaatctaaagaaaaagtagggacttggatatctttatatagtagtgatggccttgttttaaatagtttttgatatttgaactttggtgaaatgaaagccctaagcttttataaagcatcacagtcatagggcccacgtacctgtggctcatgtctttgaagttataacttactttgagcaattttgggtgagatccaaaagtaaacaagttctgactgagaaatgaagtctatctcttttggttccctgaagccctctgaactacatttatctgattctgtgaactgattttctgaagaggtatattaagtcctaatttatgtaattcttcgttatatcatcagcgggtacatgcaccttctgaaaaataaagcctattttaattcatctgtttggagtt

SEQ ID NO: 74319 - DNA, 1903 bp, Homo sapiens
gagtaaaaatagttcactcagttgggagatggtataaggagagtctggcagcctctgtggggaatgtatggccacttagccagggaggcggaagtgtgctattctgtgccattccttctttacttggggcagaggacagagctttgttggatgataatgtggttatgaattctgagggttttaattcatcagactttgcttgtttgaagccctcagctggacagtcctgttagacttcagctgtccagtatggcagcagtcagggacgtgaggttagtctgcgttaagatgtgctgtaagtatagaatgtacaccaaatttcaaagacttggtacaaaaaaaacaatgtaaactaattcatttttctttgtatctattaattacatgttgaaatgctaatatttttgctatgtctagttaaacatactaaaattaattgcattaatgtcttgttagctttttttaagtgtggcttatagaaaatgttaatttatatggcccacattatatttctattgtacagtgctatattagaccttaaacagaaggaaagtttcttattacagataagagagatgtacactcatcaaagagtcagaacagtgacatttattttctctctctaaatatacctgacactgtggcctgtcacacatgcccagatatgtatatacacacagacatttctgtacacttacaaggaaaaaataaatgctgcctatgggaaaatggctctgctgggtgttttcccccattgattcttcatagtagtatctgtgtcactatttgtaatgagtgcagttagtacatagtgttatactattggatttaaccagtggtcgtcttaaaaatgcccatgtatgtttagctttcaccatcctaagcaaacttcaatggctttccatttagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtaagcgtgttctttattgtccttacattattgcagaccaatatttttgttttctgaagctctcatggtaagaacatgtggtagaattgataattccctgggcacaaagtagagtttaaggtaacgaataacttatgtgataatgataatttgaatgtgtgtttattcagcagtatatttgttggctgtccgctgttaacgactgtcaagcagtattttagctctggggctaaattagtgaacaaagcatcaaaaatagctgcctatgtggaggttacatcattatatatattatagttgggataaacagactctgaacaaaataaaaaactgtagatgttgcatgttagaggttaatggatgccgtgagcaaaatgaggtagaaagagaaggagggatttctagagtggtgcacaggattaaatagagtggcactgggcttagccaggactcagatttagggtagccaggctgctgtgaagctccctcctcagaaacgtccctctttaagttgtctctcctctgcctcctttcttccccgcttttctcacccacaccacagtttcttctgctcaccacatctcctcagcatggcctgtccacactggtgctatcagcataagcctgtgatgatgtaccacttcaagtgctacatccttctctaggttgagcccacactcttaggatggatcctaacatgaccctctttctagttctcttcagcctcaccaggtatttcaaggcctcttggcctccatctttgggtgtactgcactctgcctcgaagtcctgtctgccatgttgtggccttgcagactcctgtacattctctaagaggcggctta

SEQ ID NO: 74320 - DNA, 1064 bp, Homo sapiens
acatcatttgctaataaattaggttttactgttactgttggaaataaccgtggcatctacctccgagatcctgttcaggtggctgcaccttcagatcatggcgttggcattgaacctgtatttccggagaacacaggtcagtaataggctggcagtaagctgacgtattcacatttgctgtttgaatgagtggtatcataataaagaattgctgtttgggccagtgttgtgaagagaatacatgaattgacagtatgattattttaaatcttagtcataagagaaaatattagagcaatttggggtccttgtacaatggcaatttagttagcatcttaaactaccagggaaaacagtagaatgagcctcagtgacccacagctttattaaattgtggataataaaatatcaaatttcttttccactttacctacttaggtataagacagagctttctgttgaagaatgaaaagtagaagcagtctaggagaactgcagctcgattaggtgtgaacaaaaataatcatcgctattatctggctgtcttcatttcagttgaatactatgacctgtgtgcagtaatgaaaacattcacttaaactctttattttaaggtcataccagtgcttggtgaaagtataaatgaatcatgagtaatctaaattgtaaggaagattatttgactgttttatttaagctgtgttttggatgcattttacagccaaccaaaccaagtcgctaaatttttttggaaagatgtaacatttttaaatggaaaaaaggaaaaaaatactcatctttaatttttggtctttttcgtgccagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtattgatgtatcttcatttttactttcttcactctttaaaatgtttaaaaggttaaaaaaaaatccaaagtatatttgca

SEQ ID NO: 74321 - DNA, 1989 bp, Homo sapiens
cttcccccgctcttttaaacatttgtttatggatattgacacttaccgattcttttttcaaggtatgtggctatgatatagcatcccctaacgcaggtccgctcttcagagttccgatcactgcagttatagcagcaaagtaagtaacaggttactcacagcttactggtacatctaagattttaatgactattcatggagtcttgtggacttttaatgatcactaatacagaaccaggtaatggggattttgtcttagttctgctcccagctagcatttttaggtgtcatgtagtcagccatactgactcttgtgtgctctgagagtaactgatggcacctggcatctgccctacctctgcatcaaaactatttccaccacagtcactctgagctctgcattgcccagttcagaggataactcaggcttcgtctgacccgatcccactgtagtatttgacaatattacttcactcccctccattcctgccctttttgtctctgtcgtttttgggatttactctcttctcttaatgcttccacttttctagttatctactgtagaagcagaagttaagaaactcttaacttcccatcttattcctctggaaccaaggaaaaatcagcagattatattacttcctgcttaaagtatatcagtggcacctccaaaggtcaagttcaagctccttaaaatagcaaacaatgctccctcacaattatagccctagccagtgtttcctgtcattccgtacaccaaattacacattttggccaactcactgattttggcacttgaggattctcaggatttgtgcatgtgcacagctgataacttggtttcaatttcctgtctcttcagttaatgaccaggtgcattcctggtcatccctgggtgaagggagtcccttctttctgcttcgtggcacattttacgtgcccctggacagactttagccaatatattgtaattttttatttaacttacactctttcactgtgagcccaccgaaggcacagagactactgttatacaggatgtataaaataaattatctagtggatgaaggtgagattgggattgtgagagtactggaaaccaagtggaaattctaaactaacagttctgttactctggtaaatattaagtatgcaatagatctcagcccatgagaaacacaggatgaaattgaggagaataaatttaaaaagtggtatacatgtggaaaaattgtgcaacagttaaattctcagccgtatattccctcgaagtccagtagtaatttagaccaggtaatgtgtaagaccttcaggagtcagctgccacgccatctccttcaggaagcttcccaggctccgtaactcttcttgtctatctggagcatcttatgttaaatgtctctgatgatgattctctccatgctagattgtctaggttaaagaatcatattttcttctttgttacgtttctagctcctaataacagggcctcatgtagtaggcactcatttaaccgtttgtcctactgacaagaatttgtctctagcataaaatttgtttccgtggtgggtagttatgcatttgaactttatttcattgatttcttacaaaagtgctttgaaagtagtttgcctttctttactgttttacatcatgggagtgttttgaagctacaggaggagcttaatttaacacaagtctcatagctataataccagtgacataaaactttatcattgattttaatatctaggactcactgtagtttggaatctggtaattggaaaattctgtgaatgttgtagaatgcctttaacaaaaaagagaatgcttttttaatagtgtgtgtgaatgtatcttacaaatcataaaataggcaaaaagtagaatcatctatactctgctattcagaggttatctctgctaacctactgcaaaaattgaacaatatcgtacctactgttttgtaaccagcttctaagtccctgt

SEQ ID NO: 74322 - DNA, 1981 bp, Homo sapiens
gttctacatgcagtccagcttgtgaagcaaagagcatatcgaagccatgaattctataagttttgttctcttccagagaaaggaacactgactgaagcttttcctgtcctagtaagtttaattatagtttataatcctaacacaatttatttgcctttttggtatgggctaagactaagtatttgcatttgattttatagtttgtatttagcatgttgggattatatatttttttaatgccaaaaaaatgaagtagaaaaatagaaaatctaatcagggtacttgaaatcaagttggaggtaattatggctgtaattcttgaatagcatagtcaaagaaacatactagtctggtagattctcgtgccttgtagttaggaccctgatttagattattctttgttgtactatagattaatttctttaagacctgtttgcttgtcacttaacttattttactaatgctgtgttgttaagctatgaggctaatttgcattataggaaaactgctactgcttcatgtctaagttatctcagatgatggcagactgcattcttatctgtggtgttggaaatgatgactagtctttcttccatagaaggtgaaagtactgatgttcttccttcaatgcgctcctttgtgttttcagttggttctgggattttcccagtatctcttggtttctggttactttcatttgtgttcttccatggatcagtgttgcttcatctttttaaacttttaaatcactgattactagaaaacttactttaaaactcagtgctaagagcaggtgtttttttttccttttccttatctttattttttaatagggagaaagatgtaaatgaccataatgtcattttgttttggttgccaggtagctgtgagcccaaactcaattgtgcctattgagtatgccttacaaagttgaagtatctttattgtgtcgttatacttgattatttttcttttggtcctaattttttatttcacttcgaaataataaaatcacatttgctttattatatgtgctttcagaagctgcctaggatcttttatgacaagaagcatagggttatgagtaaataactatgtatatttaaatacaccatatctctgcaaatgatttgtctaactcttacttagcatagctgttaaaatttttgagttttcttgctacaaacaggaaaagtttgaaaacagaattgctctgaaacagctagtatttatattctgtaatttgagaaaaataagaaaagagatatattttatttacttttatttgcagggtggaaaagcaattgaattttgcattgctcgttggtgggcaagtctcagtgatgtcaacattgattataccatttctttccatgggatagtgtgtactgctcctcagttaaacattgtaagttccacaacattttcatgatttttaatgtcagttacttgtgttactggagagtaacttcattggttagatttaaactttaatgaggggaaattacctgtggttctgaagatagcagtaggctttgtgtgtgggtacttataaactttatattggacacatttattttaggtacaaaatattgcttatttttagtaaagtttgagaaagtaatttgagaaatcctttgtagcatgcatcggaaggaatcaaccgctttgatgttcagtcctccttgaaatacgaagatctggctccctgcataactttgaagaactgggtccaaacactgcggtatcattcaatgttttaggaactacagatattgaatatagattggggggatctcttacactcttaaaaaagggccttttttttttttaatccacctgcatgctagaggtgagaattttatccttgccagcagatctctgcaaggcagccccagtatcagcttctagcttcactgtcccacctgaccagcaaagtcaaggatggtggatagccgatcccagtcatgactagttagga

SEQ ID NO: 74323 - DNA, 2933 bp, Homo sapiens
agaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataagtaagtgataacattgcttatacttactgcccatcgtatacactgtagtccttttaatgtcagtttatgacatctaggctaaatttagaggatgtagtcattttttttttggctgaagtatttcttcctttgatttttgaagtcttagctatgggaatgaattcagtgtggaattgttttcatgtttttccccttacttgtctttgtgaaactttctcttttgttgctttttttctctttgaattctcttgtttagaatacctaaaggggcaggacctggatgctatcttgcaggatccttaacattgtcaaagactgaactaggaaagaaagctgtaagtattagttttttaaacactgaaattacctattaaaaaatttcatttctttaaagataagaattaattccacatttcagaatggataaaagagaagatatactcttggggaaaaaaatttaatccttttttcccaggttactagtgaaagtcagttaatatttagttgtcttttaaaatgtatgctacttttgaaatatttaggcttctttttcacaagcctacagtactcaggccctgaacctgtcttacctcctacggctaatacacttgaacttcctgtgaaacatgtaaatacaaatcaaacttggcttaaatacatgtgatatttaagattagaacatgttatagaaatttaaccaataagattggttgtccatataagattatggacataggaataaatcagattatcttggggtgcttttaaaaagtagtcagaacaattaccctaaaacatgtttcttcacacttctacagacctatctcattggaatttcacatggttaagtaggaaaatatgagatgtttcttttggtattgccttttaatttcaaaatgatgctttttttagaaatatgtttctggttgttgtactttagacatatatgttacagttttataagtacctacctgtttttgttttttccttctatgttttcattacaaatttattatgagaatgatgtttatatagatctatcaccttttgtcataataatcattttagctcaatgccagtaaaagttgtcattcttaacagttttgcatttctctgtactattacttcttacagagctaagtaagcctgctacataaatgctgttatcaaaatgagtagttctcatacatcttaagaattatatttattttttgccactattgaaccaaaagccatttatttactgtcattgaagcataattggggaaacttgtgcttagaaagttgcctaccctgacatttcttgggtctcatttcagtttatactgtttatacatacgtactttagtataatttgaagtaaatcaatagttaatggtttgtaattaatacatgcactgatttaagaaaccctggtagttttttttgtagatttcatttcacaggaagcatagctgctccagctattgggcgtcagctgtgaattttcgttcagatgacagatgacactttgaagagtctgcttacttgtgaagagtataacagaaaagcattattagtaaaagtgggcttttagcaattcagaaatagttactacttcccagttacattgttttaggagacaattgtgaaattaaattataaatatgtggtgttaactatggtagctatttatcaagggagaccttcctgggagaaagcagtaacttaaagctgttgagttcattataacttccatcacattgtttatgtaatcttttctcagtggtttagcgttttcttgttttttggtagttgggaaggtaactttcacttcactttgactttcacagtaactttgttgctttttataagaatgcataggcaatggggttgttgtggtaccctttaatcagactagaccatcaactaaatttactattttaagaaatgcttttataagcaatagattttgatctactaaatttttcaataagaagttgacatgtactcttagtaataacatatttgagtactttttcttatgtaaggaatgaaagtggcaatgttgctttctttaaaagcatgccatcttaatcacagacctgagccttctaagtggtgtaacacaggtggaacataaactgaaagacaattagacagaggttctgtctccatcctgtgtagattatgcatgttttcttacagaatgtcgttctaactcccaggggcagtctgcagcaaaacgacaaggaaaatttaaaaaggtactgattgtcagttcttaaaaaagatgtcttaaagccttatttgcatattaaacttttttctgtcactattataaaccttttttttaataagtctcccttagtttcctttctttgcattctaaagtatagtgctcttagctgtacttagaagcattgttgacatactgcttttctaaaggtttttttttttttccccaccataaattcctggatgactcattttctctgtgtatacaaaaattttaatgctattcatttcttgctacagatatgataacaagtagcaatatttgaaatttttcatatttacaattttatagagagatggatgtgataattttttttttttagccatataagctaaagcacttatttttaaagtctaaaagcacttttaaattgggtgatttgattaataaaatgttgcagctttttaaagcgaactttattccctg

SEQ ID NO: 74324 - DNA, 1052 bp, Homo sapiens
atcagtaatgtcctaatgtatacttgttaattagtagtgatatggaactggggaatcaccattctataacagcttatcctttattaaaatgtcttctgaaatgtccatattattacataatagtaaataatttgtccaaacaaaatacagatactaggaatcatctttctggagaaagatctaaagatcagtatttctcaactgggtgtcttgaccgtttgggggccacgtaatgggataaaaacagcatttttttaaaataggaaatgtcagttcatcagactcataaaattgtaatttcattttatgtattaatgtgtatatctttgggacattgtaaaaatagtttgcaagttactgctttagagaacaaggaataggtattctaggaatctattaaaaatagaaggcacttatcacgaaggccatagccaattatttttcttcttatttttgttgaccttttgcaagtttgggtagattttgtttgaattaggttgtatagttaggaaaacactgaatgaataggaaggcatttacttggtgattagtaaagcttcatttgaagaacttggcagctagagttatctctgctcgttcctttctgtcttcaatgcaagtacacaataaagctcttattttagaaataattagtattacagttttatagtcacattacaaagaaaaaaatacatgtataatttccggttgattaagataaatagcattttgtatataattcttaatagattttttcctctgggtttcagtgacttgatttgaaacggtatgtcaccctttttaaaattccttgtaaaatgcaataatatattttctgtttgtttgtatgtttttttaagagacagtctcactctacactccaggctagagtacagtggcatgatcgtagctcactgttgcctccagctcctgggctcaagtgatcctcccacctcagcctccctagagtggctgggactacaggcgtgtgccactatgcctggctaatttttactttttatagagagaggtcttactacgtatgttgccca

SEQ ID NO: 74325 - DNA, 1861 bp, Homo sapiens
cagcatacctctctccctgatacggtgaggaggtgtgggaagctcagggagaaagactggagaccactcttctagcacactgggtggcagagaagctcaattccatggagaatggagctatattaacagaaagtaaatattggaggccacttagcccctttaattcctagatgtgttgtctttgctgtacagatgacactgatgcagtctgtttccataagaacttggtggtagaagatcagctcagattttgcgcttaccttggctttgctcagggcagtgcctacccagagagtgaacctcaagaaggagaggagcaggacaggcagctgggtcctgaaagagctagcccaagcaatagacctgtttccttttcccagtctcatgtttcacgtgaggcctttgtttacaggttctggccccctgacctcagagggagaatgacagccagtggctacaaatggatttatatggttatctgacatcaaagtggttttctgtgctttaaatgagtcagtgtggagataggattattattttgtgttggaatactattagaactacaaccatagttcctgttgtttactgttacatcattttataccccgaaattgtgttggtgaaaatatttaaaatgggaatatttgtgtcgtatatgctcctaaaaatcctatttgcgggaggtgaggacttgcagtattatttttttactcaaccagagtaaagctttttcagtgaatgtctttttgggaacatttgtttcagttttacaaactttgttaattaaaatgaatatagtattttaatttagcaccattttaaatgcaaacctgaagatagaatttgaggaactgacttaataaataacgacttaattaaggacacccagttactgtgccaaaaacaaatctagcaggtatagcatgtgatttcatttcccaaataatgctttacctttcacaagtcaagacttatctgtgaataaaataaatacagttactctccatttctctgctgctgtcttcaaagcaaaacttctcaaaagaatcacagacatgttgacttccattctcttttcatctctgtctcctccagcctggactgctccactgtcccctgacactgttcttgtccgggggggtcagtaggctctgtgctgccgggttttcagttccttccttcttcgtcgtacactgcctctcagctaaatgggcagttgatcattttctctttcttcttggtggtttttcctcaaggcttccgtgatcccaggtgctttttgctttccttttctcactcacagagctgctttttccattcactatccctaactgaccttattcatccacatatttttcaacattgtcagcaacacattggttctacctttaaagaagatctcaaatctattcattttctcccatttctgcgacccatttttagtctaaggcagtgtagggtttcctaggtttgtttcctaacttgttgtcttcttgcctccacctttaccctctataatctattttccaaatagaatacaaaccaaaattttaatccatacaggaaccagagtcattaaacaaaaagcagaaatctttaatcatgtcactgtcttttgtaaaactcttctggtatgcttcttagtgcacttggaatacaatatatagtattttttcttttcttttttaaaccatattctgtcaagccctacttaagttggctgctgcctgctttctcagaagatacagctgtgcttgctttatacccagctcaggtctttacacttgctcatctgctccttgttcattgagggtcgtttgcgtaagatattacctcttcagagtggctttctataaccact

SEQ ID NO: 74326 - DNA, 1008 bp, Homo sapiens
ttctagaaaatgccttcaggcccacccttctctagttatatgctaatttgttggtggtaggagattgggggcaggttgaggagacatactggttagttgttacttattttcctcaaaactcttgaatttctcagtaattatcatcttgatttgtagctaatcagttttaaaacccaattcataaaagcatcgttgatgaacttttttggattttggttacaaaaacattttaaatctcttttagctctctactataattcttgcaatagcgtttatacaagttattaatcttcttttcctgtggaaataaaataaagtaaatggagtcagtaggattcccctcgcgtatcacagaccatcattttgttttagtagacaggtgcttgttctcagaattaactggtaatttgcagtaaagaaccctggaagtgggaagaaaattcttatatggttcagatttttccaacacagtacagtggtgcatttaaagaaggtactcagttactcagttatatttgggaaactgaaggagccagtattgcagcagaggtcaggaatttgaatctgaaattagagcccttgagtttggctcctgcctctaccacttttatgtatgaccttaggcaacttacaaaattttgataccttagtttcttatctacacgacctgccttaggctgtgatgaatgagtattaagtacatgcaaagtccccaacaatatttgctgttattgcaaacaattattgaaggcctatgtgccaaacactacttactactggaaacataaagatgaataagaacctgctttctgtctttgaggaatgtaacagagattgacaaacacttgatgaacatataataaaattgttatagatcattctatttttgcaatactactactatattaggggctatgcattctattacctgtttactgtgtttactgtgtctatggcaacaattgttaaatactttagttgcctttacaatacaaatcagtgtcagga

SEQ ID NO: 74327 - DNA, 1307 bp, Homo sapiens
ggaatgtctttcccagattttcgcacagatttcttgtcattcaaactcaactggagtatcacctccatagagatcctttcttaaccatctaactccccagttagtttatattgtgtcaaatattatttctactgtacacctgataaatatcttattacttgtttattcatttattaatttgcttattatttgcttttcctgaaagtgggaggtgaatttgttcagtgctgttttcccagtgtttgacatgatagttactcagaaaaaatgaatgaaaggaacttaggttggtaggaaggaaaggaacaagtaagttggaaggaagaagggaggaacacaggttaataggaaagagggaaaaggacagttggtagggataatgatgagaacaataggttggttggtaggaaagttggttgatagtaagaaaagttggttggtgggaaggaggatcaatgggtgggtgacggttggtggaaggaaggttctatatgctactaccttactgttactatttaatacagaatttattctaaatactgagcttaaaaatctgtcacttcctttataataatatattattgtattttgttgtagctgatgaagttacttggatggacccattgtgcatcttttactgaaaactggctccccatcatgtatcctcccgattattgcgtattctaaaataggaaacaagactttaaattttaaaaaaggaagttttatagtgaatgggtataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaattttttttttttttttttttttttggcaaatgtttacattcaattaaggggaaaaagtagaaccagcacaaatgagtggcagttgctggagcataactgcttcaataaatcttcatcttggggtaattacaggcaagtcattt

SEQ ID NO: 74328 - DNA, 1023 bp, Homo sapiens
tttgttggatttagtcccattttagtatccccttaaaaagtttgactgatgactctggatattcagccaacagtgttgtgtcaaaaacttgcttgaatttatctaaaaattcatagtcggtgctgaacctgaatttgtttgcccaaagcagcaccgtccctggctgggaaaggtacaccatggtggtgagcagcttgtccaggaagtagtgatggtagaccacatctgaggctaggacgtaatcatagtaaaaagctgacttgggaaagtttttgtccaggtcttccccccataccagttctttcacttcaggcagatgtgctgtacattgtagtgtgttttttaaaagattgtattgaaggtttcccaggacatcaggcaaatctgttgctgtgacttgagctcctaagagaaaaagaaaacaatgacctggaaacatctgggcagtcacagtgtacatatacccagggagaaacacaagaaacaactggattccttagccttggctctattggtgggtgggctggacatgtttgacctaatgtgggctggctaattcttgtgggtggtccgtcccgtgcactgtaagatggtgagcagcctccctggcctccaaccacctgatgtcagtagctcccccacctcacctcacctgtgggattgacaacagagattcagagtcatgcctctggactcaacttcgtcccatggaaactggttgattggagtttattaacctctctgagactcaatgatctctgtagataacagcagtaattcctgccgcatgacattttggggagagtcactgagtgaagttagggccaggcacctaaaccacagcctgtcatagagtaagcacttgctattgttgttacagtaaagatctggatactaggtcaggaataaacaaacaaacctaaaatactggccacaatggaaacaaggcctggtccggcaccaatttcaagtatttttgcatcttggaaattcaattcctcggcatgttcctccaagtattga

SEQ ID NO: 74329 - DNA, 1927 bp, Homo sapiens
attgccttttatttttttagcatttaagatcaatttttagctttttttttgagacagagtcttgctctgtcacccaggctggagtgcagtggcgccatctcggctcactgcagcctccacctctgggattcaagtgattctcctgcctcagcctcccaagtagctgggactataggtgtgcaccaccatgcctggctaatttttgtgtttttagtagagatagggttttgccatgttggtcaggctggtctcaaactcttgacctcaggcagtctgcccacctaggcctcccaaagtgctgggattacaggtgtgagccaccgtgcctggcctggtattgcaacttgttaattgctgccttttggagttaatttgttggtaaacagatatgatgaacagtaaaagatccaatttgccacaccatcactgctactttatgtgaaagtttatatttcaaactgaacttaattttaattgattttaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaaggtgaattataactcaatgtttgtgtcaatgaaagagaatgaaaggcagacatatcttgggagcaagatacttctggcaacagtgtcttttaaaaattgctaatttgactaatgctagttttgtgtcctggttactctgttgcttttgagaacctaaaaatataagtatagtgacaaaatttgtatccctggaaatagagttggtaaatatgacccttacttggaaaatgaaggattaatatctgaatcatctgattttgggattactacactatagatttttttaatcatttcaacattcaggcagagtatttgttataaaattgattcttgagaaagggttggcaatgtctacacattactaaatattagcccaatattatgaaacaactttatattccccagggcatataatttgcttgggaaaaagatttttgggggaagaaatttttttattccaatttattttacattttattagtaataaatgcttgatctgatactgctacagctgagagaagtggactgccacttttacggacatttcctcacacattctattacctagaaagttgtctgagaaagcatttaatgaatacttgggaatgaatgccagtataggcaggggagagaggaccttttattaaatatcaacagaacattagtctagtatcctcttctttttctctttagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaaggtgcttttgtcttattgataggcaactgagaaattttgcagagcagcgttatcttcagaaaaggaaaacatta

SEQ ID NO: 74330 - DNA, 1056 bp, Homo sapiens
ggtacataataagttgcttatggtggtttctaggaagtgaaaggaacttggtggttgggggaagagtgtgtggaaacttctgtttacattgtcttttaaaatgtaccatgtacacacgatacctattcaaaaatgaaatgtattcttcacctcaggaagatctatgaaaaacatattctgtaaattatgaacaaatactttgacttctgtttacatttttttaatgtaccgtgtgcacatgatacctattcaaaaatgaaatgtattcaccttgggaagttctatgaaaaaattctgtaaaaaattatgaacaaaccctttgacacagcgattccttccccaggaatttatcttataaatacacttacatcgtgtgaaaataagtacagtgctatgtggaaggataagtaagaagcagataatattggttacctttggagaggggaatctgatgtcaagtcaagagtggaatgagtgagactttttcactacatattcttggtaccttttgaactttaaaccatgttattgttacctattgaatgaatgaataaataaatgttaatgggaaaaatgggtgagtaatggagatcctgatgttggtaatgtcttaaacaatacaagagctcttaacataggaaggaatgctgcataacaaccccaaaatttcagtggcttacattttatgctcatggatcttcagatcagctgttggtcagatgttggttagactagtctggactccagacttcagttttgggttcagttctgttccgtgtgtcttcattttgagacccaggctgaaaatgcaaaaccacctagagcatgtttttctcatggctgagggtgaaagttcaaaagggcttctggaagtttgccatgcctcagctcagaagtcacacattgaaatgtctacctacattccattagttaaaacaagttacgtagccaagtccaaagtaaacagggtgaagacatatatactctgccttctagcagcactgtgaagttccatgacaagatgtggatgggtaggcttgggaactataatgatga

SEQ ID NO: 74331 - DNA, 1486 bp, Homo sapiens
gatggttttataagaggcttttttccctttgcttggtgctttctccttgctgccatgtgagaaaagacttgttttcttccgcttctgccatgattgcaagtttcctgaggtctcctgagccctgtggaactgtgagtcaattaaacctcttttctttataaattacccagtctcaggtatgtctttattagcagcgagagaatggactaatacaggtggtcaagcaaagaatctttgtcagtgattacatggatgttttcttataattaaattgcagatatatgtttaaattgcagatatatgttttatattcttctgtatgtctatttcaaaattcaaaataatttagaaaaaattatttgactggaagatgaatggaagagagaatattaggtaaaggaatttgtagaatatgatatatggttcagtgttcagatttttagttctttttaaattcttttaactgcatttcaaagtgattttcattcattcatttactcattgtgttaatgccatttttgtgttgctataaagaaatacctgaggctgggtaatttctaaagaaaagagatttattttggttcatcgttctgcaggctgtataggaagtgtggtgccagcatctgcttctggagagggcttcaggaagcttccaatcatggtggaaggcaaagtggagccagggtatcaggtggcaagagagggagcaacacagagagagggggaggtgccacaccttttaaaaccaccagatcatgtgaactcacagtgagaactcacttgtcactgcaaggatggtgccaggccattcatgagggatccacccctaagatacaaacatctcccaccgggccccacctccaccactcagaattacatttcaacataagatttggaagggacaaacatcaaaaccatatcacccattagatatttattcagtctttctagttgctggcactctattagacgttaggactacccagaagaaaggcctggtctctgaggtcatggcacttaaaatctagtaaggataaaatatgtgctgaaggatgtgtaagccggttgaagaaaagagggccaagacattccaggacaagggaaaggcaagagccaggaaggtaaggacacaggcattgacagaactgggagaggactcgttcttccagaggacagtattgatactagaaagtgctgagagatttgactaaagatgcaggtagaggccatctaatgactggccttgtacgaagtattagctagaattaagtttggctgaatacccacaataatatgggcttaaaaggagacaggggttcattgctttgtcatttaaaaccagtctgggcaggtggtctgggctgctgtgcattaaggacccagattctctctgtttttactgctctctgttccaaacacggctaataattagcacaacgtagtcctttaaaataaaggtggttttattataaaattctaaaaatgt

SEQ ID NO: 74332 - DNA, 1028 bp, Homo sapiens
tccgtgatttggtatcagaacacttctcactttggctctaagtgagactggcagcttccttgctccactcctgctcagttatttatcttcatctacgtgattgagaggaggtacccagccagtttcttccactgagtagtagaagttaggggccagaatgatagcttcgtttattttttgctcattgtctatcctagtctttcaccactactgttcataacatgaggcctttacagtagtacagcccatggatgtttgggttccttatcagtaggctatgaaacacaatgtgattttacccttagctgactctgggcctctggaaatagtcccaagccctaaaagcctctagcagcagcttggctccctctcatctttacaggaaaataattaacgaatgtaagtcttcttcacttgtgtaagacttcttgatagctctaaatattttgcttcttaattgcagaccaaagatgaactctgatatgcaaaataacttctattagaataatggtgctctgaagactcttcttaactaaaaagaagaatttttttaagtattaattccatggacaatataaaatctgtgtgattgtttgcagtatgaagacacatttctacttatgcagtattctcatgactgtactttaaagtacatttttagaattttataataaaaccacctttattttaaaggactacgttgtgctaattattagccgtgtttggaacagagagcagtaaaaacagagagaatctgggtccttaatgcacagcagcccagaccacctgcccagactggttttaaatgacaaagcaatgaacccctgtctccttttaagcccatattattgtgggtattcagccaaacttaattctagctaatacttcgtacaaggccagtcattagatggcctctacctgcatctttagtcaaatctctcagcactttctagtatcaatactgtcctctggaagaacgagtcctctcccagttctgtcaatgcctgtgtccttaccttcctggctct

SEQ ID NO: 74333 - DNA, 1036 bp, Homo sapiens
caacaaacaacaacaacaacaacaaaaagctaaactgtggccttgattacactttctctttcaagtagcgttgctctgagccacaagcattgcctccgctagcaatgtgaaaattgtaagatggccagtctggcagaagtcactaacaggctccaggttaaaatgagggattgattcagaagtagatgcagccataaatacagaaataaagagggatggaatgcaataaactttaagctaattgtctcctgaaatttgtgaaggcagctggctaagcttcatcttgcgtttacaaagtcatcagtttgcttggtgtacaaccttgtctctccaggagaggcttagttctagaaggtccaatatgacttttcaaacttttaagtcttagaaacctccctctgatttaaacaaacatactctgttaaatgttctgttttaccatgagactacccccaaagatattatttcccacagttgccccaatgtatacatactctgaagagcagtttgcagatgcctgcatgggaaaaatggattctattacaggattttgtcgttgttcttcctgtaggccaaaaagatagcaaaagcaggacaagaatttgcaagaaataatctcatgggcgatgacatattctgttattatttcaaacttttccaggtcagtattttccaagaaaatcatcacgtaacttataagtagacatgttaagaacaaataatattttacttaacaatttctaaacatatgttactatagggagatatatatacttctgtggatgaaaatcagagacaaatattaagtaatcataaaaaaatagttgaaaaccaaagattagctaatggaaaatgttacaatattaagcgaaaactattaatattagaactatgtgatgtctgactaagaaattggcctctgatcctacaaagttacagtgcatggatttgtatgttctctttgtgttacattgctgctgccttaccatttctttgtctaaacagtgccaggtgtgtttgggcctcttgtcttgac

SEQ ID NO: 74334 - DNA, 2051 bp, Homo sapiens
aaaaatgtattactttttttttctttgaaacgggctctcactgtcttgcccaggatggagtggcgcaaacatggctcactgcagcttcaacctcctgggctcaagtgatcctcccacgtcagcctcccaagtagctgaaaccacaggtgcatgccaacgcacccagctaattttttattttttgtagagacatggtctccctgtgttgcccaggctgctcccgaactcctgggctcaggctgtcttcctgcctcagcctcccaaagtgctgggattaccgacatgagccaaccttgctggcctgtaattctcttaaaatgtgttttcaatgaaaatgctcttcctatgtaactaagcaaaattcatgaagccacattatagatgtttattacaagtttcgaatgctgagtgaaatgatcactgttgtactttgttattcttatgtaaatagggccggtttaccatgagaactgtgactgtcctctgcaagatagtgcagcctggctacgggagatgaactgccctgaaaccattgctcagattcagagagatctggcacatttccctgctgtggatccagaaaagattgcagtagaaatcccaaaaagatttggacagaggcagagcctatgtcactacaccttaaaggataacaaggtacaacacatgattttttgcttgtttgttttagtgattttttttcttgttttgaacatttggctacaattagctaaatcattttataaacatcattcgaatgagcactgtgacaagcttttcctcagtgaagtctgccagcgtctttagactaacataataaatggtaaattctcttttaggtttatatcaagactcatggtgaacatgtaggttttagaattttcatggatgccatactactttctttgactagaaaggtaagtatatattttctcttagctgtaatagataatttaagcccagattttacaggataatttttcaaaatacaaattatacactatcagggtattctcttctggagccttatgataatactattctgaagctttctgttatttcaggtacctgcgtttgtttcctagggctgccgtaacaaagtgctacaaactggaagccttaaaataacagaaatgtattctctggcagttatggaggccagatgtccaaaatcaaagtgtcagctaggtgccatggctcacgcctgtaatcctagcactttaggaggtcaaagcgggtggatcacttgagcccaggagcttgagaccaggctgggcaacatggtgaagacctgtctctacaaaaaatacaaaaattagcctgtagtagtttcagctaatggggagctgaggcaggaagatcgcttgaacctaggaggtcgaggctgcatgagccgagatcacgccactgcactcccaaggcctgggtgacaagagtgagatcctgtccccccccaaaaaaaattaaagtgtcaggaggccagctccctctgagatgatcctttcctttcctttcctgcctcttcctggctgctgtcagtggccctccatctttggtgttccttggtttgcagctgcatcctcccatctctgcctctgtcatcacgtgggcttctcccctcatgtctctgggtctcttcttataaggacacagcatagtggattaatggcccagcctactccagtatgacctcatgctaactaatatctgcaacaaccctatttccaaataaggtcattctgagacactgggatttaagacttcagcatatcttttgcagggacacaatattttatagaggaaagaaaaatgccttatcataaaattattttggtactaaactaactctgagtccaaagatgacttgccttgtactgaatcccattccttgggataatgggcttttgttgggttctagtggaatggtttgaaagtaatgttaaaatggtggatgtgaaagactctaccaacatttttaccaaatgtatatttatttgtaatctattatatttatttgttgaataatttgcatgtatatcttgattaaacta

SEQ ID NO: 74335 - DNA, 1046 bp, Homo sapiens
attatcctgccttagcctcccatgtagctgggattacaggcacgcaccaccatgccaggctaatttttgtatttttagtagagacaggatttcaccatgttgaccaggatggtttcgatctcttgacctcatgatctgcctgcctcagtctcccaaagtgctgggattacaggtgtgagccaccatgctcggccattctgatgtttcttatataggatgagagtacagttttattacctagagccatctccttccctcttacaggcgacagtaccacaagacagtagggaagcagtgtatatacaaaggcagaaatcttgtcccccccttaacaaccccaagaaaagtaaacttttttttttttatttttgtgaactctgcagagaagtaagaaaaggtaaacacttttcaagagtgtctaggttcctttcctacattctgccagtacagcctggtacagtatcacccactaaaccttaaaaagatattccattgtcagccactgcctgggttaggtgggatctgagaattataaaaaggaataacagtaaaaacctcagtgcagactgtaattaatttgttataaaattagtgaagtggactgttttgagaattacttttgcttctttttgttgccgttgttgttgagacagggtctcgctctgttgcccaggctggagtgcagtggtgcaatcactgcttactgcagcctcgacctcctgggttcaagcaatcctcccacctcagctgcatgagtagctgggactacaggcactcaccaccatgccccactaatttttgtattttttgtagaaacagggttttgccatgttgctcagactggtcccgaaccctggagctcaagtgatctgcccacctcagtctcccaaagtgctaggattacaggcgtgagccactgtacccagctacttttgcttttttttttttttttttttttgagacgatgtctcgctctgtcactagcctagagtgcagtggtgcaatctcggctcactgcaagctctgcctcccgggttcaagcgatt

SEQ ID NO: 74336 - DNA, 1050 bp, Homo sapiens
atccagcgcgcggccggcgaggcgcctcctgttaccctggggccggcgtccctcgtcccatcggagcgagcgaggatgctgcggtgcccggcgacaggtcgtcggatagcattgacagcaccttcctttcaaggtgctttatgcctgccctctccacgtgcggagggcagggtgaccaacgcaaaaacctgagctgcgcctccagacccgtgcgcccctttgatgggcatctgtggtgtttatctgtcccccgaaagcggtgaccgagaagtaaataaatgggcgagaggtggtaaaatcctggcagtatttccgctcgtcctgtcgcgaactacatatcccagggagcccggggcgccgggacgcgtgtccaccccgccatccacttggagaaggcgttactgagcctggcccgacgcacgggccaatcccctcgccctacaccttggctggaacctgagacggattcgctcccaaatgatgctccagtggcaggagcaactcaagttcatcattgtcctgagagagaggagcagcgcggttctcggccgggacagcagaacgccaggggaccctcacctgggcgcgccggggcacgggctttgattgtcctggggtcgcggagacccgcgcgcctgccctgcacgccgggcggcaacctttgcagtcgcgttggctgctgcgatcggccggcgggtccctgccgaaggctcggctgcttctgtccacctcttacacttcttcatttatcggtggatcatttcgagagtccgtcttgtaaatgtttggcactttgctactttattgcttctttctggcgacagttccagcactcgccgagaccggcggagaaaggcagctgagcccggagaagagcgaaatatggggacccgggctaaaagcagacgtcgtccttcccgcccgctatttctatattcaggcagtggatacatcagggaataagtaagtcgagaaacggctccttacctattttggatggcggttaaatctgtttctccctttaagatttttctttccaagaactcgttt

SEQ ID NO: 74337 - DNA, 1030 bp, Homo sapiens
gaaagctattacaatacagttctcagtcttgtgtcccaagactgcattatgagtaaggccctgggagacaccagaacaagtctcataattccttttacttgttttctttttgcctgctgattagaagaggacttcatttgagtagttaatggctttttctattaatatcagcagtatctagatggagtgagaggatagatgaagagatgggtcagtcaaagtaaaggaaattaagggaagcaggaagacccagagaaattagaataagagagaaaatctatcaaagaaactctgggtatcgaggaaacatcagctatatacatttaatcaaattcccaaagtaagaacatatacttttataattaatggaatggaataaaacactaaaagggccatggagagagttgacttaggaatcactattctggaattttaaaagatttttgatcaactgtcttgtccaactttaagattttatactataattttgctagaaattctcatttgtagatcttttgaatatctgtactttatttattttattttccaatagtctggtacctcccaagttctttgtgacttatttaaatgtaatgatttggtgcatgtgttaaccagttcccttaataatctaggatgtgtagcattgggtcccaatgactttttttttttttttaacctatttgtttaaatttcctccagcatacatccaaacttttcattgaggaatgggataaactacctattttccttaaatttgttttcttttgttagggggttgaggtgcttactgtaatttgagtaagttttaatatatttttcaagttttattcctactttcaattttttttttccagaatattcgactttttactgcttttctgtgtgcatttcctgaaggataattaatctgcgtacgcctcctggaatatttttgtctttacctttgctaattgggggacccagttaagccctgcttcatctctgatatgttccttggccaccttagccctggattcctctaaattcc

SEQ ID NO: 74338 - DNA, 1030 bp, Homo sapiens; identical to SEQ ID NO: 74337

SEQ ID NO: 74339 - DNA, 1030 bp, Homo sapiens; identical to SEQ ID NO: 74337

SEQ ID NO: 74340 - DNA, 1030 bp, Homo sapiens; identical to SEQ ID NO: 74337

SEQ ID NO: 74341 - DNA, 1037 bp, Homo sapiens
tactccaccaagaaggcgcttttgcacattgttttaatgcttaacgccttcaggatgccagcgtgacggaagcaagtaaccaccaaggcatcaccactggcgctaaacttctcacttccggagtgctgcaagcgcagaaaatatacgtcatgtgcggaggcggagcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttggtatccttaacgccgcgttgggacttggggtgcagggattcggggctggattcctcgcggggctctgccttgggcacagtggcatctgcaggatgatggtcttgggtcggggtcggggtcgctatagaatctctgtcactaggttttctaagtacagtcgtccctcggtatccccggggctttggttccagcccctcctccgtataccacgatgttcaagttccttcaactcccttatataatggcgtggtatttgcatataaactacccacttccgtaatcttttaaatcgtttctagcttacttgtaatgccg

SEQ ID NO: 74342 - DNA, 1063 bp, Homo sapiens
gtttttattggtatgttttatttatttatttttttccatcgcaaatatttttgatccgtggtaggttgattgcggaatcgggtgatgaggcgggccgccctgtctgctttccccagctttgcagtcttagcggcctgtgcatcctggtttgtcactttgtggcagtgctttatgttcctctctgccttagttctctcatctgcaaagtagaggtggtgatagtatctacacacaggattggaatgaggaataaagaaattgcctacatgagagaagtttagtgcgattaatacagtaaatcttaaagttattatcctgtccgggaggtcagtaaggagagcagagtagacttcgacgattagttttgcttgagtcttgccccatttatgtttcttagaggaaggatagtgtggacaggtgttttacccattttttaaattgactttttaaggactattgtttctgtacatgtttggctggttttgtttgtcattggaattaaattcttttttcattagcaaaacgtgatactgcttttgaaatttttatctttttctttgttatgtagtcattttttttttttttttgagtatctattctggctcagaatctggtgataccttacaccaatttcctaaatggggatctatgagtctaggggctcgtgggcttgtggaaagagtcctgtaaatgattgcggggggattggggacgggaaatggagtgcaagagtgtgtgggcgttcagcaaaggaatccctgactgtggagccctaattcttcagtaggtacaaaacttataaataaaacgacattgataagttttaaaacataatgagattatcattttttgcaagtgaataatctttaaataaatctgtaattgatttttggcttaaaagtttttatacagggtactttgaattggggaaagccaaaggatttttgttttgttttgttttgttttttgttttttagagcacatgcgctgttgctgccctcaagctgttgcttagtatcattgcagtctaaagattttctcagaaataaagggtaaaggttag

SEQ ID NO: 74343 - DNA, 1023 bp, Homo sapiens
agtgaaatgagacaagtaggctgccattttgacctggtaatttggagttgtggcaattctccgttctgtgagaatcaactttgctaatgagaaaaaaaagctgtcgtgttgcgtcatgtacactttttactttgattatggtcttcttgactctaggtgagcagccccgccaaggttccttcctttctctcggctgcatttattttccacagcagtggcctgagagcagccaggtcaggtccctgttcaccatcctgagcagggtctgcataatctgtttaaagatttgtgtactttccagagatgaagcactacccagtcttacccaagttcgaagagaaaacgacctctatgttttgcctcctttacaagaggaagaaaaacacaggtaaatgtttaactatttaagaatattattttagtcattgctacattcagacacatttaaaccttgatgtgttatctacatgataaggcatgtgaacatttcttaatgcatctgaaataggcatgctctatacctttcagaatatttttcaaagactaaattttttatttactattctttgtgttttggtgattcatgattcttattcctcttcattctaaagaacttctgccagggctgtggattctaaattctccaaggcatgaattttagttttgcttacactttgcttacacatgctgtctctagctgcttttcaatccagtatggtctctctcaccatgatgctaaaataccacaacccatgacattcttgttgctaaatctagcagacgctttgcacgtcttagtgtgctcgacttctctgcactaaacaccatgccacactgccccgctcccccggcatctctctggcgctttctgctcagcctctctgtggactcctcttcctctgtctctctcttaatggttggtggtttctgtgtttgaagtgaaggtggagaaccggaagcttggcagtttgcctttgtcccctgtccttccctccacctcttcctttcccaggagttcccaag

SEQ ID NO: 74344 - DNA, 1053 bp, Homo sapiens
gcgattctcctgcctcagcctccggagtagctgggattacaggcacgtgccaccacacctggctaattttttgtatttttagtagagacgaggtttcaccatgttgtccaggctggtctcgaactcctgacctcaagtgatccacctgcctcggcctcccaaagtgctgggattgcaggcgtgagccaccacacgcagcttagcttctcatttctttaggataaaactttaactccttaattacactttccagtcttatccctgcctttcttcacatcatccacaggcaggctttcttttccttgtttctatatggtcatacaacttagttcttttgcctggaacactcttctccatgaaccttcccgctccctacaactacactcattaattcgtggctaactccaaccagtgtaattgcaggagatcctggaaagcttttgtgactcctaaattgggtgaggtgactccctattgcatctctagtgacctgcccttcccttgtggtggaagttattagatcccactctaattgcttacttacacgtgtcccccaccagaccatgagaccagtagtggcacagatcttgctgttttattcaccactgtagcccgtataacgagcagagccttgcatacaagtatttttgtaaggggtccttaaaaatcatagatatcgtaaaagtatgtttgactttcagttcagaagaggaagatgaaaaagaatggcaagaaagaatgaatcaaaaacaagcattacaggtatttagatcatttttgaattcagaatgtattctgttatttgaaatgaatgacatgaaaatgaatattaatgaggtatatcaaactgtgaaagttcctgataaaaagtaaagacagatggctttttggttgtgcatatatatgtgtacatgtatgtatttaaaacacactcacctacacacgtgtatatatatatatatggaatttgccattatgcacatctatatattcaaaacaagctatttttcttttacaaccaaccaaccaatagtaatatgtgcttacatagaa

SEQ ID NO: 74345 - DNA, 1048 bp, Homo sapiens
gatctgcataaaaatgacttttctatctgtgatattgtgaagaagcgaaaagaaattggtgctagttttgctgccgtaccataaactgcaaaagtcatgacctcagcgtgtgataagtgctcagttaggatggaaaagccattacattttggggtggaagacatgaagagaaacatgttctgattgatgacaatcaggtttggtacttctgcagtttcaggcatcctctgggggtcttggaacataccccaaggatgagggggctgtctactatgttaatagaatcaattgtagtaaattgacatgcttttgatcccagatctaccacttattagccctgtgactctagggaggttacctaacctatttaagtcccaatttcttcatttataaaatggaggtgatatctgtttcataggatgattgtgagaataaaatgaggtattatatgtaaaagcacttagaaaaatgccctccatgggaaatgccttataatgttaagtattactgttaataactgtgattactgtgatttattgtgtcttttatgggataaggttgtgcaggacacttcacttgcatatttacctacattctagaagattgttaagccataatcagatgtcatagtgactgctatgcattacatgctcaatacatgtttattgaataatgattaaatcataaacagtattcatgatttttttttttttttttttgaggggaagtctcgctcttgtccctcaggctggagtgcaatggcacaatctcggctcactgcaacctctgcctccccggttcaagtgattctcctgcctcagtctcctgggtagctgggattacaggtgcctgccatcacacccggctaatttttgtatttttagtagagacagggtttcaccacgttggccaggctggtctcgaactcctgacctccggtggtccacccatctcggcctcccaaagtgctaggattacaggcatgagccaccgcacctggccatagtattcatgatttttttttgcccaactctttcgaagattattt

SEQ ID NO: 74346 - DNA, 1048 bp, Homo sapiens; identical to SEQ ID NO: 74345

SEQ ID NO: 74347 - DNA, 1048 bp, Homo sapiens; identical to SEQ ID NO: 74345

SEQ ID NO: 74348 - DNA, 1048 bp, Homo sapiens; identical to SEQ ID NO: 74345

SEQ ID NO: 74349 - DNA, 1049 bp, Homo sapiens
aggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggtacgtgtctgtgcttttgtagaaatctggaacggtaggatttcccctctgtaggaattcagagatcggttagtgtagtcccgttttaactttttacagataaggaacgagagacgtagaaagaaagatgaaatgactttcccagggagtcacagctggtcatggaatcttgaccttccctgtgttgctctgctttt

SEQ ID NO: 74350 - DNA, 2928 bp, Homo sapiens
tgagtccgagagcctcctgagggacaactctgagagggacgacgtggatggtgagccacaggaagctgagaaagatgcggaagattcgctccatgaatggcaagatattaatttggtaataccgtaacattgtgtttcgacttcttgctgaggaagccaggttaagtaggttttgagttttaaggagttggtggatgagtatttagtagctatttgcagtacatcttgtggttgctgatggcttcatttttgtgtaggttactggctgggatagactccgttttccatgtggtttagtgatgaatctctaaagatattacagagtcttggttagacatccagtggagtacttcctaaggagaaagagcttattggtaatttcagtcagactaaatgcaggctttttgtaaacaaaactcatttggattattaatataaatctataaatgaaaaaacattttataggaggagttggaaactctggagagcaacctcttagcacagcagaattcactgaaagctcaaaaacagcagcaagaacggatcgctgctactgtcaccggacagatgttcctggaaagccaggtgggtgcaggcagcttgggtttcctttaccaccttcttcagacccctgggggaatgcactgcatgaagggggtatgcactgtgccccctggtgctcagggcctggtgatgccgttccctgggggtcactgtgtgtccctaactctgcaggaatgaatgcattacatgaagtggtaggcactgctccccctgtgctcagggcctggcggtgcccttccctgggcgtcactgtgtacccctcactctgcaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggtaagacttcagagtctttttgattactttctgacatttaccttcagagtttgtcctaggaagttttctttccaaggaactagtttgatgcattgatggaaattgcaggtctatgcaaatttttatatgagtgatctttggcttatatagaggaataggattttaaacatttgaattaaggaattaaagtcctagtatgtttaggtagttaatcaactgacttagttaaactttgactagttacccgagatctccacagtgaacaaaaggtggtggagaggggaagcaggccgcgcctgggcctgtattcgggtttctggcactgatcttcttctgttcatccagcaaatatatgtttggtgactcctatatgccagttgttcttaacaagagggaaggaacagagagtaaaatagtaggagaaacagatgataagcagatacataaatcataatttgacagttggtggtaagtgccaaatagaaaaatataacagtaaaggagaggagagagtgaacttcaggcatcgagagtgcaggtgctgtttcagagagttgttgggaaaggctttactcgtgtaacttcaaggcagggacctgcaggaaataggaagcaagcactgtagatagatacctcgggactagtgagtgaaaggggctgaggcagaagcttgtgggctgtgttctagggaagcaaggaggccagtgtgagaggaggagggaggaaatggcaagggttaatcttagagaataggaagaagctgaaacccaccagggtctggtgtgctagggtatgcaggcagattgaatgtggggtgggagaagaatgaagtcgaggaggattccagatactgagcagctggtcgagtggacctgccttcagtaagacaaggagggagcacagtggaggaggagaaacgaagtgttcaggtttggatatgataaattggggatgctcattggatacccagtggaggtgttgagttgatagttgaatatatgtgactgtggttcagagagactcaggctagatagctaactttgggggtcagcgtatagagggtatttaaagctatgagaatggatgaaactttaaaaatattaacagaatgccattgaataaaataatttattttcaaataataagatatttttggtggttggatatagatatagatatacacacgtacatgatttatataataaaatgtttataaatgtcatataagaaatcttgataaaaattaaaaaatattgttactctttaggattggaccggaataagttaataaatttggcttatttgcttggaagtgattataccgaaggaataccaactgtgggttgtgtaaccgccatggaaattctcaatgaattccctgggcatggcctggaacctctcctaaaattctcgtaaggtcttttatttctttaatttggataattgtgtaaatacccaaataagcaaatagaactattatttacagcatgaactgtcatgctgtaacatgtgaacaatggttcactgagaaagcagcagaaagtattggttgttttccattttctagagatgatgaaatcagagtcagttcttagtggtgctgggcttatcctagttcaagggtacaaagccagtcctgtggatttcacaggaatgtagaagttgccttttcatccattgacatacttatagagcagctatgatgtgtcagacactgtgctggccctggggaaaggagagatgagtaaggcataggccataccctcaaggactccccccatatacttggaggtgatggagaagcaaagcaaattgtacttgtctgtgtgtttggtgtcctgagagaggtcagccaggaagcgacttggaaatataatgc

SEQ ID NO: 74351 - DNA, 1125 bp, Homo sapiens
atagtaatccaatgtgagtgatcaaggttgagcttgttgatttggtttagaaacttgacttacttgtctgatttattattattattcttttgttatttttttagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtctttgtatttagtgtgtggttcctaaaaacaaatgctaaatctgacatttgttttttaatgttttacttttctagtattttttagctgaatatttcaagtatcattggatattatcttgtattcacaggctttgtcttttcatgttttcattatcttaacaatgtctgatccttcctggtcacatgttaaaaaagcgaaaaagatttctattgatcagcactcactctcaataggctttccctctgacattcagacgtagctgagaagaaatacgtgcatgtttctaattccacaatagtggcagttttacacaactgtttagccctgctgcc

SEQ ID NO: 74352 - DNA, 1046 bp, Homo sapiens
gtgaaggttaacctaacagttaaacaatgtttggttctatttccaaaagattttaatatgactccgtctctgaaaaataaagcagaagaagtactgcaatcagtacattgactggaccaacaaaattagcagcattccatttgagataataactcaaaattacttcctaagtaagactccatgtacttttacaatttattactaacacaaaaagattgtacaaatataattaatcttctgactcacagaattttggtaatgcagatttcattctgacagcatcacagccaatgcattgccatttttaattcacaagtaaaaaatgtattattccagggttctctagttattaaggtaataagagtaattaacagcaccctgctggctacacatggcttggactgtgtgtttccgggtttgggtaaatgggtggcactgatcaaagccttcttcctgaatccctgttgcctcacattgtggtagctgtggctatagagaatccccaaagacaactctggaaaagacataagtatctgggaagattttgcccactatttcacagcagaattcaaaacctaagtgatggccctatggcgatgctcagagagagacataaacagtgcaaagtgaaactgaatatcattttttctgagattaaggtaatgccttcatctaatagtcatttaaatttttcaatatttctactataaaaagtaaatctatttcattcatttcgttttttgaaaaacattaggtgtgatttgtttgttattttacaaaaaaaaagaatattccttcaatccacttagctagtgtaaaaagctacaggatgaaatgcccacgttttgagatactcatgactcaaaacaaacaaacaaaaaaaacccctactacactcttttccttaagctacttatgcaaatgttaaatttttttaaataaatctatttgctattagcgtccatgaagatgctaagcttaggtccacctcaggaaaattgttattgtaaaacatatgatgtgtgaaaacctaatatttcagtttt

SEQ ID NO: 74353 - DNA, 1075 bp, Homo sapiens
aaaactgactcctcaaaaaataacaaaagaagttctaattcagtctttgccagtttccattgtgtaactcctcccaccatccaccatgatgcatttcaggtaagtggtgaatgtgggcatagaagaggcatgcaatgggcattcaggagcccaagaggtcggctccagcacagccctggaccggctcctgtatggacaatacaagagtgagccatattgagggaggagataggaaaacaataaaaactgtcaggaggccacaaaaagcttagcattctggagtcatctgatatacgagcaaatagagtcattctcagcacaaacccagcatgatcatttatcagcgtgctgaggccctgaataaaaggcaaagtcagcatagcactgagattgagagctgcaatgccaaggctgacatccggccctgccaattgctatttagttgtgtgacttggtgctggttttggagcctctctgggcctctcagctcctttttctctaagatctgaggctcactgcatctgacttaaatggtcactgggagggtaaactagttactattggtgaagcatctgggaggtgcctgacacataaggttatgagctgaactgtgtttccccaaatccatacattgaagtcctaaccccagcatcccagggtgtgaccctgtttggagataaggtcttcacaaatgtgattacattaaaatgaagacattagggtggacccccccatgacttgtgtccttataaggagaggaagagacaccaggtctatcagaccattcttgcattgctataaagaaatgtctaagactgagtcatttataatgaaaagaggtttaattggctcagagttctgcaggctgtagaggaaacatggaactgttcatctgcttgtcttctggggagggctcaggaagcttgcaatcatggcagatgggggagcaagagagcaagtgagcaagtggggaggtgcttttaaataaccagatctcaagagaactcactcactattgctaggacagtaccaagggggatggtgctaaaccattaataagaaatggaccccatga

SEQ ID NO: 74354 - DNA, 1050 bp, Homo sapiens
accactgcactccagcctgggtgacagagcgagactccgtctcaaaaaaaaaaaaaaggaaaataaattcttctgtatttttctttcttcaagtgaggccatttaggggaaagtataccataaaacttgctctaagataaggcaaatttggtattataggatgaagtgctatgtgatttgaagtaatgctgaattttttaaatatattaaactaaacaagaataatgaggccctcggaaagtcatgattatatttctcatttttctcattttaaagccacagtgaaaaacacataaaaggaagaagttagaaaaaaaaatgaatgaaattctttttttccttttggcaaattaaatagatgtttctgtttcagaagattttattaattaactttaaagaaacagtcatttatttttggcattcagtgaacactatcatttccatgtttagaacttttcttctaagttagcatcttaaaagataactgtgaaactcaaggcattcaactacattaatttgagtttcagaaattgaattcttgtttctagagtacatagtttgaattgatgtcagggtgttaaatagataaatcttagcttcctaggttgtatattcacactaattatttttttatcagccttcttatttttcaacttaccttattctttttgtttttttgacactcagatttgatagccctgtggtagaagaaaacagtaatacagtttggtttgttgttgtgtttgtgtttattttaaagtcacggctttgctttccatgttgttactggattatgctttttttaattcttcagtttgccaagataacagtcttccgatcttcagaagtctgtatcaagcttaaggaaactgatgtgtaggaagactcgcctaagaagtccaaattagcaaggctagcatgtgaggacatgctggaaaagaatagttcccatagatattgacagagaatgttcataaaatgctacttgttttgtggttacatgagagtaacttgtgtccagtgcagctgtatgtaagggcaacgttttta

SEQ ID NO: 74355 - DNA, 1013 bp, Homo sapiens
atgttattgtgtgctggtttctttccatggagaggaaaaagagacctgatgctttggaggagtgcttgacttttccccagtgaggagtagtccagagggactgacttgcattggggagtaccctacatgaacagcatttcagaagaattaaaccaggaacctagagtcctacttgctagtcctgcttcctaagcttaatgagaaagtcaattttatttctttgaactttaatttatttccctaaaaaacgcttttagtattgtcattgttctggctaatgatggcggtctcctccagtttcaagccaccttagggctgggcatacaaatgcaatataggatcacttgttagtgtggtttcaaatggacatgatcctctgtaaattctttaaaaacatttaatttgatttgtggtgttacctgctttaaaatatagtcatcacacttgtgagtttcagacgtgaatatgaatttttaatttgaactgtatttttaaacacactaagtattaactaagtccccttaggagatatgtggcaaactgatatgcatcctcattcattcttctcatagatggttatttgttttttaacttgtggcaaaattatatatgaatggtcaccgacttaaaatagttccacttaaatttttcaactttctgatgggtttattggagtattaaatgtattttcaatttaatgatattttcagcttaccttgtgcttatcaagtatcaagacatagccccacctaagtcatggagcatctgtatatgggtttttattcttgtttagaattgactttttcaagtgacctatttcagtaattagccctgggcctgatttgcataatgagatctcctaatcttcaagtaatgcaaagatggagatattatggccatgtggtctgaagagaccttttctttattatgttcagatctttaattgccttaaaaatagagtagctaatttacctaacctctagttattttattattgtctttaaagttttttt

SEQ ID NO: 74356 - DNA, 1039 bp, Homo sapiens
taaaaattcatattcacgtctgaaactcacaagtgtgatgactatattttaaagcaggtaacaccacaaatcaaattaaatgtttttaaagaatttacagaggatcatgtccatttgaaaccacactaacaagtgatcctatattgcatttgtatgcccagccctaaggtggcttgaaactggaggagaccgccatcattagccagaacaatgacaatactaaaagcgttttttagggaaataaattaaagttcaaagaaataaaattgactttctcattaagcttaggaagcaggactagcaagtaggactctaggttcctggtttaattcttctgaaatgctgttcatgtagggtactccccaatgcaagtcagtccctctggactactcctcactggggaaaagtcaagcactcctccaaagcatcaggtctctttttcctctccatggaaagaaaccagcacacaataacatatttattataacactgctcgttctgaaggcgcttaccaactagacactcagatttggggttaaacccatgtagaatttattaaagctgaactcaaatgctaatattatttactgtctcaaagtgaaccaacgatttgaagtgttaaaaatatacatgtaaattttaatactttccgtcatgctacctagcactatttataaatgtactgatataaaaattactaacttcaaacactttccttctcaaaaaagccagtacagagcttgactgtgtgtgtgtgtgtgtgtgtgtgtgtgtgtgtgtgtgtgtgtgcatttgtctgatatgcaaagtagtgactttttaaaatccattcattgttttggtgtcttggaacttatgcagaagcaatacaaagtcaatattaatttctaaaactattttaacatttgttctctgcatttcccatttcctttctagggaaacttgtagatcaatgagctttgctgtagggtgggtgagaaattggcttctatattttcccaagtatctgaaacgccttcctctgcctacgccatcgtgg

SEQ ID NO: 74357 - DNA, 1069 bp, Homo sapiens
tcctggcctcctggggaagggttgcacatctgagccgtggtctcagatgactgcctcggaagaagcctcttcccttcaggcaccactgatgtgtgcttggtgtggagctagactttccctggctctccatgtgacgctcacatgtgcgtgtcttgatttcccttaacttcatggcttatctatgaacagcttgatttgggggaaaaaaatgtgtttcccaatgctggagttataattgaatgtgctgcagtcaaaactgaaatgtgtgcagagaaagggggcttttcctgtcatgctcattgggcaccagtgtgtcttcacctgttttgtgtgttaggtccatgcgtcatgctgaaatgaagaacatgggatgtatggggctttggacagtgctgagccaaaagcaagtgctcaaaagcagctgtgtttgtattattagtggttctggaggtggctgattgccttgcattttaagtagagagggattgtagaagactgccaatacttagaactttttccagagaggaagggtcagaaactgcatctgcagggctccttgctctccagaaatgccagtgtgcctgggagggcatcttcagaaatccagtctctcctcctcagtgtgtcctgtaccgactcagtggttctgtcttcagaattcctatcatgtctgtgatctgcaaatagtggtatttaatttgacttcaatttgtataaatgttagcttctatttgttcattcctattttttgttcaattaatacattatttattgagcatctactctgtgtcagccccttgggtgtttaatactgaattagtcacatgtgggacttgcctgccctcagggagctagactataaattcctaatgatcagtggtctccacttttctgtcactcataatgtctggcacaacataggttacttgagttgttacactcacagtactgttgtttgctgccatggtgctttaggaagtgtgagagttcccgggaggcagagtcaataatgcagactacacgtagtgaaaacatggccaggagagctgtagttcaggctctcagctca

SEQ ID NO: 74358 - DNA, 1035 bp, Homo sapiens
ctgttattgcagattcaagtttgacaaataaaactttcctttagactgtagtttaattactttttttcaaaggtatgcgtgatgaagaggcacaaatacacctcaccttgaagagttgctaaactggtttgtgtgccgatcagttcaccgtgtgtttgaatttctgtgcttctcatctttccttttcttgaaaagattttgcttgtcattggtgtgaattgtaccccccacccccacccatctagtctttgctctcagatttataacactttaatggttccaaattgtatagcctgctcttagaccccttttcttttccttgaataaatcaggttcatgttgcagacgatatttgttttaggaaagtgtgaaagaaggggcacctgtgaaaacacgcaattgttccaacacacatatacatccaaattaaagcagaaaatgtcaaagcctccaatcactaccttatttcttggaggtttaaagccgctgagaagatagtggtgccctcgctggaagttttaaggtaattactttttactctaagcagtagtatctggtaacctaattccgtataaacctgacaccctatcgctacaccccagtatttctctgatttcagaataagtctgcgtagaaacttgttctgatgttaaagtgcaaaagggggcagtaaagtgctatccacaaaaaaggaaaaacattttccaagtatttcttattactgcctgtgtctttcgtaggccctgcctttatttattcattttataacaaaactcttatgtttggggcattcagagaataccttattaagctgttgcagcaatctagcattaaatggaagacatgcaagactgaagatcctgcctgtttatgaagtgtgccatcaaattcacatgctcatgatgcagagtccttctttgggagtattcgtattcccaagtgcacagagcacttcggaaaggagccttggtctttggtgttaatgctctcctagctccgtatagatgtggcaggcccaaagtacatggtggggtg

SEQ ID NO: 74359 - DNA, 1183 bp, Homo sapiens
ctgggattctggcttcttgccggtggattcattcagtacagcccatctggcttttgatgttctgcaagtttggagccatttgttgaaggaagccaggcggtgaatattggtggtcctggggttctcttgactccaagtggtgccccttggtttgcattttcaccatgcttagcatctgcttacctggagaccatgcagccgccggccagaggtctccaacaaccaaatcttcatgccttttagaactcagagtccccagcacatcctccttcctcctccttgtccaattactttcatgcagttctcagtagctgcttgtttgaatcacttatagtatttaacttctagggtgtttttgggttttggtcaaggtaattccaggctgaatgtggtgactaagcaggaaataaatgggtcgtcctcaaagttacagtggagcgctgtttctattttcctaaggtacacagttgtgggggcgatccgtatggaagtcaggaacccagtctgattttgcttccttttgatggtagcagtacagacctggctgttttgtagcctgctttgtttttcttccttttcttccctaacttcacgggctgtggcaaagccctgagacgtgcaggaaaatgtctcctgtcatacgcccacagcagacctagccctgaccctcctctgaagcccaggaaggaggtatctgtgaagcagcctgcttgtaaagcaattgcacacagccttgtaaactgtgttactgggctgattatacttgattggcaaggtgaatctcttatagcaaaagagaacttggagagttttatctcatcttatgccttattaatttgttcattctttaattacacagccacctattgagcaccctatttatgcaaggtacctggtcgggggtcagagggagggtcccatggtaaacgagacagactcaatcctggaggagcaggaatggcagcccctcgctgggctgttggccccaccaaaagggaaaggtttcattttaataatacatgggtgaatcatttttgtcaataggcaaaattctttgtagttaaaaaaaaatatgatggtaggaaggaaagggatgggcagagggttaaaacaaaagatatgctctccctaactctagattgtagtattgttatgcttgtcactgtagctgaattccatttct

SEQ ID NO: 74360 - DNA, 1082 bp, Homo sapiens
gccttccatactttccatttcagccattaaacaaaataagccattgaaaccacgattgggttccatgcagagtgacatccgcaatcgggtcaagccagaaggaaatacttgctcgattgccccctatttggcattacaggaaagtctccacactttggaagagtctgaactctcaagacattgaaaatgccaaaggctgcaaacaccctgtgtctttcttgatggagtgcatcttggtgtgttttacaaaggggaattcagtgctgtttttttgttgttgttgttgttttttttttttaaagagcagcatagggcccttctagactcttggattctgtgtctgacaaaaatggtcattaaatgagcaatattataatttagacccatttcactgattttgttccaaattctcaactgacttgagcatctgtttggggctgtagatacattgcccttgttgactgtttttctcgtttctatgggaattactgtagccattactatgtagctttcatagactcaaaacatttttaaagtattgcatataggctggccatatccagtgcctgttactttaccttctttttctaacttaatgcagcagtctgtattaacagatccatttcatttgtctagcttcatcagagagaggctaccccctgatttacaggctgctcacatccaagcaccttgcattctacacttgacagtgattgctaatggcccattcaactaaagtatttgcttgttaacagggaacagaacatgataaatgtccagcaagcttgctgcctccttcagcttttcaaacgcagactggtgcatatttatggcaggcaaatgacaaaagaaaaagctgaattgccctggcctccagctttctatcagaaacagggttaaagtgattaaagcaatcattcaagaaagccctgccgtttgtttactaaccttcatccaacatttagctttgtagtctacctgtgagaagatatttcagaagtattagagataaggaaggaggatctagcaaaccagtgaaaagagtaggtgaccagttataaaatgctttccatgcacattga

SEQ ID NO: 74361 - DNA, 1486 bp, Homo sapiens
aattggtggatttatattaaaacctcttgtctgtaaacttactgaggtgcatccttcggttggtggatcagtgagataattgccttcagatggacattgcaactggagcaactaaatccttgctgtctttccttcctctgaaatcttccaggtagctcccgagagcttcagtatgacaccaaacttcgggcgacgttttagagtgcgttcacctaatgggaaactattcgagatcccagcgtgactgcagtaatgcgtcataggaatgggagtggcaggggaaaaggaaatacagattgtagaccctaataaaaaaatttttaggaaagatatttctttaacgttttatgagaacttcattcttaaaatacttaattgcaaattagacaaatagaagtgctcttctaaggaaggtgattaaactggtcctcctatcagcctaatctctgcctgcctttgctgctgacataaagaacctgtttttcaggtcacttaatatacatctacatagatttgcttatgagctcaccctttgtgtagcggagtagagccttaaagaggagtgctcaactgtttaaaatattttgattaaaatatgcagaacccatagaactataagcttctagtcaggaattagctctttcagggaacagctccccccttctttttaaggggggaattagaaggaggctgggggaggaatataagaacagcaaagaaggaaggatagcaaatgggacatgttccgaacagcttggaaaaactcctgtggcttcattgtctctataaagccaaagaatacaaagacataagcaattcagcccttctcccatgatggaagatgtaaaccgttgacatgcctcccctgtttaacttgtttaattctcattttaaattcagcacgatactagccgtgtgaactctgaagatttctttagtaatccattttgtagttccgaatcaaaaacaaagtgaaagggtctgacacaatttgcttttatttttaggcaaatcaaccctggtcatagttaataaggggattacaactcagactaggtctttacagatgtgatgtaaatcaagggcagagtataaagaaactgatcccttttgattgaagtatagtaaaaaggcatagagaaactagcagcagtaatctgattgtatggcaataaaaccaccattttctgtctttcagataaaaataatgtggtaaatccatgcagttcataagatgtaaaggcagataaagggtgaagccatggcaacatatagattagcttgatgttagaaatgacacgtctctgaaaagggcgcgggacgaaggcccttgcctccaggctgttgggcattatgtgagaaccacacagacttggaaactgggattaggaagtatgaaagctctacttgtggtctgggatggctgaggcagtaaagaaaagctgctcagttcttgctcattggtggtggataatatggcaaaggt

SEQ ID NO: 74362 - DNA, 3346 bp, Homo sapiens
aggaaaaaggttttagagagctgtatcttaaagatacattttagctctctgttggattttccaccatgctcacctgccagattctctcactgcttgtaattctgatctttgttatctccaaccttacttgactgcggttgatttgttccaacacctatcttttagtctacgtcacattgctgtctaaacttctttgcgttcttccctttttgctacttaagataaaatctcaacattttttattgcataccggagtcctgttaccttttccatcttcctctgccataaatgcctgtaaaccagtcactttacactttatttaaaaaatacatatatatcaatggagacaaaagaagtaattagtgtgtggcattagagaatgtatcagaagagagaacgtttttaaaagacttaagtgaacagaagaatttatttgaataaagagaaaaatcactgaatttgatagattttgaccatacagaagaaaattttagtagaataatggagatggaatcaatgacctaaaatttgactttgaatgggaataggtaggcagctcaaaggatgcagcgaatgttttaagatcactgtcagatagaggggaaaaaggataaatcatgataactgatattaaaaagggttagagcaggctttctcaattttggcactgattggatcattctttgttgtgggagctgtcttccatattataggatgtgtagcattgtcccagtcttccacccactagatgccaggagccattcccagttgtggcagccagaatcatctccatgcattgcctaatgtccccttggggaagggattaaaattgtgcttggttgagaattgagaattgaagatgtgtgtatggtatctctaggaagcatgagaagggcctgactttggtaaagagggggaaatctgtggaagaatgcgggaaagaagttgcttgacatggaaggagttgaaggcactgcaggagtggaatcagttataccagtgtccttttgaaattagatagcactttatagttagtcaggtcagaaggttttgtaatatttttcttcaggtaattgggtctgtcgtgtttcttggttgtctactgatactataatatagtcccttttttttcagcatgatttgaccacacaaaaagccccagtggagattttttcctatgtttctgtttttttgtgtgtgtgtatgcccttcaactataaatatggcaattggtagataacctgctctttgagtaaatctgtacctcggtttataattaacaatctattaatctggtacaatgaagttagagataaaaataggtatagaacaaaatctgtcatctcaacatgtgatttgtggaaattaatttccacttccaaaatgtgtaaatgcttttccataatttgttcatttattttcattgaaaatgaaagacagaaaatgtagatgtaattaataaagggttctcttttaattttcttaattcttttttctctaccaaactatgtgaccttcgtcagattttatgacacatgccattgtgtgtaagttgtcacctcataactaaaatattttgaaggcatgtaattcataggaagtccttgtttttacccccttttttgcatttgcattaaaaatttttttgtagatacataatagataacacctgttgcaggggtacatatgataatttttaatacatttctataattaatttttacttttaactttcaggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattccctttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcatatgttgaagcaattttttttaatgttatgttaagtcttaaagagggtggttcactttttgatggtcaaccatttagaagtcttagaactatatttcctcttgtttatacttttaacatagggtttatatgtacattaaatatacttgtgaattagtatttaatggctatttttacaaatatcaactttatgctgatagagcaaatggcatcagtgttacctttaagaaagactaacaacatccagaagatttaaattctcaaacctgtgcctctgttttaggatataagtattatcacaaagtatacttaataaaggctagaaaaatgcttttaaattatggaatctgagatcgttttcagagtgggccatcagaaagaacttagctttatactgtcaaaaaaaggctaagatggtcgagtcattttcattgtgtagtgtacttgcacgtttatttttaggacaaacacatttgaactttatgaattttttttttttttttgcatgtgaaatcttatgaatggctttcattttatacactagaatctgcctcatttactcttaacatatgtttaagtatactggtattaaaacattcaagaaaaggatattgatctaaaatgctacctgagatgcataaacatgtcatcaagtagagaaaatatttttatttttgcccaatattttttagacagtttgattattcttaaaaattgaaaacataagctaaagagatgactaaatggtagattattttgtgtgtgcatgctaggaa

SEQ ID NO: 74363 - DNA, 1432 bp, Homo sapiens
ccaagatcgtgtcattgcactccagcctgggcaacaagagcaagactctgtctaaaaataaataaataaataaaatagggcagagattactgggaggggtaagtaggccttttaactataatggaacatttttttgtgtgtgtacttcttaccaccagtcactctttagcttggggtacaaagttgaaagccacctttgtgagattgaacagggttatgggcataatggctaggagggtctgccccagtgtattggttctggtattgtggatgttagctttctccttggcctccaagctgtccactacgtaatccttgtgagtgagttgcttagtattactcatctgtataaatacatatatgcatccccaaccccccatgcaaatactgctttcttgtgcataaatgtgaaacaagcagggaaaggagcaatggttgtattctccggcaagtcaagtcatcaggaaagaaaaagttactacagagagagggtaggatttaggaaaatacctagcaaataaggtatagggtcataccacacttacaagtggtggatgaacaggaaaccagcttttatcacttgagagactatattaaaatgagagatgacggttgttagtgtttgaatagtctttttttttgtcaaagtgtaattaagatttatgcctaaagccatagtagaacaaaataccaatatttgtatatagacagtatattcaactaatttttaaatcattgcattaaatacttctagtaggcactgtatgcctagcattggtgattaacattgttgagccgtagtcccggagaaaatcaactctgctgtacatacatacacaacacacttttgccttctgtatttgtagacctaagtgaagaaacttgattctttacccaatctaaagtgcagaattagtattttatctgaaggaagttgctttactttaaaaatcttgtttttttaattaggcaaaatgatcacatggttcaaattttgtttttttaggaagagaaacagtgaagtccctttaccttacccccaacccaatccccaattcccaaccccgtctccaaaagtgtactcagttacgggtttttaaaatcttttcagaatgtctgtaaaagcatattcaggcagatacaaatgcataatattttaattctccctttattgcacaaaagtagcatgtacacaaggaactttctttttttcatttaacagtgtaacttggagatttttccattgcggaacataggggcctccttttttcctcttacttgtttttaatggctatacaatattctcctttatatatcttcagtaatttatttagtgtaccccatattggtggatatttgggtttttttcacattcttttctttctataaactgtgttgtaatatgtaaccctgtaaatatatcagtttcgca

SEQ ID NO: 74364 - DNA, 1056 bp, Homo sapiens
ccagagtttgctttgcgagatggctttcttttaaatgagtttgtatgataggctgaaaaatcccttctgtcctctctccatgaaaaacaatctgtattctagtgcctggaatttgaatgtgcccatatatgacaaggagggcggggcttttgcagatgtgattaagtatcttgcaatggggagtttattctggattatctggtgggccttaaatgccatcacatgttttcttagagaggcagagggaaattttagcatatagcacagacaggagaaggaagctaagtaaagacagaggagagagatttggaaatgttggcgttgaagattgaagtgatgtaggctgaagccaaggaatcctcgcagccaccagaagctgtaagagacaaggagcagactctccgctaaagactccagaaggagaatggacacccttctgacaccttgctttcagcccagtgatactgatttcagactcctggcctccagaataaatttattttgagctgtttagtttgtggtaatatgttacctaaaaatgtggaagtggttttggaattggacagtgggtagaggctccagttttgagtcacatgatagaaaatgcatatgttgcctttaaagactgttggcaaaaatatggattttaaaggtgcttctggttagggctcagaagcaaattaggaacatataaactggagggaaagagatcctttctataagtgatagaaagcttggctgaattgtgtcctacagttgtatataaggcagaacttaaaactttttcatatttagctgagaattctaagtaagtgttgaagttgcagcctggtttcttcctgtttatagtaaagtggcaagaaaagctaaattgaagaatgaactgataagtatagaaagaaccaccagcactggatgttgggaatatctcaggctactcagatggcaaaaggtgttcactgttagaaaaactgtctctggaaagaaggccaggggtattgctagacagccttttgtttgtgtggaagaaactatgcatgtaactcataggttccc

SEQ ID NO: 74365 - DNA, 2013 bp, Homo sapiens
aagatggcacggtacacgttgaggcccacttccacttttattgcctttttccttccccttcctctcaattttgagcactattctttaatctttatgtatgtttattgggaaatatgtaaaatacattcaaactcctattaaaagtacttgataccatataaagcaagaagaatgagaagcattctggcctctagaaagtgatgaatgatgaagggtgatcaaaggtaactgtttgctaaaatctatattgagaaaaacaactggatggaaaagtagacaagccattaagtgctttaaaataatttaacatattttggaaacaaagacaactccaaaaaaagttactaataccatggaaatatttggtaagtggtataggtaatgtaagataatgacatagttgccctgggtggcctcggaaaccttcctagaagaggtagtcccttgagctgggccctgatgggtaggtggaaattctattaggaggtagacaagagtgtgaggaaatgaaacagggcaaaggcctttggggtagtagaataaaacaaaggctagggtgtggaaacttgggatattggaagaaggagctatagtaaagtagcagccatccaactttatgtatgctaagaagtttgtgtggaaagtggattatagaaaagacaagttgataatgaaagtaccttggaagtggggagggagatttcttaaacattttaactgaaaaaataatacaatgatgttacagatcagtaaagaagactaacttcctaattaaaaaggatatttgtacacaagtaggacaagaagcaactacaatacatttctgaaaatatatctcaacctcagagaaacaaagaaatgtccccctcttttctttttccttaatagaaatcccctaaagccattgtttttcatagtgtcctgtgttggcgggttattatacagatacctctttacctgatgatcatgagaatttaaatgggtataacagtttccaaagacaattaacagtaaatcagtaaatataaaaaactttaattctgtgtctaagaatttatctcatgagatagaatcatttacaaatgaatttatgtacaaagatactctcaaattatttaaaatagaaatgtccaagttgttggattcattattattacacagtgggtttttctgtagccaaaaagtatttgataattcaggggaaatacaaaataggaggtagctaaatacaaaatttatatatccaatatgatccttttattttgagaaacatatacttgcacattttaagagacagaaaaataagccaaaatgctaaaaatagttatccttaattggtagtcttacgtgtaactttatacttttcttcagtttctacatgctacaagtaatgtatatcacttttttttatcacatagaaatactagtaaagaagttaaagtcatacttttgacttttaagtagccttttgtgacacaagttcacagattgaatcccgtaatgactaataaggaatgtgttagcctagccacacgagctcatccatatgtgaaaatcattaagtgctctaatccatgggtagttactgtttttttcagttccacattgtgtaccaagatatttggtttgtcaacagagacaaaagtattaaccaacaaacatactttatttacaaagtaaaagcatccaaatatgacttgacttggctttttggcagattgttctttgttcttgagttagtgttggcgacacataactatctttaggtatttgaagggttaatacaatggaaaattttaattttcttttgttaaaaataatgcttaaaattttttgaagtcttcatggtgtttttatgatgtgcctgggaaaatctcagatactgttctgaaatgtatatgaattttacttttttggagagggaaacagacttaaaaattggggatagattttgctatagaataaaatactcttccagaaggttgtgtcagcagaaggaagaaactctcaatc

SEQ ID NO: 74366 - DNA, 3577 bp, Homo sapiens
attagtccagcaatctgaatctcttcaatctgtatttattctctctttgcttagcgggaaatcaattcagccaatctgagttgcctgctacataatttctccttctctgtagctcagccccagacgaagtgattggcaaatgagcaaatccatatgttttaacaacttgtcctctgattataaagtcaataacagaataggttttctgtccggatttattgttcctaaattagaactaatgaattaggctctttgtatatacctgttctcctgtatttagaatatgataaaggaaaaaaagattttatactcatttgaatttctgtatcagttaacatcttggtatctgtcatttcctcaaatgtgacatggaaatgaattctgaaaaaatcactgaataatatcaggctcaatggcttgatagacttaaaactagttttgtttaaatttatagttttaaaagtaaatacctaacttgtttttttcactttgtttgctagtcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggtaagtgtaaagcatacatgaaaagtgttttgtattttgctttatttccttttttcggattttgtggattgatttttgtgccctataatttgacttattttggggggattctcaggactaactttaaaggctttttgaggcaaggataggaacaattgagatttttccttccaatctggacagaactccaaaatttgcagtgattttaaaaaacaagttttctggggaaattattttgttctctatccccagttttttctttcctaacctcattcacattctcctatgcctaaaaaactaatagcaacaacaaaagcttgggggtatatttaaaccaactataatatgcagcattttactttgtattagttggcttgttaccaggagtagatagtatttatttgatagtaagtgcaccggagtaatttcctattcctagtttataatcttaagaaatacagagtctt

SEQ ID NO: 74367 - DNA, 1050 bp, Homo sapiens
attattattattattcttgggtactcattatccagattcaacagttgtcagccttgtttcattgattagttttctttccttttgggtgaagtagagaaacaacattttatatggaaatgtgatttaatttctattgaagttgctgtctggtttccttttatatgctcccagtgattgattttttttagtattggggaagatacctgctctctcactgagctgctgtagataaagacttcaaacaacaaagtcctgagaatgagtgttgggcaaacatctaggcccttaaaggaaaatattctttctctagtacctactgtctccttgacagaagaatgtagaggataaatgtagaaactgaaatgaatcagattaagacacattggtgttagtgtgttatcactgaataagtaacaggagttgaaaatgagagcccttgggtgagaattgaatcatcccgaagaatagagttgagttgaagtggattggggtatttaaaggtcacttagaaactataaagtctttactaaacagataaattgaatgattctcatatatatggatgtcaaatgagtgatcaaaagataaaggttgcaggttttatttaattttgagaaagttggaacatgaatcgtcctcttaggattgagatttactgcaagagcctcagaatttattcattcagcacaaattattgtctcagtgctattaactagaaatagtatgaacaatatatgcaatgtaaaatttttttagtaaccttaagaaatggatgaaattaattttattgtatatttttatccaaaatatcattttaacacgcaatcaaataaaaataggagatcatttatattctttttcttcatactaaatttcagtttggaccagacacatatgactggtggctgtcactgaatatcattggtatgaaatgtgcaggatttccagtggtgccttgatgaatgtcagtaatttcagcacagaattttattttgagtaaattggtttataatatcaaaatgggattggagtaattaaaactgtagtatc

SEQ ID NO: 74368 - DNA, 1150 bp, Homo sapiens
taagtaaatgctgtttgctaataattattaagcgattcctagaagtaaacccctaggattgagttcccacattttaaagatgttttaaaataatggtgccagttactctgtaacagtgccgaagtgctgtagccttactgttttgtttttaatagttagcattttaaagttcagtgtgactagtggtttttttttttgttttttttttttttttttgagacagggtcttgctctgtcgcccaggctggagtgcagtggtgcagtggcgcaatctcagctcattctcctgcctcagcctcccgagtagctgggactgcaggcacccgccaccacacccagctaatttttattttttatttatttatttatttttatttttagtagagatggggtttcaccgtgttagccaggatggtctcgatctcctgacctcatgatccacctgcctgggcctcccaaagtgctgggattacaggcgtgagccaccgcgcccagcctgactagtgtttttaaaatacctgagagcacagagaaaataggacctagtattataccatttcattgaaaaccttgaagatcttgatttaatgctttcgtcagtataacatattattggcagggaaatggatattcagcagaggagcatgaggaaaacattagagaaaagaacatcatgagggtgacaactgctatggcaagggttttgaggagtgaataggctgttagatgatacctattttgcaagacactgacccactcaagaaagttcagtgcctcttatgggagtaggcataatagtggttttatcattgattatgatgataaatttgccatcagtaaagatgaactcatgcttaattcagttgtatatgtgctcactggtttgctgaattcagtgtatggtgaggggataaaattgagctttccttcagcattgtttctaaaatttgatttaaaatttttttctgattactgaagtagcatttttaattttaccaagaaaaacagcagaaattatattcttgctaacacttgcaggcaaacagttttgctgtggtaccctgaaccctgcctgttgcaaagcttcattttcatattgggatgccttgcagttcctccaggaacaaagggagataagcagctttgtgag

SEQ ID NO: 74369 - DNA, 2454 bp, Homo sapiens
aggaatgaaatacggcaaatagaggagctatatggttctctggtttgagagaagacacaaactgccaatagtatttaggagggagaagggaccaggactagcagccacctgtactctaaattcctgggtgccgtacaataggcattttatttaatatattctaatgtcttggaaacaatgcaaaagaaacaatggaaagacttaagtgttggagctttggcagtgtaaggaaacagtttgcagtctacatatcctgttggttattttattcatttaactgatgtttattgagcatttaataagtgccaggcactgtgctaggtactgttaatataaagatgattggcccttctccaagagcttgatctagctcaaagacagatcattaaataggcaataatacagtgtagtaaatttagtgacagtaatataaactgtataaaggaagtatcctgtgtgggtggaggatataagaatatgacaatgtcaggcaaggtataggacatatgtggagcacagaaaagagcctcctcccccgactcctgccaaaatagaggaaatggtcttaaaagtggaatgatcaggtgactgttgacttagaacacgaagttctataaatatttaagtcatggagtgactggagaggtaaatagaggctgggaatcatgttagggttattgtatgtcatattaaagagcttggattgcatcctagaaacgggaaggattttaagcaggtgaatgacatggtgccttttttgttttgattgttgtgtaggatggaaactaagaggtgggtacagaagtttacacaggagtagtgaggatggttgttggaatggaaaagagggacagatttaagaaacattcagggtatattaaatggaatgtgggacttcagaaaaagaatgttggttctcatgtttatagtgtggctgttgcaactcatctaccaaatgtttcagtaacaaccatgtggcaggtactggtaaaaatgtcagaaactttttaaatagtggataagggagagggaaaggggataagagaatggtgccttcactgtgagcactagttttggatatactgtactgagtttatccagacttgatcatgtgagactgaagcctagctgagaggggcttcgctgaatgtcgtgaaaccttgagagtatatggaatgacccagggagagtgtggagagaggagagcggttcattcaagggactgaaagaaccttaggacatgcctgtatttgcagttaggaagagggagaagagcctatggtggaagcagaaagaaatatggtaaaaatgcatagtgtcaagtgcccttacaagaaatctagttagatggaaagagaccgtaaaataagaatcaaccattgggtttaactaattaggaattctttggtaagattggaaaccttattggtttaccacttataattctgagttgctgaataaatcacctccctctaaccttgtttttaaatctgtgaaatggagataatctgtcttgcttgttgtgaaaattggagatgatgtatttaaagtaggtgatacttggcatgtaatagctctcaataagtaatgttatttaatgtaactaacttacatggagccagaccgagcctgatgaatttcagaagtgatcttatgagttgtcatcttaatgctgagaaggtaggcctttacatttttaaagacttttgccctcaattttgaataggcagttcacatggttcaaaattcagttcaaaagatcttcctctcatccttgcgtcccagccattcagtgtggttcttctcacccctcccccacaccagtagcaccattttcttaaatgctcttttgagatgctgcatgcatgttatattaactgttgaaaaaatagacaactgaaaataacttgcagcaaatcaggaaaatgttaatggcatagtaacttactctagcctgtgatatctaggttcgaatatcctccgtgttcaactggatgacggattaagggccttctaaattagagtatctacactgaactgggatctatataagtgattcttagaatacttgggcagttcattgtgagagcaaagaagagcttttaggagaaaattgattatatggaaccgcatatttttggaggttaaggctctgacagaacattaaggcataagacctagctgatgttaagaatatgtattcatttatttatttattatttttgtagagacagagtcactatgtttcccaggctgatcttgaactcctggcctcaagtaatccttctacctcagcctcccaaagtgctgggattacaaatgtgagccaccgtgcctggcctatacttttttcttcctttttttggtcgttaaatctgtgtgcttgtctttgccttgcttatttgtcctgcagaaaccggtgtagggtggtagtatagtgcttgcttgagatcg

SEQ ID NO: 74370 - DNA, 1020 bp, Homo sapiens
gaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaatgtgagtgcccgcgcggggagggaccggggcgtgcggagagcagggcgcggggcgagggcgtggggccggggcgggacggtgcgggccgggagaatggcggggacggtccggggctggggaccgggcgcgggaacgggtcggagaggcggcggcggggcgggcaggcttggcgtttggaaagcttggggtgggacagacccagaagttgttcgggatggaaaattcgagggcttgagcagaaagggtttaagagaaggcgattttggcgcgagagaggagtggtgtcccggaagtaggggtggagttcggagtgaggtcggagagctgcgttggcttgtgaggccgggagcgagccggcctgcagatgtggagggtggtgagcgtttgctggtcggcttgaggaggagagagaagggaattaacctttgagatgcgaatcacagctggccagaagcattctattgaagctcaaatttgggacaggacttaactaatctcgg

SEQ ID NO: 74371 - DNA, 1069 bp, Homo sapiens
cttcaggtgtacgtccctataaaaaattcactgatacgtgtgctggaaaaccaggcatgccactaccattctgcttcccatggcagacatcactattcaattcttgcactatttaatgctgagtgtaacaccaaaatctttctcaacacaagactccaggtattgctaccaatatgtccaaattagaatttaaattgaaacctatttgtcacccgtgcttttaaattgttaccagttattttaaagcaatggtagccagtgatgaaatacattgttggaaatataacctgcaaacaaagcatcgaagtctagaatggaaaaataacaaacagcaaagaaagcgcatttggcaaaattataaatttttataaattacaaagacaaagttcattgtttttttgaaactgatggcatgaagatttaatttctcaaggtcaaatggtcacttaggttaagtgagaaattctgtaacagagattttgtgggtagcaagaaggtcttcacaggcctgaactttgctctggtgtgtcaaggctgcccaccaagagccacgtttgtgtacagtccccaaaactgaagagaaatgaaagacaactgtgaaagagatggaccatcttttggaacaatgggtgagaaggaagaccctgggcatctgcctgggttgctgaaatcagaaaattcaccctgagtcaggagtttgctgaaagtaaaacgtgtctccaattgggattgacggtcaccagatttgtggaagtcaaaaactctgttcccttttatgtccaaaggatctagaaaactgtggaaacttcttcagtagagagactcatgtaaaatcaaaggtcttggattagtttgggagccttgctactgaaccaggaagtctgggagcgagcccggcaatctgtggtgttatctaattcttaaacacactcctcaggtgattctgatgcatgttaaggtttgaaaacgctgatctaaggctggtttatttaactttgatttgcacagcactttccccaccctgactcagattgttacaatgcagtggttggggtggggcttgactgtc

SEQ ID NO: 74372 - DNA, 1033 bp, Homo sapiens
tcttatctcttcaatgttagaagaacttgttcagaaaaatatttgccttttattaaaataaaccaattattttgtgtaatttaaacatagctttagacatgactacattgtacaaacgttcacattagaactcaaaaaggacagataaaaataattattcagtgcttcctatgtggtagaagtttgctttacagtatctgaaattcctacaatgatcctgtaatagagttgccattattcctaatgtcctataggtaggaaatggggatgataggtttttttttttttaactcaattatgtggactttaagaatacttgtagaaactggcattgcatatcaggtgttaataggattctttttttttctttttttggtgggtgaaaatgtttttttgtttttcaataatataatattttgacatattgttaagcattataattcctgcaataaaaaaaaaaaacactgcatgctagttagagaacaatagatttaccctgtcatcattaacattctcataccttgtctccctctttccagttcaagggctgagcaattctaatagtaccgggaaaaaaggactcaacgattattcaagagggacaagtcaaaagcctacaggaaaataaccctggtttagattggaaaggaaaagtcaagttagagacgtaaccaggggctttcatgttgaatgtaaaagtggcaggcagctgttcttgttcttcatttccaagggcatagaacaggaaatgaggtgtaagttgcagtcccgtggatccaggttaagtatgaattggctgtaggttacatataaattggctgtgggaatcatttacataaataagacatttaactctttgactgaacatattttaaaacagtgaaattctctctcctgtttggaatggtttacgttttaccttgctgtgaagtaagaatgaataggtctacagacatattgtcctgagggtgcttgatctcatctgaaataagagtgaataagatgagttagtgaaattcatagtcacactcat

SEQ ID NO: 74373 - DNA, 1035 bp, Homo sapiens
ataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagatta

SEQ ID NO: 74374 - DNA, 1035 bp, Homo sapiens
accagcaattttacccatcattgcttatgcatcattagtgcaagtgtcaaacagtgaaaaaagtaaatgatattttagtattattatgagcataatactgatcttgtggaccccattagagggtcttggggaccctcaggtttctgaccaccttttgagaaccactggcatagaaagatctcagatttaatagagccctcaaagttcatccagtttaacagctctaaattcctctatgctatccttgccaagtatttatttagattatgctgaatacttgcagtttctgtgaataatcgtgctaaatgaataaaaataagtgtcacagacagctgtttgatggaaagtaatagagattcttaatcctggagttatgttttgtcctgcttttaaaacattgcataagtttccacttggtttctctaagtaatcaaccttgatgaaatccagagactactaaaattatgttgtgaaggaaagatacagctaaggttttgattttcctttgctatatgtaatgacaattgtcatctttctttgatttttctttgtctgctctataattaaatgaacttacgttaggtatgtagttatttatatccatatctgtctcccgagtacctcaagagttgcttgaacgttactgagtagatcacaagctacttgagagcaaggactgtatagtatactaggatgcattggaatctgatgaccatctcttacggaagaggctgggaaatcaactgtaggcctgcttcagtggtccacgctgggtttcacagctcccctgggagcctgcagtgatattctgaggactcataccattcgtagtgggcatgacttcaatattgatctctttttctaaagcatcagtttataaaatagttatttaaatgaaatatttttccttaaaaatggaaccattcgtgatcctatatgaacacaggagatgattagtagacatcagagaagcatggccatcactcatgcccttagctgacttaccatccagctaacactgttagccagcaaggt

SEQ ID NO: 74375 - DNA, 1057 bp, Homo sapiens
tctagaatcatgcttgtttgcctcccagctcttctacattgagaagcagatgatagccagtctacttatgcccctgagcttctgttttctcattaaaaaaaaaaaatgacactatcgcatcaactttttttgggtcaaatccgtgagaacacgtatatgaagaataagcacttgttaaaaatgagttaatttgaagaatattagtgtttcctaaatatgacagtggagggatatggtagaaaggaaactgttgagaacagaaaggacaagggaaattatagcagctacttttgtggatggactgtacctattaccatatttaacaattacatgtggcctagtaccatagtttattatattgtggatttttaaaagaatagatagacgttgaattattgatattctccctctctctctctaggatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagacctgaccttgataaaacaaaaatttttctttttggccgttccttgggtggagcagtggctattcatttggcttctgaaa

SEQ ID NO: 74376 - DNA, 1034 bp, Homo sapiens
gtgcagaatgataaagaatgttccttttagaagtgtgttatgtctgtacctgtctgaagagtgacattaaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaagtttcttgttgctaaagtggtgtaatctgttacacagatgaatagctagatgtggaaagagatatgtaaacaagaaacctttgggtattgtttcttaagtaaatattgggacaatcatggtaagcaaacttagttctgtaactgcatttttcaccttaaaagttaaatgaaatgcatgatggtattttattccttgaattatgcaatgcaacattttacatgtaaatagcactggtcatatactgatgtatatggttatctgggttatatctatttttatgtaaactctattttgtttttggcaagaagtgaaattgagacttatgtgcaggttgccattgaattttgctctggtgaatgctgagatccagctttttcttacaaataaatgggaccctgttttccaatacaaatgtaccgtgtttttgttaggtacagtctggatcatggcatgtagaaatagaaatttagaattttactgcagctttgatgtgcatatttgaactttttaacatttgtaactttggtggcaaagagaattttagcttctatcgattttgtaagtcttcagctgaaccactaatagcagtcatagtgaagattagcactacttagaattaaattaggaagtcttttatcattgcaggattgtacatactactttataaaaattctcacctttgattttaaatcccagtacctagttatatctaacctatcaaaggcaagatatcatttattggacttcttgaaaataaaagttacaaaatccaacaacaacaacaacaaaacaatgttct

SEQ ID NO: 74377 - DNA, 2346 bp, Homo sapiens
gaaaatacaacaaaatgtatatttagacacgagcttacatggcataccttatatttgtatcattctttaaagtttacaaaaaaaaaccttatgtttttatgtaatcagtcattacactagggagaaatttatcagctttagttctaaatatgctcatgaggtataaaagctatttcttcatcagtattttgcttttatgctgctttttctttttgatactccaggtttataaactatcttttaaaattttaagccaggacttcaaaaattgtagagtacttgtttggcgttccctaccttcattctcttagggttaaggagcctttctttctgcagctaagggcagaggctgtgcctagggctataccaccactagcatctgtatttgagactgtttccttagatgggtaagaggtggaaaacaaacttagtatcaggggtccatgaagcccatggcatcatttttgaaaatatttctagttttgtagccaaagcaattggttttagtaaaatgagacttcttcaggagtcactcctttactgtggacccattgcttagtgggaatggaagtatatgtatctatcttgtgtattaacttctgacttatttatacaagagcagctataggagtttacaaaagaactttaagttattaagttactataaatttggggatcctagagtgatcttaaatatggcaagatacagctcatttagaataaaatctcacatccattattttaaagggaatgattggggggaaaaactggtgaaaaagaaatataaaaaggaccctaaaaagaattctgcaaaataagagaagaaataatttgtgacaggtaatagaatactagtaggatagaaacaactagaaaggaaagtgtgacacagtttttaaatttagatgtagaaaataatgaattaatgagattggtgaaaggaaatcatgcaaaacatttgaatgcaaagcatttctaacaaaaagtgactggagcacttgccattgcaacaaccctgtttttgcaattaggtttttgactgttaaaatggatattttcataaaaatggtgttctgaattttgctacagggctgcttaaatttatgattacctgtagacacttgatatttacatagattacagctttggtaatatgtcactggagtaattacgctgtaatacctgttgagaattcataccatctgatgcttatatattaatttcttatgtttgtaagtttggctttgtgggaataggtgtggagaaattaaagagtgaaggccatatttcattttttataaattatctttcaagctcagatagcttaagagcagtttatattaaggagacccttttctccttgaggatagggataggtaaggtaaacttgtaaaaaggatgtcacagaagtcactttttaattaagtcatgattgagatactgaactcttccactcattcttctttcccattttcctattatgtttgataattatatgtatttttaaaaactgtgagaggaaaaattagtcataacccttttgggttatccacttaaatttaggtattttcatattactcaggtaaagatggaaatgacagagcacagacatttattttttaaattgatagggtagaaaatgaaatgtacttctgtttattcttaatactatatatatatatacacacatagttttagcaaattggaaataatatattcatttgtatggcaagataaatgcagtcatcttaatactagtctatacatttttgccaaatggcgcaaatatacctccatttatattttgtatcttaaaatgtagtttaaaaataggaccatgtatgagacacttttttacaaaaagtgccgtatatacatatgtaacaggtgagtgtgtgtttaacataatttataattatttctgtcagtacagcgtatatggaaaattcaagttgtttttaacatattcaagtatgttcagtataaaataagttaatcccatttcataatgtaaatcatatttttgttatttgccatattttatttgaagtgataaaattttataactcaaatttgaatgtcatagtacattgtgtgctaaccatggcaagcaaacatttacatttgttttttacaataaatttcttttaaaatatactttctatttttctgtactgacatatgcaataaattggtacattaaaaatttgattaatgtcttcagatagtttgtattcagtctttttttaaaaattgttaatctagaattttatggtaggacattaaaatttcttcaatggttacgtaaaattcctgaatttgcactgaaattaatgaattttattc

SEQ ID NO: 74378 - DNA, 1089 bp, Homo sapiens
tacttatttttaaaaataggcaaggagcatgaaacagaaacaacttatttctgcaaaatgcttgtgttccagttgtgtattgagatgagctagatagaaggcaggtaatattctttttttttttttctttttttttttttttttttttgagacggagtctcgctctgtcgcccaggctggaaggcaggtaatattctgataaagtagactctttactttcttcacatatatatgcatgcatgtgcatatttgtagagacttgaatcgcttgttggctttactttatggataagatatgaacattttatttgcccatttagttgactcttctgcagctcctctggacatacactgtaacatatgtgcctttacagtcctgtgtcttgcatgttgcctgcttaatgagttagtgaatgcttaaggaaaggaatccttaacaaggaaaaaggaaaaagagagacaagatgctaatactagaaaaaaagtaataatatcattgaatcaaagttttaccaaagctaatcattttaagaaaatataagattctacaggagacaggatgcttaggtggtagacactaataagacaaatccagctactgtctgcacagtcttgacagaaatgccttcaggtttaaaaatactaaatcactaactgtttattgatttaacatttaacatgtgccaagtactctgactgggttaaaatgtcaaacaagacatggtccttgcccaaatggagttcacaggaaacactcgaggaaataaataaatggactataaagtgacaggtgctgagatagtccctgcactacacaaagggaggctcagaggaaggggcaccatctatcagggtggggttgggaggggtaggctctgacttttgacaacccattcccattacctcctttcagaccgtgagaaaggtaactcttcaagagtgatacctagtttacattcttgctaccctgttaatagagcctgccttccctgctaaatgagaaaataaaccaagaaaattatttcaagaactaggtcttgaaattaaaccagtatgcaactcggggagatgtagccaggttaagaagaa

SEQ ID NO: 74379 - DNA, 1063 bp, Homo sapiens
ctcgattcaaaaggaaagccagatgtttgtatggtcatgaaagtcaagagaaaaataaattgagagtttttttgtggaaatgggagtgatatcattccaggagaagctagccattccagcacagagacacaaactctgaaataaagttgcgaactgcagcctcagcacaaacatgaagacagattcaactttgtgagctttctccctcctatgtacatacattttactgtgtgaaacattataataggaaaagaatgttttagactaaagaaagcaaaagaaatataggtgttggtgccataatgtggtagagatgaagtacacattcgggacatcaatgcgacacattgagagacagaaaatagcaactgctcatatttttaatttgttggtaaacagacctggaaagggctgtatatcctcagagcagatatagagtgttcatattagaaaaatatgctttgtaaaaagcagagtaaacagactgctattgaagaataattaaatgaattattaatgaggtaagtgggcaccggctggtttcattcaaggctttagtcaataaataaataaataccaaatacttacctgtggtacgtatcaggggagatgactggcttagtaggaaatgcaatataaatgactcaaaattatgttgaatttagcctaaccatatggggctctttactagccctggaacccatgatttcttttcttagctttttctcagaagcacttactcagtagacttccttgtgaaattgtatcttttaattggatggttgacctttaattatattctggccattaattgattcaaatgtcactcaagctggctccccagaaaatcgttcgcttgcctaaagttttactcctcacctctgaatttagtagatttgaaacttgaaactatggacacaacagaacagtcatacactttcatcttgtttcacagttttgttcattttgagaaatattttctcaataaatataacatgtttattgcagaaaattgaaaaatacctaaacatgtaaataatacaattcagaatcacacataatt

SEQ ID NO: 74380 - DNA, 1007 bp, Homo sapiens
agccctgggaggaaggcaagtggattctgtgtatcccacacaacacaggaagcatcaaggcctaaggagttacaggggtcattccatcacacagacacgcagtgcaacctaggaactggcccttctttttctatcttgttcgacagaatgattcacaaaaacacatgcgaatatttttcttaaattgaaaatacgaacctaactgtctagacaactcaccatgaacctaacagctctgcttccaggaaaactcagagttttcccactgaactcacctctggaaaacagaatgaatacatgtttctttctcaaaggtcatcagtttatgaaaatgacccaggtcctagctgtgggttagaggggccctttctggaactccagagattgctctgttctcctgagggtctctgctaacttccctcctttctttttcagagtgaagatctgtctggctttatcaccaggatgtcacatgtcagagagtatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgttttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtcc

SEQ ID NO: 74381 - DNA, 1375 bp, Homo sapiens
acaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaaggtgaggaggccctttgccttggcgtctggcgggaaggaggggcggggcgctgagggagcctcttgggtttcactgctcccactttttggggaccttgacccagaagccgacagcctggcactggctccttgttttgtttttctgcgggctgccctgttctcttccttcagagaacttgccaggaacattcgtcttggagttgaatgtgacgttttccgcgtgggagggagactgattttttgaggccccacccattcacccattctgtgcgtcccacagccccctgtcccttaacacagtggaagttctcccagaccggccacactagaggccgcggggcacccgactgtcttcatccggctgcgtgggtccgtccttctggaaggacctcgggtccggaccgctgccctcagccgcagctttcacctttccctgtgttcctggagctgggctccgcctgattcttggtgagcttgaaggttcagacctgaaagtcatttaagaaatgagcatccattttgatggctgctaatagcgacagttaaccatttccgttttacacacaaactgtgggagcttttccatcagaggcattgtttttctcggaaggggtgaaacggtaaggctgcacacagcctaatgcagtggtgttcaacttgagcatatgtgggagttacctggaggctttgctgaaacatggatctctggcctgtgttaaccccgcagtttccgatgctgtagctttggggcgcggcccaggctgtgcatttctagtgagtctccgcataatgccgatgctgctggccgggggaccaccctgtgaggaccctgccccaggtgagactcacctggggaggattga

SEQ ID NO: 74382 - DNA, 1039 bp, Homo sapiens
ctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcct

SEQ ID NO: 74383 - DNA, 1081 bp, Homo sapiens
gcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcc

SEQ ID NO: 74384 - DNA, 1735 bp, Homo sapiens
agacgggcaggtgggcgggcgtccactacctgtgtgcgcggtgcgggcggtgactgccaagttggagatgcccttggagaactgcttcgaattcatgtatctactgggcttttgtgactttcaaagcctatagcaaataagcacccctgcaattacgtctcctcaatgaccaagtcagggtgaggtgagggcttcctgagttcagatcccagcaagctcccgatcctgcgcaacgaagaaaactcaacaaaacaggctttggctgtttattttattttttttttaattgtgccttcatgaaataatttacagcaataatttatcttataatattggttattgtttttaagtcccggatgtttacttttggatgtcctctataattcatagaagtatcttaaaagtaataaaatcttaatctaagagaaaataagtgtaatttttgaaagagtgatatatattttaatatgtttttgtaacatgtgacttgaagattgtgttggctaattttatgtgccaagagagccctgactagtacaaagattatagcgtttttatttttagcatgtatacagttaggattattgatcagtagcctgaatttgggaagaataatcattgtggcaaatatcacccagtgtgcctcaaaaaggtgtgtttaaagttgatcttccatttttaaatcataccttaaaaaaaaatacctcaagaaatgccattttaagtctgtgcacctatgtgtgcatgtgtgcgtgtttgtttatataatagattgtgtgattgtgtgtgtataggtatgtgtgtatgattgtgtgtgttgggggcgccacctttatgaacattatgcttcggcgttctttttagatcttgttaccttttcttacgttcacaaatgttgcctagcaatatgtctagtcaggaaagatgaagggattcttatcttggtgcttgaagaaaatgtggtgtagttttattggctttgtgatcacttacatcccacttttatgaggatgtaaatgggccacctctatgttcctgtatgttgccagccatcagtagacaatgctaaaggaaccaccacttttaaacatcatgtgatggtttcttctgagaaagtatattttgcaatctttttctttttcatgttgacttttattatgcagttgcattttcatatccgtattgaacatttacttgctgtgcctgtcacacgctagcaggtgtcatcttttcctgtttgcttgtttcttggggccatcctagtgttaaaggccagtgtttttaaggtgtcagcagctctggattggcagttagcactttccccatgtactgcctcagttaccagactggggacaaaagagagaaggttaaagaattatcacctatgtccgtggtattctgtcatagagagtataaatttcctacagcaaactggaaattaattgcaattctgcagttagaacctccaaatacaaatgtggatgatacaatttcaattctcattgagagtcagcccatgaaacaaaccaacagtaagaaactctgtaattagaagtatcccagtcctcttcctcaaccgaggaacttgttttctttccccctttctattgccagataagctatttatttatttaaagcttgttctacaccttgtgattttccaactgttcttccatactttttcaacaaaagtcagctaataacatctgccaacatgctctgcacgcaggactgg

SEQ ID NO: 74385 - DNA, 1070 bp, Homo sapiens
caggagctcaaacaaatgcatgtgcacagcaacactattcacagtagccaaacatcaagatagtccacatgttcatgaatgggtgagtcgatacagaaaatgtagcatatttacatgacggaagttatacagccataaaagtgatcgaagtactggcatgccacaatgtggataaccttgagaaggtcatgctaagtgaaagaaagcacacacgaaagtcatgcactgtatgaaatatccaaagtaggcaaatgtatagaggcagaaagcagacaggtgtttatcagggacggaggggtagggagggaatggggtgtgacttctgaatgggcatggggctttggtgtgatagaactagttttggaactagacacaagtggtttagtactagatacaagtggtttagtactagatacaagtggtttagtactagatacaagtggtttagtactagatgcaggtggtttagtactagatggaggtggtttagtatgagatgcaactgatttagaactgaatgcggatggtttagaactagatgcaggtggtttaatactagatgcagctggtttagaactagatgaaggtagtttagaagtaggtgcaggtggtttagaagtaggtgcagctgatttagaactagatgcaggtggtttagaagtaggtgcagctgatttagaactacatgcagacggtttagtactagatgcatctgatttagaactagatgcaggtggtttagagctagatgcagctggtttacaactagatgtaggtggtttagtgctagattcaggtggtttagtgctagatgaagctggtttagtactagaagcaggtggcttagaactagacgcaggcggtggcacagcattgtgaatgtactacatgccactgaattgttcaccttaacatggtgaattttacgttatgtgaatttcatcaattaaaaaatgattacaaatcgaaatgtagtaagtaaaaccataaaactttgagaagaaaatgcaagagaaaatattcgtgagcgagggtatatcaacaggttcttaaccataatagcaaaagca

SEQ ID NO: 74386 - DNA, 1196 bp, Homo sapiens
tcgaggtctagggaattactccagatttattactcatcacatcattccacaaatatttaatgaatacttactgtgtgtgtaaagtgttgcagagaagaataatatcttcttcttaccctggaggagtttatgatctagtggaggagaatggaaaaaaagtgaaattgtagtacgaggaggcagggtggcacagaggggaatggccaaggcttcggagccagactgatgtggcgggacttcagctgtgccctatggggctgtgggcactggggcaggtgccagggcctgggtgtgcagctggtaacctgcagtgttctgtgtgcgtgggaccgtgtgtgcactgcacccagcacctgcctgctcactgggtggtaccaggttgaggcctgatgccaggggctgggctgatcccttagagatttccgagcagggcaggagtgccatgtttctgacgtgctgtgagatgatggccaatggtctgtctctgtgtcgtgttttaggaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtcc

SEQ ID NO: 74387 - DNA, 1021 bp, Homo sapiens
ttttggctattgtctcatgacccatgttagaatgggttggagtgtttcaaatctaatacacagtgagctcttctttaaactctaatgaagctgggctggtcacctatttgggaagcagccattagacgatccctggggccatgctgagcaccatggggccccagccatgcaggcactggcttgcgggccagcccgataatttgggcacagagtgtgtcctgtggtgaccacatgaggctgcagtgtgtggctttccagagggaacaccctggcgccttcctgggaaggatcgatctctttcctggtgtttggggagggaacctctgactcacggctcgcatctgttctgcagcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagtaagtgggagcactgcttttttgcaggctgctggcccctttgtgactttattttttaatcatccgcgatccgtaacaccttccaatgcaaagtctcaaagatggttagcaatgaatatttgatgctgttcgacatgggcagatgaccgagacgattttcaaaggcagaccttcagtcacaggtttaattttttcatttaccgaagaaccatgaaagaaaaaggtcattttccattttttctaggtgagtgtactaaaatgtaattaaagcaactgaaatctccaaacagagcatgtttgaaatacagtatatttaacaatcccggggagaagaagtgagcagcgttcattttcatgccattcataacactgatcgtaatgtacactttgtgtaagttctgagtgacttcacaaggtatttttttagacctgtgcaaataaaaattaatttcagcacaaattcagctgaaactgagagggaagacccttccttcct

SEQ ID NO: 74388 - DNA, 1024 bp, Homo sapiens
gatcggctactcttttgtgatggtaagtgtctggggagacgccatatttcccgggaagagccccactcacgccccatagtcgcctctgtctggtgcctccacaccttggagttctctgcatctcgctgcttaagcccctccttcttcctccaaccatccccttccaaagcatgcctcaaagcctggcctgccctgcctggtgacagcaggggtctccagcaccagccagaaccctcccctgctcacagccaaggtagctgggatgagcatcttcctggaaatgcaggcccaggcctctgcttccctgtggctgctccactcaggtgctctacgggtctgttccagcaccagcaatatgaacagcttctctatacaaccagcttctccatacaaccagcttccctatatgagcagcttcttcatatgaccagcttctccatatgactagcttctctgtatgaccagcttgttcatatgaccagtttctctatatgaccagcttccatctttgagcagcttctctatatgaccagcttctccatatgactagcttctctgtatgaccagcttctccatatgactagcttctctgtatgaccagcttctccatatgactagcttctctgtatgaccagcttctctctatgagcagcttctgtatatgaccggtttctctatatgagcagcttctccatgtgaccaacttctctatatgaccagcctctttacatggagtggaggcctctttcagggaaaggaggaagagagcctccacgtggggagtacacattctactacaacatgcacgagcttgaaagcagaagcttgagttagggagagaacacccgagggctggccgtggcctccacgaaggccctcctggggcagtgccgcctgggacccttcccagagggcaaggactgctctcctagccccagggcttccctttcccacaaaagccaactgaaacagaaaacaaggcccctgtttgatacactcattgtagcttattttattctattac

SEQ ID NO: 74389 - DNA, 1008 bp, Homo sapiens
aaataatgattagttttgctgtaaattgggttagagggggaaaaaaggaagaaaatttttctagtctcagctttgactagatgcatgaccctggacaaatcacttacctttcttgagcctcagtttcttcatttgtaaaataagggtgatggtaggcacttcgcaagatgaaatgaaatagtatacaggacagggctgatgcacctacagatacttcagaatttgtgaaatagaaatgttggcagtgatggcttgggatggtgagtgggtggtgggtggtgtgtggtgattatgttttgcaagtggtggatagcctaagatgattttgaaacaaactaaagctgaatttctaacacttgtcaaatagcctaaaatattttggttttataatagaggttgagttaggagagggtaaaaacacctagctatgatcctataactctgacaactcaatttcagatggaattgtggaatgtcagcccggacctccaggtgaccagggtcctcctggaattccagggcagccaggatttataggcgaaattggagagaaaggtaagaaattttgatttttttaaaatggtggttgtgtctttgcgtatgattttttcccacatacttaccggctttggagccaagtgggggtgggcagagttagggcgtaggttccttttatttggaaccctcttcacaatctcttcctagaataagcatcttccggaacttagttgatgatctgggtgggaaaggtggagacagccctgaaagtcagagttttgccccttctccctttccgaggaccgtgaagtcagtcttgctacagtgggcgtggtcagcagataaaactcagactgatttgttaccgcaatctttccattcagtgtttgagaagagacttctgttaccaaagaatgctcttccctccttcaagccaagtcaaaaatctgcacatggaatgctcaccaattcttccagtggtgtttgcatcatcagtgtgagcaaatctac

SEQ ID NO: 74390 - DNA, 1039 bp, Homo sapiens
cctttaaggggatgccaggggtcggagagaaaggtgaacccggaaaaccaggacccagagtaagtgctttccaaagtccttttatcataaaacaattctccttccatgcggaaaatcgcagattcacagaaacacaagaacagaaaaggctcgtagggacttctagtttatccctttcatgccccgaagggcttttccgagactctcctgagctatatcagttgcaaggcttcccaggcaggcgaggtccttccctgtttaaggatccagcactgaaggtgccaccgccggctgttcagagaggcttctgaagagccctgggccatccctgaaaccttcggtcctgctctgagagcagcaggttggttggactttgccacccagaacaccagacagtgtttgcacagccacaagcctgagaggctgagttgcttttcactttagggatggtggtggcgtgagacccaccccactgccagtcagctgggatggttctggtttctacctggaaggagcatgcagaaacctgcattaaatgaagcatttgcataagcttgcaaatactcagctgccaataggcaaacttctctaatgttagctttgctaccaagatacaatcatattttagaagacttgtagctcatcggactctgctctttaaaaatggagttctcttatattgtaactgtttcataattattcatcatatacaatattacttattattgtggtattgtcaacttacatagaaccctcatttaccttgcttgtgtttcataggagagacaacatattaagctatctgaatcagagctttggtgttatatccgttattatatatatatacatatatatatatttgagacagagtctcactctgttgcccaggctggagtgcaatggtgtgatctcggctcactgcaacctccgcctcctgggttcaagtgattctcctgcctcagcctcccaagtaggtgggactacaggtacctgccaccacacccagctaatttttgtatttttagtggagacgggattt

SEQ ID NO: 74391 - DNA, 1073 bp, Homo sapiens
agctattccaatgccattatttgggaaccattgaatctgaaaatcctgaaatattgcaaattttatcatagctattatctactccatgttaattttcagttgtttccagctatagatcagttttctttgtctaagtgcttcttacactcgtgtcactgaaaacctgaagagtacagagcccagcccctgttttgggtgcttggataaggggagcttactggtggataaggaaaactccagagactgagagctctttggagttttctgggtgctccagcacagggatgctttgcaaagattcctcaagcccttctgcttgtacaaccaccagaaggtgctttagagaaggggaggcactgagatgacagctgtgcaactcaggatgcacccaagacagaaaaaacacgttcatctttgtgagcttgagttgggcatcctttccgccgttctccctctgtccttcttggaggtgctgaaagtgtgcgtagctccgtctccctgcccctcctccctccactgggtcatgcaggggctccctggacaccagatagtgcgaggtccttcccctcgcctgtgtggatggtggggaggctcagggcccactgggtgaccggaaatcctttctccagtgggctcattgtgctctttgtgctctgctcagcagccgctgccctcgctgtgggtttcctttgtgattaatccttatctgctcaaaaaggcttgcttcacatttgcccttggctgctggtccctggcagagtgcaactctgctgccttatgccttttttaagtttttggattcctttcaaattttctcaaatctcattaccctgattaaacattttttcgattaaaaattaaatttctagaaaagtgtcaggaagtatgcaaataaacgctggcatgctttccacttgagagtcatcaattgcttacattttgccacattcgtggttttactgcctctccatattactcttgttttttgctgtgccatttgagattaagttgtaaaggtcatctcccttagcccctgaacatgtcagcgttagacccaaggacaaggattttct

SEQ ID NO: 74392 - DNA, 1237 bp, Homo sapiens
cgggaacttcacaaagataagatattaataggactggatcctttgtgggcacgaagtaggggagtatttagatttgcagctgtgtgcagccatttagactagatatctgagtggctggcctcgggctttagggtggggacggcaggctgtctggcttgcccctgagatgtcatgcggcctaaaggaattctgttactattgttgaatggctgaataagagcaaatgagggcgttccttccctctgacacatagtggggaaaagtgcgtctctgcatgtccagtgccctgtggcttggccttgcagccctcatgtctacacctggggtgcccggggcctctcctgcctcttcctaggtgggtggcctctgtgtgaagaaagacaagacaaacagcatctctgtgggccattctccaccctcagcctcaggttttccaaatgccactcctgaattttctggagttttgtgtcgtttccaaacttgtttcgaagaagagctttgaactaatgtagcagaatgcaaagtggaattcttcccagaaacgaattctgtttaactctttgggtttagtggaggtgtcaagtagcttgggacacagtcagaagcacacactgtttatcgtgtggacttgggaaaagtgagcatttgggatcttctgctggtcttgcctgagtccaggcatccatgtaatgcaagctgcctctctgcgaggccagcagggctgcagagccggggctcatggtttgttcacctttgggatctgggaatacagcttcagccaatctcagtgccccacgaagtaacccaccgcctttctggcactccggggtgcctaggatttctctgtccctataggcggctcctctgtatcccagctggtggtcttactgcctcagccccattttcctgggaactgttcctcctcttccaggaatggatttcttggcatgatacttctgcctctctcccccacacaatctgaatgccacacaaggctctggaccctgaggctcctgtctgggcctgaccggacagcgggcccctccaggcatggccatctctccctttagcctgctcagccctcctactctgcctgcagccaccctcaggagcttcgagtgttcagcaccctcatgtgaataaaccagatggttattggcctgggtgtgatcccaagcccccatttcccctccagtgtcaagtggctgagtcccactggcttcagtgtaccctgaat

SEQ ID NO: 74393 - DNA, 1491 bp, Homo sapiens
ggctggtaaatgtcacaatcaggggaatcgaagggctataggaacactgaatccagctttggggaactcagaggaaacttctgggaggggcttccgcctctgaaatatgagggagaaataggaactatacaccagcatgtcatttccatgtgcactgtgatggtgtactatacacagaagacatggtcattctgcctgtctgctctcaagtctaagggtctttgcactgaaagatgaccttcaagtttgctcctttgagataccaaaatgtcattgtttctgtgattaacaatcttggtggctgaactttgctctcagaggggtggaaagaattggaagggcagggtttaggagaccagtgttaaaaaagagctcccagctccaactgaggccccagtatgtggtcctgtcccttttctcggaggtggcaggtaggcaggcaggggatgtttggaaagttgcggcatggatgactgattctagtcaggagtgcctttaggaactgacccagaaaacctacccttacttgggccaggccatgagggaattcacaaaaccctacattattcattaacaaggctgttggcaaatttctgagaactggcaaggatggtcataacaagttcagttatttagttaagagctggtaaagattttgcagacaaatggaacccaccagtgatgatctaagacaaacctttgtagacagtggaagaacatcaagaagtggctaaatgacaacagtggttttgatgaattctatgatatttgttataataattgttccccaaattgaagaaggattaacctcattaaaatgtctcacaaggaggtttggtattttgagttcttgggctagagtcagctcaagcaacaatagaatgcctaaaataatgttagagcattgttcttcctgctattattaagcaaccatgaaaaaatgtcaactatagaacaatacaaaagacatattcctaccattcttatgcatacaatgaaaagggatgtcaaccagagcatgttttaatggtgaatttcttctgagtcttttgacactgtaggaatgactttggggtgaagactttgatagtctggtacacagtgagctggttccagcctcgtttccctccattgttctcctggtcctaactctgggacatgggtccctcctagcgctctttccgtgtctctgcttctgtcttcttcctcttcccatgcccctcagtgtgggtgagctgcaggggcagctctgcgtggttctctttgttctttgcactctctaacttccactgggggtctgctccatgatgcaccattactccctgaaggggactccagaactccttcttgaactccagttcaacgtcttcacatttccacgcgacgcctccccttggctgtcttgctttgatctcaaactgagcaaatatgttcaggactgaactcattttttacctggactgacaacccttcccgactctgccattttgg

SEQ ID NO: 74394 - DNA, 1125 bp, Homo sapiens
aaatggtggtggtgatgataaccccactccctaggtctcagtacccatactgagattttatgctctccctttttctgctggatttcattttttctctagaagcttgatgctatgccttgattattacttatttcaatgggacaaatttgcactagaactacagtatttgttatcactgaatttttcacggttgccatatatatatccagcatcatttgtgtcctactgctgttgaacaactactttaagatcagaaaatagaagtagtttagccagtctaaaaggatttccattcatcgaatcataaatagagaaaaaaacaatcccttctatccattactaaacctctccattccaaatgtcttcaaacaaagcaattatggtggacaagtatttgaggacagttttttctcataaacagctgcatagtgctatagcatccttgttgattagccaattagaataaattctttccacagcacattttaaaagacttaggggaaaaaacaagacttgcaagacttgaagttttcatagaacaatgtgcacccgtcttccgcccacttccccagagagaaatatatgaatcacatagcagtaaatgagtaaagtatcaaaacaggtgctggagactagggagcatgaatcatcttcttccttagatactttgtaaataaaacaggatgtatttatggtaactctgtgcgtaaacttctatttacaatgaattatataaaataaatacaatgtcacacaaagtaaataaaattgaagaatctattaaatatcactttaacaattatattaaattgtttccttaaattgatccaattttgaaagaggaatttgaataggagagatcaacaacaacaaaaattcctcctgtattcaaactttaaggaacgctagctatctattttaatgagtgaataacttatttcccaaaccacattttaagaaagtcaaaaatagttgcatcacatttttcctattgaaaatatacactttgaataacagaaaaataatccgcagataattttttaaagatttttactcagcttagtggtaatagatttctgtttatattaaccttaagaaagagtgttcagaatggagtttggccat

SEQ ID NO: 74395 - DNA, 1041 bp, Homo sapiens
ctgatggcttccttcatcgatgcagactggggagaagtgggcgaggtgtaggccccaagcagtcccaggctgagagcccggcacaggactggaaatactcatcagggttcacaggctgtctggtcttaaggaagtgacagcataagcaggagcatgtcagtaaattcacagcaagaccctgcatgcaattctatttgcaaatggaccctctcactcttgcatgactggctccaatagaagcaaaactcaggtccatcctagagcacatcccaggagaagtttctctatgggggatgagcttcaaaagtaattgtaatttaattagaaatttagatgtgagtacctggtttttttagtgggactcttttttttttcttggtaatttatacattagccgagacgcttttcctactacactgccagaagttaacttctaatagagttcatacattttgttctctctcatgttttttctccgtcacctattcttcacaccttttaaatttaagaagcatgtatgtatacatctgtgcgtgtgtgtatatgtatccttggcagcagtcctcattcctttggtgattactaaacatttgaggactggtaaactgtgaggaattgaaccttgctggctgaaaggtagaggaccagagtctgccttgttccccttatgccttcaggggcccggcagggtctcctgctcctggggctcatcctgcaagaggcggctggtatccaagcagcccaccccgatcgcctcctcagggaagagggcagggcagttaggaggcaatgcttctccatggtgctgggaatctctgtgatataaacccggtgggatggaggagattatttcaaataattgatatttacttgcattgaccatgaaaccaacccttcacgagcaccctctctggcccagggcagcactgcgcccctcgggtgggaaagccggtgtgggagagtccaaccctgcaggaaacggcttggagaagctcccgcctgggacactgaagaagtgagcgaggaggaatgatgcgtcag

SEQ ID NO: 74396 - DNA, 1002 bp, Homo sapiens
tagtggcattgcaggcccttgaagaagagtgtcaggccagaaaccagctcaccatggttcaaggtgtgaatgggggacaggaagtggctttggaatgtgtccaggttctttttgaatagagaaaaatttcctccatgaccatgcttcctgaaaagagaatgaacccacactctgggatgtgaggccaggagagttggcttcaccgtcggctggccgtccccaagtcctgccccttctcccgctcctgtctgatgtgagaggtgttgccactgcagtgtatccaaagttccagacatgcagagccgccctctggccatcgtcggggtcatggatcctttaggagtgaggaagcgggatgcgctggtgtggaaggcctttcatatggtcgggcgtggacacagagagaaagcgccaaacatccttgcggcattgctcctgcctggtggaacagcacattcacagtgagacaaacacaggtcataatgagagcagaagaccacaacagccacatgacacgcgtacacacacacgcacacatatatatacacacacacatgcacacacacatacacgcacacatatacacacatacacgcacatatacacatggacacgcgcacacgtttacacacatgcagatatacacatgcacacacacgtacacacgcacacatatatacacggacacatacacataacgcacatatacacacacatgcacacacgcacacatacacacacacatacacatggacacgcgcacacgtttacacacatgcagatatacacatgcacacacacgtacacacatgcacatatatacacacggacacatacacataacacacatatacacatgcacatgcacacacgcacacatgtacacacatgcacatatacacatgtacacacatacacgcacatatacacatgcacacatatacacacattcttgcacaaaaatctcacaagaacatcacgggtgaagctttctaggaataa

SEQ ID NO: 74397 - DNA, 1021 bp, Homo sapiens
gtactgaaggcatgcctagaatggcggcataatctaaaagtcatcttacttccgatcaggatgttttcaatcttatttttaattgtgtgtttatctctttcccatattcacaatactccaagccaaattagtacttgtagttaatattagtaaatattaatattactaaaatatattctgactaaataacaatattagtaaaaattaatattagtaaattaacattactaggtcctgatagggctgatctgtttgatatgcttatttccaactctgcaataaaaggtaagtaaatctaaagatggttaaaagctatcactcttaaaattatttcttctccattagggtgaacctggagagcctggattggtcggtttccaggtaagtttatttttattggacgatattccaaacaaaagtttaagagcttcagaactccaagtaccagtttacctctcttaaaaacattctcccgctgcctatccatagggacctcccggccgccctgggcatgtgggacagatgggtccagttggagctccagggagaccagtaagtacctggacacaggtgcccactctgggaccatcgtccggtcatcccttccagatgccacttcttcaatggttgactccagatgagagctttaagaacaactatgatgcttataggcgtagcagagaacatcaagacaaaacggaccattccttgcacactttgctgctgttaaggttgaagaataagggcttaaaattatggtcaccagctctctgccagttatgtcaaattttgacttggttccggcagggtgcccttccatccccaccccatacctacccagtgacagacagcccatcatccctgggcaaggcaaaccaaagtcccacaggttcataaggaggaaatggaggtctgcctgtgccacacccatgctagcaggcatatcacacctgggctcattacagcaggtgagatactggccactgtttaacacaatggccctagagggctcattgcaagt

SEQ ID NO: 74398 - DNA, 1078 bp, Homo sapiens
aaatgcatcagaaacctccatgcatcctacactgtgtcctaaatatacagtcaatggctttcccagagctttccaccagatgttatctgggtcctggggtaaagaaaaccatttacacatttctttgtatttgtacagggaccacctggaccccctggaccaaaaggacagcaagtaagttggttttggggggtgaggatgagggaagggggtacttaggtgtttgtgggtttgtttgttttttaccataaaacttcttggttggcaactatttattgtttatattatgatgaaaacagttttggaggtttttaagacttaatgttaaactccaaggatagatccatggtgcctctggacattaaaaaagtaaacaggtggaatgatttgttgtttgcaaattaattaccacatgcctgttggtatatgaaaaccacactgaggaacatttgattgaaacgaagattagaacaatttagggacagttcacatttattcacatgcattgatttacgagaatggacaaaatgtaactctatctgttgtagggaggccaatgtcattcttcttatctggctagaattaggttctacaggagtctaatgtcagcctctagggatatattcagtgataatcaagttaggctagagcccaaagctgtatactgttttcatcccagaaaggttattaagttgattggaacacagcaaagtaggtggtttgttagaaactcggaggacagaactagggttccttattatctgagaaagctggataaatgtccaagacaaacgaatgcagttgacaagggaagtatttgatcaaaatgcaacataattcagaaatgctgggctgccagcgggaagcatctaggaacgtttcctttgccctgtgtcccgatggaggacgtgccaagcccacacgttgccatgcctgcccattgctgtgacccctggtgactacagctgccaccgcccatgcccccaggctcctgtcccctctgacacagcttccggttggctggagggcttgcgctggacgccccaccgcctggcagcctggagcaggatgagatggg

SEQ ID NO: 74399 - DNA, 1138 bp, Homo sapiens
cagatttagaaccgtctgaactctaggtcatacacaatgttatagttcagtggttgatgccttttcactgttcactgtgcctgcgggtcccaccccacagcacacagcacacgcctcctacggcaggcccggcaggctccccagacaccaccactgacagccccttgggtctcacatcacactcatgccaacatacacacaaagacgtgtagcttcacatgcatgtaacggagcaacaaaagaaatgtgtctgtgctgctctgcccagtgccccttagagaatgttccaagtcggcaggtacacatctgcctcgttctttaaagctgcagagaatggcagtcaataggtgcgccatatttccttacgccctcgaggtggttttcatatttccagcaaacatgcagtcacctcggtggtacacagggcttggctgcctgcccatgggctagtatgtccatcactcagtcctagtaggtgcacagagatagagttttatcaaaatcactagcctcagaatcacaactccgttgaatcctgctcagggctgcacagagagtagtgtggcgtctggaggcccatgggcttcagttagctggtacagaagctcggcaggcctggtgggggttccgccatgcttgttccaggaccacagatggacctgcctcccagactcgctttctgacctccactggctctagacacgggccgtcttgacccagcattctgcttttgaccattcaaacttaacaccaatcttgatgacttcctgcaacctccaatgatcatactgttcccatttctgttattttatgctaaactcagcccagggagccaatgccaggctttgccgtaatcacacccagcctttcataacatcagttactgatcggagtactcccaaaggcggcacacctagaacaagagctatccaaatgcaccccacccagaggccacattctagttcatggcttaggaaaagcaaatattgtaaagggacagaggctaaagcagacattatcgttcaaaagtaacccgtttccacctaccccatgtgattaaagtgctgctgttaatttcctaccatgtgctggtaaaattataattatctttagttttccatcttcaacacaagggact

SEQ ID NO: 74400 - DNA, 1157 bp, Homo sapiens
tcagcctcccccgagtcagttgacctgttgacctgccgctgggaactcccctggaaagttttagctcattgctttggctcttggggttccagctgcctcagaggaatcctgagtgcttcttaagttgtcccccttccccaatgggttttctataatgcccagtgcatttcagatggttcaaagtgcccatgctgtcttggacccttcagcagagatggcaacacgtggtgtctggggtgcttgttttgtttgctgaggatgccacagcataggtgtgtgatgctcgtggcccagagtgaagctcagatttgacaaattccagggcaccctctgagctggccagtctgtggctgtgctcacagctcccactgagtgtccagctgccagctcctgtcatgccaggtacttgaggattcctagcttagcttatgacgtggcctctaaacaggacctcatttttaaaatcacagaagtttgtctttacttttgagtcttcagctccacctagcgtgagagaaagtccgggtccaaaccacaggaccacaacaacacacacaaagtgaagcccgtctcaattcagtctaaacaacatgactttcagcacacctgctcctgggtgtcaagataacctcgaaagtaatcagagaatggacctttcttatacctgtggcatctggcattctgaattttgagagctgaaccatgcatgttctttaaaagagggaatacattgctagatttttagagagctttactcttctgtccagatacctcatgatatgactcaatgataaactttttctttcaaaaaatgttcaagggaatgagaaaacaaaacttagtgttatagttgttttctatttttgaaacagggtcttgctgtgttgcccaggctggagtatggtggtaccatcacagctcactgcaacctcaaactcctgggttcaagcgatcctcccacctcagcctcccaagtagctgggactgcaggtgcctgccaccatgcccggttacattatgtattttttgtagaggcagggtttcactatgtttcccaagctggtctcagacttctgggctcaagtgatcctcccaccttggcttcccgaagtgctgggattacaggcatgagccaccatacccagcagagatttttt

SEQ ID NO: 74401 - DNA, 1050 bp, Homo sapiens
ttatttagagatttatttgtagctctttaccttaaattcacacaccgtgattagtagcaagatttttcattgcgcttggttgaggatttattatcagactgcctaaacttttacgaaaagccaggtagagttgtatattactgaggctttaggaaatatttcagttaacttagggattgtggttaaatgctctaaattagttataactcacattaacttaaagtatttttgtttttttaagtagaattttccagtactaaaagcacttttagcacaaagcagcagtgatagtcttccccagacacgcttccttaaaacaaaagccaaacaaatttaacctgttcttccagactcagaattgtctgaagagttaccgaatgggatacatcttaagtcgcctattgtcaaggcctttttatccttcagaactttgatctttatatgtaaatgtttctgtgttaacatttgaaatgttaagttcaaatggtgacgtcagtaagccagctggaacttgcttcactgccaagtgctgggaagtttagttgacctgctttggcccttttgctaacagaagctgtttatcttaggtgaatgctggtgagcagcctggattttactttgtgttaatacaattctattcaagtgaaaatgctatacttcttattttgccttaaaatggcagcattttacacctactgtgtgcccacaaaaataaaaacaaaaacatggcagcactttggtaaaatagtgtcttgtggcctggcttgtccattactaaccacagcatctgcacaggtttctctctgggccccagtttccttatctgtaaaagaaagataaagtgctagtgaggagagtgaatcacgatgtcttgacttcatcgaacatgtatcaagtgtcttgttctgtgccaggctgtgttcgaggtgattgagtcccacatggaagcagtcagtgctgcagcttgcggatggtgccacattcctcgtgggcaggcagtagtagggtgctgattctctgccagtccagacataagaacttccttcttat

SEQ ID NO: 74402 - DNA, 1034 bp, Homo sapiens
atcaagaggaaatgggaaatttggaaaatgctgtggtttaatgaatagtattaaccaatgtgaacttggtcatgctgatccggaatgtgggtgtgtgaggcgttaacctcggggaggctaggcgaagggtacatgggagccttctgtactgattaaataataaatctaaattacagaaattatttaaaagtcattactatttataagttattttttcaaaataaaatgtaaacaaatacatgacagtaagtaaatgaggaattgtgggtaaccatcctggccttcctttccttctttagtgacagccccaatgctgttcatgaggtggagaagtggctgccccggctgcatgctcttgtcgtaggacctggcttgggtagagatgatgcgcttctcagaaatgtccaggtaatgtgtatactcactcacttccctcatgacaggcttagccttaggcgtgaagttggaacagaggcatttctcttgcattttgtgtagtgttccgtgtgcctctttgtggcatgattgagataagatttgagggacggaggagaaactgagtgcaaaggtggggaggaactgtgctgagatgtgcttctctccgggcccgactgttttctcatggagcagctgcaggaggtgtgtgtgtggagttgctcagttgttttatgtctgatgtgaggagagggtgagcaggactgaggaggtgacagaggtttggggtcaggcctgggtgtatctcccaggccacccccttcttgctgggggatcctggggttccctcagcctcctgggccgttgttcccacacagccctggcgccatgctctgctgacatcaggctgtgaggtgacacgggcctgcttgtccgtgcccacatgcatatgcgcatggactctcatttatgctggtatttctttcttaaagttcatcttatgcccacctaaatccaaaagatgaaagttattctgatcactttgtgcctgctgtaaataaataccacctgggatcaggggcgataaaaagatggggatg

SEQ ID NO: 74403 - DNA, 1049 bp, Homo sapiens
agttttgagaagacacatacccacaccatagcagcaggcatggtgctcagtctggttttctcttctggcagggcattttggaagtgtcaaaggccagggacatccctgttgtcatcgacgcggtgagttgacttctctcctcctggctcggactcccggaaggcctgtgcagtgagcacggctccttgttctgtgcaggatggcctgtggctggtcgctcagcagccggccctcatccatggctaccggaaggctgtgctcactcccaaccacgtggagttcagcagactgtatgacgctgtggtgagtcagtggaccccctggagggtagatgcaagccctgttcgtcctgaagagggtgaaggacgagctccatgcttctgcccagcctgtccctgtggacacacctgcaagtaatcgctgtgcctctcccagcggatggcgcgtcttcccattaatgcgcttggattggatgaacgatggtgtagtgggcttgggacaggcagggactcgggtcagtcagcccctcctgcagtgcactctggacaggtcactttgtctgtgtcctgagtgcctcatctgtaatgtgatgatggcatcagcttcacggggttgtgaggatgagatgaggaaacctatgtaaagccgtgagtccccacatggtaagtgtcccatcaatgttagtgcccagtacgactggaatttgtattactcctgcaaagctctcagaacccagtcttgggtggtcctccttcagcctgctctgatgaggtagaggatgggcactggagcaggcaccgtgtcagcacctgctcggaggactcactgcaggtgatatcctgggcatcctcccacctacatggcctttaacaggtgcctgggtgatccctttagacacgagagcatgagtctcatggcggatgggacagggctatctgtcgtcgtgtgtctgaggaagactttgctttttctctgtcttcctgtgttgtcatagctcagaggccctatggacagcgatgacagccatggatctgtgctaagactcagcc

SEQ ID NO: 74404 - DNA, 1049 bp, Homo sapiens
atcagggtagaacactgaggcgtctgtgggcgggtgtgtgcacatccacacttgtacactcacattcacatgcacatatgtgcacacgcatgcaattcatacacatgcacagttgtgctcacagcctcgcacgcccttgcacactcgcacttatacacatgcatggtcatgctcacagcctcgcacacgccctcgcacactcatccacacacagctgtgcacaaggaacacagagcagatgttctcagagggactctgacacctttgagatgagggttttttaatcactggaaggctctcttgggtctaacaggttcagagaatgtaacacctggttttcaaaacatttttcaaagaaatagagaattcccatacacaggcatacgtgacgttatgaggccggtggaggcctcgctcggtgttgccctgtatggttgagctgtggtttaaggtgaactctggagtgtgggctgcaggtgagggctccgtccctgggagctggtgggaggagctggaggctggcgccgccctgctcagagctgcctgcttgggctcgtctgaggcggttccgagctgcaggtgtctccaccaacctgctgtgctacacagcggggtctggggcagcctcaccactgcgtgtcttggtttcctcttctgtaaaacagaggctgcctccaacccttggaacaaacagggaagagccgtagcaggcaggatgtgagtggagcctcaggctgctcctggagggtgtggctctgcctgccgtgcggccttccacacccgtggctactgtcacattcacacacatggccatgctgacacctgctctcacttctgccctgtgcagtgcttgtgtgcagccaggaaggcagcagccgcaggtgtggagggcaaggggacctcctgtcgggctccctgggcgtcctggtacactgggcgctccttgctggaccacagaaaacaaatgggtaaggccacgtcttcatttattctactttgaaaccgtctgatttttctaagctgtttcagtagctcatgcgttgaataag

SEQ ID NO: 74405 - DNA, 1040 bp, Homo sapiens
cccctgcccagctccctgccggaggaaagactagggaagggaagcagaggaggaacgaagggcgccggcagagagagtaacaagtagaaacttcgccgatctgggagcaggccgagaaactctgttgagctgctaaagaattcttcattctcatgtgattttcttcatttctgtcttcccagttactaccaaggagctaaggaaagttcaggaatactttgtttagtgtcgccataacatctccaaccatgcattaagtttaaccaaaagctgcaatattccagattcttaaattctcaatggcaaccaatttatgctcaagttgaaaatctggcaagcaccgtacgccttcagcacacgcgtgggtccggattttcccatcacacacacgctctcccccgtccaaggtgcctgtttacttctggtctgcgcgggctcaggtttcaaagagcttgctgaaggcggcccccacctcggcgatcatgtcggaggtggtggtggagcgaccgtgcttctggaaggcttggtggttgcactgcctggtgagagagcaggcgccaaacgcggccaccaggagagggctggacctgcggagagggggacagcaggaggtgtggggaagtgggcgtcgtggtccgggggccgcagctaccctgggctctggttttgactcctgtttcaatctcaggaccccaaattgtcaatttcaagtctgatatgcccctgaggagaaagcaggtttatcacagcgaaaaccaccattaaccctccactactccctggcaggaggcacacaggaaacgtctatgtactcggagacaggtccagggctagggcacacagtgggccaggtgttcccggggaaagccaggcggcacaagctgcttagccctgtttgactgtgctctcagtgcccaggtgcagagggcatctgaggtctgagaatggggattcctgctaccagggctccatctcctgggggaggggtggaggcaactcgagtgaacacagcagaatgaacagtaagactcctgcccaca

SEQ ID NO: 74406 - DNA, 2143 bp, Homo sapiens
gcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacacagccgtgcttatgtgcgtatgtattgtctgactgcttttgcaaaacggcagagttcaatagttgcacctgaaaccatttgacttgacaagccaaaactattttctggccctctgcagaaagggtttgctgacctctgatttagactagcatctaacattgatttgcccacatattgaaagggtcagtggagttttcatttattattttttatttttttgagattgagttccaggctggagtgcaatagcgcaatcttggctcaccgcaacctccgcctcccaggttcaagcgattgtcctgcctcagcctccccagtagctaggattacaggcatgcaccaccacgcctggctaattttgtattttcagtagagacgcggtttctccatgttggtcatggctggtctcgcactcc

SEQ ID NO: 74407 - DNA, 1078 bp, Homo sapiens
gtaatggagtcttgggaagtttttgtgattggatgcacctgagctcatatcttggttctcctactttcttgggcaagtcactaaactactctagatcttggtttctttatttgtaaaatagagtaaaatgcccttttcatttggccatccagaaagttaaatgagatcacatgtgtgtttaaagcacataggcctattcccatttgattctttcatttcttcttctcccttctttctgatgaaggaggactttagtttgcttctgtaacttaacccatacttaaacaggaagagtatatttagcattgagaatatatttttttctgcagctgtcctagattaaaataaacaaaaataaataaatgaatgcctaccattctgagcagctcagggtgtatgtttgagactgctttgaaactctaatacaagcacaggcatacctgtcctggtgcttttgcacacaagcctcacactgtccaagaggacagagtgtgtgtggctcccaaatgcatgtggagccccctccagatctggggaggctgccccatatggtgctggacagtggctgcaccaggacctggaggggaacctgagacctaggcccaggcaggtgggggctgtgaacatgtggctgggagaggccattgtccatacacagacagcccaagttgttcaactccatttgccaacccatgccctgcccctggcttgactggtccccctcctcttctgctactaaagtatctcctgaagctgagaacaagccaatgaggatgatggtgccagggagagaggatcctgtgttggtcaaggatgtgcgagtagctgttacctccattggcagttttgtcactaaaagacctcattcacttgagcatttgaggatgaccaaatagaatcactaactttggttatttccagtttggtctgcattagaccatgaccaaggaaagctgtgccaatgacaaaccatatgcttaagttttcaccacataaaaagttacttttaggcagaagtcatgatacactttccaagaaatggttgtggaatattgtccaagctgcgggggattcgtta

SEQ ID NO: 74408 - DNA, 7306 bp, Homo sapiens
tgctgggattacaggcatgagccaccatgcccagcccttttttttttctctctctttttttcaaaagatgccctgcttacacactgatctcttaaaagtgcatgcctgagtcatagtgaaagtggagcctggcctgtggaagattttttaaagctttgaatggataagactaaaatccaccattgaatgcctctggtcttaaagcacttgtatttgaagaatgcttttggcctcctacctaatcagacttctgactaccccccatccccccaactacacaaatcacactgttctgtttctctcccccatactaatttcagaaatcgggtttctcattctgtacattagcatctttgtagaataatccagatatcatatatacagtataatcaaaaatgactcgtgggcctctaaaactagagctaattcaagctgcaaagttccattctccctatttttaaatgtttatatgaaggaggtatttagcactgaaagttgctatttgtggtgtatattctttggcccagaaataattctaagtatctgagttaaccagaaatacacataaaaatgcatttatgagtatgttaattgtggtattcatgataggaaggaaaagggaagcagcccagacagctgcagggaatttggttaggcgaatcgtaatacagccatagggcagaggaaagattgttttgaaattaactgataggacatttatgccatggtaaatgaataaagcaaggtgtaacagtgatttgttagaatcctttttggtaaaaacattcttaaacacgagaagccgttcagacacatggagctgcttgttgtaagaagtgagtcttgctaggattcagaggcggaggtgcttgtgcagcgtgggtatgacatggggcattcgcatctccacagtacagagaatggtcatcttggaagtgaagtgcccgtgtagctttagcttcacatttctaacgctttctgtattttggtgtaattattttactgtattttggtgctcagatcaaatgccactctgggacagtgctgacagactagtcttgagtctcttagcctttacattattttttttgttaatggaaatagtggatttttttaaaaaatcaggattgttttaattgtatgtaaatttaagaattgtcttagtattaaaaaaaaatctgctgaatttgaaaatggagtttggaattgtttccaggttatataaccacttcatgtcttctaaatgtccagaaaattagaatttttgccatcaagtaaatctataataggcatctgaaattccatgaccttaaaatctgcacatgtcaagaaatctttttgattgtggaaaagtttttcagttgtgtgctaagctcattagtgacctgtcgatttttttttatgtgattgtttaaagtgttcagtgctcacacaaaataatgtaaactgtgtgtctgaacacttatcttgttacagacaaaggaatctgaaatagtctttgttttctgtgcagctcaaagcttggattctgccgtgccactcacgaatggcgacacagaagacgatgctgacaaaatgcacgttgatagggagtttgctgttgtaacaggtgggagtggacagtttcctgttagctgcaacaacaatccaatggttgaagacaccaaacagcaggagagtggttctgttggaccaaaagaaatagaaatatatactgtgtcagcaatgcagaccccctgtcgttgcaggaatcagtatgcatattatttctaacataagtttttctcagatgttttgcactttgttgtccagtgtctttttaaaaatgttatactataatttgcatatcttgggcaagtttgtagatacaagaagtgttttgggtatattctgtggacatgaaaaatgtaagtgcaatctttattctgatttgaagctattgcttaatgtgccttgcttatttttaatgaggtttgcatttttaattttctgacatatggcctttgggtgaatataccgaacatgctacagttaatattttcaaaccaatataccacaaagaggacgactagcagtaaacactgagaaactagtaaatgtggttctgactcagcccagtcactccagcatggaatcttttacccaggacttggttgctctggtttctgtggtcttcattctgagtctgttaaaatggtaaacactgtgtttcacaacacacattttatacattaatgtttttagtatattaaaacagtattcctgtttccaatttttaagaagcagaagcagctcagttcttatagcatttagaatatctaaaatgatttgtccatttagctattgcttttttattcaggtgactacaaaaacatttttagccattctcttaacatgtatgaatatttagaagtagattttttttaagtttattatgtctttatgcaaattcttcactggggatgaaaaaaagaagagtatgtatattgtttcccaaacccacatgaaaaaaatcatttgtgttcactaaacttaaaagaaaatgtgttcatctttctggaagctacagaattgctgtggtcaccttcttcccagtagagaaattcagatcagttagtatatttaaaataataggttttctgtagtcaggggctatttgaccttagctaaagatccataacaaaactcaaatcctgctttttttaaaagtgaccttgctaccttcttttgaataggcagaagtggccaccttttattcctcagacattagttatttgttaaactttatccaagctggaacatacttttgaaaaacccagcccatcccgtctaccagatgccgagtccatacaccctgtgtttcccatcatttgatttatgacactctgactgagtaagcaatgtgttaaatcactagagattactcgaggctttccttgtgggacatggcactccacgtccactggaagcttgagggagctgccttcacagtcctttgagaatcagaccaaaagtcaggctgctctcctttaaacacttgagtaacttcaaatttttgttctgccaaaattatttccaagaattctacatttttgaacaactgtgtacagctatctttgcattttaaatgcccctagtttgagactcgggagggtcaagtgtccccacccctggaaagggctcggataggagggtgcttgcttctaaatcctgatcttctctatggggttggctggaagagaagtaggatcttgtctgaaacctcatccccagcattgtgtttggatgttcgtgggatccgagggctggccgggcagacagaagggaagtgcgggtcttggctggcagctgggagcagaggaagggagagcgttggaggtcgtgatgtgcgtgctctgcctcagtaggtctgaggtgcccactgttgttatgcttagttttattagattctctgtaacaacatgagcttaccaaccagccttgattttgagattaaataattgaacagattaactgggcactgaagtaaaattctacctactttattctcttagtaaaaactatacacacaataaacaactgtcaaggttgccatcatatttgagttttgtcacctaggaaaacattgtttatactttgtttttgaaaaaattcatatgaatttcccctgggaataacttgttttatttcagtttttattttctattgaaacacttgttttctagtctaggattttagccaaatagaaaagctatcatttaatttgggggaaaaaaaatctattgtcctgtgaagaatttatagcaattattaaactatgttgcttaaatataaaaaaaaaggatgattaatggaatatttagataatgtttccattcactgaagaagccgtgatcctttattggcaggaagacttgcaggacatatcagaagcctctgtcagaggtttacaggaggtgagatggaggggaagccctctatgggaagagtcccatggtgtgtgacatgttagggtaatcggatgtatttaagctgcgtcctcattctaaaagttattagaactgagctcttctagatttaataacatgctttgctttggtagtgaagaacattgagataaaatctagtattaccgagttagagataattttagatcatcccttatactgttacgtgaattcctgtgaacatgaatattactgattctcaagttccagtatacagaagaataacttgtcattgcctgtcctggtgtacccagatgttccatgatggacgttttatcccataagacgtctccctcctgatagatgtctgtatatgcagattaaactaccaacattttttccagcaaaggtggtttttgaaagtaacctaatgaaaccctggctgccatggtcattttaattgctggactgagaagaagcgactctgcgttgtgctgttggcccaggcctgcatgcctgaggactgttggccgttacagttccttgctgtggtcgccggtctctctgtattctgccactgctctcatgtggcatttggcagaagtactacgtagatttctgtgctactgaaaaaaataaaaacagtggttccttttaatagccctgatttgagacttaggagagggtcaagagtccctacctgatttatgaggagagaagattttttaaaaacctcatgtgatgctgtcatacatagttcaaagagcttccttaattcacttcatttacctttttttccattttcgcttgagaactagagaagtttgtgttctgttggaaccctctgtagaacactttacactcagttctgatggaccttttcaggggcgattttttaaaaaccgctctcgaaagtagtcttaaaatgagagcactttattgatggcttttcaggactgtgttggtatttttcatgcagtgtatttgtcagcttacatttttcagttgagctacctgatgctactgacacacacatgattttcctatcttaccaggcaaatactactgttaacgttttaatagtaagtctacttatgcacattgattttactttgaaaaaagaactggtttaaaaggaaaaaaaagaaactaaaattctttaaaattgtaatggcagtgaagcattttatagtttctcctccctcattggttctgaattttggtgacaggtgtatttcttaatgcagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtacgttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaacgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtggaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactcagtgtgtccctggggtttctctctgggcttgggggccggcggggtgtggatatctgtggaaggaatgggaagggaagagaagtttactattgtttcattttgcttataagattttacttgactcttctgacactcttcatacggtgttttttctatttttgagtttctactctagttttatgggcaccgttggtactgaacctctgtggaggaaggatgaattgcatgtcagttcagtattgtgcctgggtgcttattttcataaaagacagcaaccataatgttctaaacttctttggttttagcaactgttaattaatgtaagccttttaggaatatgaattacagttataaatagcaccaatatagccattctggcatgcctacatatgcaatttaaaacattcactgcatcatgcatattcttgtaaaaacttaatagaccacaatgagggagcattatgctttggaagttttgcaaaaattacagtgagaacaggaagagaatgcatggcgctgtccaggccaccgcctcccatc

SEQ ID NO: 74409 - DNA, 2583 bp, Homo sapiens
atttttatttgtcctaatactaagtggtagcttctcatttctctgtttcttgattttggagagcaagtctatgcttatctatagaaataatcagtttgtaaacttatgttctccttgaagagtttttgaattttcatgtggcaacttatttttctgttcacattcttgacagaatagaccctcccaggtcatctgcacttctgatatcttttgaaagtgaaatataccattaaaaaaaagtccagctatatgatgaagctgtcacgtaatattagtatattttctatttcaataacaaggtgatctgattttgtacaaagtataattaatgtaatacaatctgcccaaactttggtgcttccttttcatttaattcatatatcaaaataaaaatattatgcaatactagaaaatactcatggccattcatagccatgcagtcttaataaggctaataaaaatagtgactttagtctgtaatagtcctgcacatagccgccttatatttttaagaattttgttggtttctgagattctcaattctcttttatctctgatcagataggatttgggtcttttttcaaaaggtgtaatgcatttatcttatgctttaaaaagtagagacgcttagctagtgtccatgcacacttctcatttccaaggtcagagctctatgatgtctgcaaataacgaatacaaggctattgtcagtccttataaataagaaaatattatttgtccctaattctgtagttttcactctcaaatgcggggttttttttttttttttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaaggtgagaccgctttgcgggtgggaagagcacacttatttttcctttctgtaatatgttttctttttatggctgagcgcaccttcgagatgagaccttcacttcaggtggtaatgcgcctggtggattgtgcggtgacggtggagatttctcctgtactgccactgcgaagatgggacttaacaaaagggaatgtgagggaaatactgatggcccaagtgtaaatgtctatgtggaactttttgagcacccatgtttacctgccatgaattagattttttaatttgttgtatctgtttgaaatatatctattaaagaaaatctgccactgtgcctgaatttttttttttttttaatttgcttcttgtaaatgttcctgggcttataaaaattgctgatggtctggcagtaa

SEQ ID NO: 74410 - DNA, 7368 bp, Homo sapiens
ttgctgtgtctgattgcctttcccctctcttgcttagctgatagcctatgaagatggtctttcaggttgtttcattcatgcagtgtagacctgggttgactgctgatgttcacagtggctttcctgggtctgctcacttttctctgcctctgtgtgtgcttcacctccccaccgccgccaccccaccccctctgcactttctgaaccaggaatttcattcttatgaagcttggtttgctttacctttgtgttcttctccctttcctctaataaatactgaaaatagattgggaatatttagtaaatattccctctagtaaatactgaaaaatagatcaactgttgaacctcaagccatcttgtctaagttgtggtcccacttcaagttcaaagcagaagattcaagatcggcattgatgatgttgactcgggttagcattggggtaggcacagaggaaagtgggtagctgagaccatatgtcagctattatgtgctatttcttggccttgatgaccgttttaatgtgtgtgtgtggttggttggttggcttgtttgtttggttacttattctgggtttatataaaacacacgtgctaagatccagtgtaaagtgatttataaatcactgttgagagcaatcacgctgtcactactggagaggccccaagatatttggtcaacgaccaaatatcttggcccctcctggttcgttctcatcctccattcacgtatagatttctttgtgttctgcttcagatcttgctcaacatgttttacttcaaaaaaggatgagaaggtctctgatctgtgttaatgacattacttccaaaatgtcagaagttttgttctaagtatgtgtatattttgctttttgttgtttcaggattgtgagggtgaaactcccattcacaaggcagctcgctctgggagcctagaatgcatcagtgcccttgtggcgaatggggctcacgtcgagtaagtgtctttcgtttattctttccagctaaagatgtagttgaggatgttttgtttaaaggcagtacataagcaggcaaaagtcctaaaactttgttttcaaaattagtaatgtaattttgccttttagaacagttggtgttagtgaggaaaattgtgtggattaaattgatctctagaggagggggtttaatttcacagcagcctcaatattcttgtcgagagagtgtatttgaactgaaagaacagttaactaattagatttggaacttggcatcattactttgccaccattactttgccactaactagttgtgtcactgtggtctttaaacttttctttgcctaattttgatttcaaaacaagaagcttggattggattaaaatatcttttcagacctctctggctcagaaggtttctgaagaaaattcacttttctaggttttgatttccacgtcttagcagatgtgagaaagttatgttttaaagcccattgtaacttaatggttgatagttccttgtaaaatatgactatttacattaaagacctcaagcttgctgtaagcttctggtactggtggcattatttttaaatatctttcgttttagcccagcttacatcagttagcttatttatgctttgataggacaatcttaatgtttacgtgtagtcttttagaaatgagatcttatatgcaaatcattagccatggcattatacatttattttagttgttacatttatttgtattaactttttcttaaaaatttatattataaaaatttttcttctgcagttcacagcattaacaaaatggatgcggttttcacccttaaatgttgagtgtaagctatagagctataataaccaaaataaccaatatcagcttttttgttttaccttaagtgttatgaataattcatgaaaattaattataaaccacattattctaatcagaaatgtgaacatttagacttcggaggaaataaaacccacaaaactagtttaaccctttggtttccatttcattgctttgactctgtattatattgaaaatagatcctagacagcaaaaccatacaggctaatgcacgacgtgtgtaggtaccggaggctgtcaatcatctgtgaatagcttagcttctgttttgttaagtttattggcaagattcgccattagtttgggctgtgatccttatatagtgatctggtattataaacatggcctctgtttactgttacattgcagggactctcgcgacttcatgtatagttgtgactaaaggtaatgtagaaacaattgatagtatgttttatatactagtagaacattgagatgattctcagtggattgctttaaagcaaagttatttgtgcatttttcttagctgtagttagatttaaaactctaatttttataacaaactttcattataaaatacggagtcataacatgattaaattgcttgtcatttattcaaacagtggataattagaagttgatatttttaatgactttctaaataatactctaattggtcctgaacattttattacaaagatgttttattcattttatggatagcttaatcttttcagccaataaatatcacgatgtcctttttttttagtaggtgtcttttaaaaaatgagaatcttttatttacaattctgtccttggttacagggccctcaagtgtctcttttccaccaggtgtggctgagatgggctcaggtgccagtctgtttttccttctcagtataagagccaccactcaagaccctgcattatggtgacttccctggactgagctttcatattttttttagaagaagtatttagcctgagctacctagccaaaaacaattataagcctttggcctggagatagagcacaagtaatcattattcattgctattgtatatgtggttatttagttttaacatcgagataaaatgtcagttttgtcagtaagttaatttgtaagttgcttcttgatttctgcacattttaataatttaccccatttagtccaccaacgtgtaacagtttgaatctccaaaataatggtactaggtctattttattccctgtaacgctgctcatatggtaaagtgtagtcctagcaaatcataaccgtttcttttttttaagacgttcaaggagcatagaattaacttatttaaagttagtttttttcattcagaatggacgagattattaactcttcatattacatgctataatatttaggagataatataaatttttccttttcctgtgaatagattaaaagctgccttatatcagtattattaaattcatttgctcttaattcctgctttgctttttatatatctgctacataaagtgcccaaagtcttaaattgttgtgcttttttggacatcaggtacataataataagggcaagtacactaagtgtctgtggctagaatggtttgttatataacttacttgttaatgtaggttgcatctgtaagataacgcatttcagctgctgtgcatcgtattaaattttctagcaccacacgtgagtatgttaatggactttctttttcttttcttattttaaatcttgagttttggtgccaagttttctgtgtgtgaggctctgtttctggcttatatgttggtcattattatttgccattgtttacatctaaaaattaaaacgcacaggattaaatctaacttgtgaccaaactaaatgtttgtgtactttaaaggacctaaatctctgtgtatggagttttcagcaagcacgtgaagttgtcaccatccttaatcttgcttatatggtagttccatttttccactgcccccaatatttgagtgctgcttgcttggtactcaggtattgactggaagaagaggatatactattacaaaaagattgtcatctcatttttcttttgaacgatggaacaaataacagcataacattaagtcttaatgtgattttggaaaaagacttgaaaacttgctgtctgctgataattaagaagaccttttcactactagcattgtaaatagaattcgggccttggaatagctgtactttcagtaatttggtaccaattacttttggctgatttgtgtttattttcttgagagataagtggaggatgtttccatatcaaccagctagtaaaatagctttttgccactgagtagaaataaaaagatttagaatgaaaccagcatgacttgcatctcaggcagatttgtaggtccgttttaatactgcattatacggatgccagtgtttaatggcagagtctcagaacttttctacaggagaggatttcttgagaagccatttattctgtggtaaccagattttcagctgggctacatgtattttaacttaattatttttatcttaactgggatcatcagatagcttgagaagcatcgatagccttatataagcaaattcagtgactcactctagaaaagtctctcttgcctagtttaggaagtaggcacagttggctataacaaagcctagaatgtgatgttagtagactattctaatgccacaaagaatactgcttcactttaattaaaagaaattttaattaaaatggaattgtcttagtttggatcataattgaccatttatgacccacctttgtttaccatagagccctgtctagaaaccagattttcattaggtcaaatacaggtgatgagcatatttaatattagtgttaaattcatttgtgacttttgcccttagcaaaatgtaacctagatttacttttagctattcattttgaaattcgtggtttctttatatttgttcatttttttgcccatcagaataatatttcagttacaaaatctaccagaattatgactctgaattcatattttctgattttaggtcctctgaattctagtcatcctcacatcctacttttgcctcctcttttttttttttttttttttttctaaaaagagacagagtctccctttgtcgtccaggctaaagtacagtggcatgattatagttcactgcaacttcaaactcctgggctccagtgatcctcctgcctcagattcttgagtagccaggactataggcacataccaccatgcccaactaatttttaaaaatgtttagtagagatggggtcttgctgtgttacccaggctggtctcaaactcctgggctcaagcagtccttccaccttggcctcccagagcactgggtttacaggtgtgagccactgtgcagcctccttttatctaattgtccccacagcagacttgtctggtcttggctattttccggttgttaaggtgtttcaggatggaggaatcagttcctgagatagttattaagttctgcctgctagaaagggacagtaagtgggttgatatcattctagacttgttaagaaattgttcagaattttgattgtttttcatagcagcttgattaaaatacagattttaataatttccttactacttttataggtagtgctttcaaataaaaccagtgtttgctaaatccaaatgtctttctcccttgctaaattatagcaggagcatgctaaatatttcatcagactactggaatgatggttttacattttaatgtttgaaaacataattttggttcaattgcagtgtaaaactattctcagtaactttaaacttgaaaacttggcaccaaatttatttaggtagaaactctttaaaaatagtttcttcctattattaactgaagaatatatttaagaaagtcttcataattaaataagagtttggataccaaagggttaaaaatacacatgtatttcttttgctgaagatatcttagatgtttgctaatgttttatctttacaaatggacaatttagtaatgttttttatctttttttaatgattccatgtatttgcttatttccatctaggaatagttactaatgtatttgagatacagcataccaaattttaaagtaaccagaatcgtgagttgatggtttttagtccatactgttaaacttatgttgaaatattgacatatttaaattggcttcatgctaaaaaattaccaaaggtaatttaaaaggcagtgttttagagcagtagctcatggtcaaggtggtcacatgacaatggcttaagctcagtgtgcttctgcaccttatgttgtctatgtatttttaatccaaatgttgcctgcaaatatgtgatcccttattatttaagtttcctgtattatgaaccattgcccgttttaaatcacacagaagattctgaatctgtaaaaactacacatgtcaatgttttacagctacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgaggtatttgttgcggtgattggttttaacgctaatctaggaattcagatagagatgctttagatttgcatgctttgcttacctaatttatgatatctacctttctatttgtaaactaacaatagctaagttgagatcagaattttaacagaaatattatttatataaaaattgttatcttttattgtcacatggcattaacaataagaaaacatcctgaaggtgatgtgacaactcggattctaaaaattatacttcaggtatttcctgatccgtggtttttcaaaattgaaacaaagtcgttctcatcagaatggcttctcctttgttctggaattgtggcactataagtggaaactggtgggaccctggctggcttcagagtggagcctaatttttaaagttctttaggggagaattcttagatataaattttagtgaaagttctttgggggagaattcttagatataaatttgagtgtttgaagagacagggtcttcctgtgttgcctaggctggtctcaaacttctggcctcaagtgatcctcctgcttctgcctcccaaagcgccaggattatagggttgagccactgtgcttggcttagaggtaataaattttaatattctattcagaataagaaaatatagcatataagcatttgtatctttagtaaagttactgccagtttgattttttttttttgcaagttacttagcagaacatgtaattcacagtaaagatgattctgtgttgtaccacattttaatattcctgttttgaaagaatagtagagagaaaatgggtggcctgctcagtgattgcttttcgtagtcttggtgaatgttacaggagattgaatttatagataaaagcacagtcatcgtagtttc

SEQ ID NO: 74411 - DNA, 1169 bp, Homo sapiens
gcccaggttggagtgcagtggcgtgatctcagccctctgcaacctccgccttctgggttcaagcaattctcctgcctcagcctcccaagtagctgggattacaggtgcccgccaccacgcccggctaatttttttgtatttttagtagagatggggtttcaccatgttggccaggctggtttcgaattcctgacctcaagtgatccacccgccttggcctcccaaagtgctaggattacaggcatgagccactgcgcccggcctacacaaagttttttaacccaccaatccctttaacgtttttgtttagaatagtctgtgcaacaaacagttttgatagaagtcttggaacagcgcagtccaatattttctgattttggcttattcaattgtagggaaacaaatatttaaatctgtatagtgttagtcgtctttttgcatttttctatttctatctaccgtctttttcataaggacaagggaatatgttatcttaaatgtcctttaaaatttgcatggcattgggaaagagtgacttaatctgttaaaaaactggtaacaatgccatttgtcaccattatagaatttcgattattcatgtaatattgaatagtgtactgacatgtctgcgtgttttcattacccctcttgttttcgaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggtaagagtgctggtgatggacttggtttgcttttgctttttctttttgcagttataattatacacggtattgctttaaatcgaggccttaattagagtttgatatctttacctgagggcagactggaatttatgtttcttcagttgtttgtggaggatagtaggccctttccataggaatgctttctgttcatagagtgctttcacctgttgtgtgataaactgatccagggtgatgtgcccaaggttatagctggtaattaaaggagcctggccttgagcccaggtttcctggctttctactcatagctgccttagcctcatttccacagataattatgaaaacattttcatcct

SEQ ID NO: 74412 - DNA, 1014 bp, Homo sapiens
aagaagcagttacttcattgtttccagctgtctgaatcatagggctctttggtcttagatacggaaggggccttagaaagcccctgtccagtgtccaaacattcccttctgagaagaagccgttaggacagaaatcaggccaggactcagggctaccgcttgcgaagtccaggctttctccccagccctgctaacggctgccctcttacacaggtttcaggctcgtgttcttagaaatgtgctagtggtgcacaagatcccctaaccgttggtaagactcgtttgttgccagaggactaaacgagttgtttaaaatctctgttgtagcttttataccatattgaacagtatctttccagaattccaaatccaagtttctaaattgaacccaagggtaacaggtttaaagccagcgagccctgaatagctgatttttggtacgccaagtgattttcatccgttttatttttattggatttgcaacctgttcatcttatcgctaattaatactttcattttcacccagtgaattaataaaggcaataaatagacatcagcctttactcccaggtccaagttggttgaagagggtgttttgaatctgtgtactcttcatctcacaggagtgtttactgaaagcctgaaagtgctaagagaaatggaaaaagaaaccttgagttgagatggtagtgtcaggtgttttgtcttcaggtgaggtctctcctcttgaagagaattgcttgcagtcaggcatagcttgttccctaactgcattgtgattggagtgagggaaaatgagcagtccaggatcagagaacgtgggttgaacagttgcttggcacatggtaggcacttggtaaatttgttgaatgcgctaaattattttagccagaggctatcatggtattggtgcttggccacaaagtcttaacttgccatgttagtcacccactaggtgcattgctcagttatgctgtaggcttttttcccccatagggttttgaaaagagtaaa

SEQ ID NO: 74413 - DNA, 1088 bp, Homo sapiens
ctcctaatcggctgctgctggcgtcctctggtccaggctccgctccctacccggctgctccaggcatcctctaggctagaccccgccacctaccggccgctccaggcgtccgcagctccaagccccgccctccgcccggctgctccaggcggcctccggctcaagccccgccccctgcccggcggctccagaggtccgcggctccaggccccgacccctgcccggctgcacaaggcgtcctctgggccaggccccgcccccagcccggccgctccaggccccgccccgccccctctgtgcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaaggtgggtgcgaacgctttaaggcgccattttccccggctgtccagtgggagtcggggaaagcgggtctgaggtgcgggggacgtggggcgtgccgggatcgcggggcggaagcgggatcgacggcgcctgtgccccgaggggcctagggcgcctgtgcggcagcgctcgcggcccggagtcgcggcggggcagccggggggcgcggggcggaagcgaggtcggtggcgcctgcgtccggaggggcctagggcgcatgtgcggcggcgcgcgtagcaagtttctaacaaggcgggctccaagggtcccggcgcctgttggccggatcctgtgcgagcgcgcgcgcgcgcggatggtgcggggccctccaggccgggccggaggcgcgagcgatttcgcagagccgggtattaggccgcgaagtcgcccaggcggcttccggggagcc

SEQ ID NO: 74414 - DNA, 1066 bp, Homo sapiens
tcacctcggaattcttgtttgattcaatttcaattagctgggctttatgttttattattacattttcatttcccttaaaatgaatgcatggatattataatctgtgacttcactgtgtatcattctaacaatgaaatgattgggaatgatacacttggctcaggctgtcttttcctcagaatttcttaaaaataatattttattttttggagtagttttaagttaacagaaaaattgaacaaaaagtttccatatacctccttataaattttagagaaatactgaatgttgctgtggagaagtctgaggccaatgtgattaccgttctctgctgtgtgagatttactttgctgtttgaacacgtgaagtattatttccttatcttgaagttcaatagcataattaggatttatcttgatgtttttattccccattaagtttcacagaaaaaaaggtatgtttgatatgcaaatttaaacttttagtttcaagaacttctcttatcttaatctttgcatgtaccatcaggtatctgtttggttcttgactcagggacactggtttttcttatattggactttcattgtctgtcttcaatgtctaatagcttttcactgactaatgttactcctttgtctttttcacttctattcattttgtttttgtccatgcaagtcatttaatttctagaaatacctatattatttcttgtttctattctctattgtaatattgttagatcctcaatttaattatgcccctctatatcaattctattgtgttttgttcatctttgggcttttttgtaatgtgtcagtttttccatcccatgaagaattgagaggactttcctctgtcttttgtattgtgtttcctctgtgttgttgttttggttggccttttgcctggtattctttttctttgattgctattgttttaataagtttgtgctattccgtgtatttcttttcactttgcttgtatttgggcatgtctctcagatgttattatgatacacagtgaatgaccatttggtcctcttccaatcttctttaagtcatatttg

SEQ ID NO: 74415 - DNA, 1067 bp, Homo sapiens
gccaatatatagcgttaagatcaacagttatttaaaaggtgttaaatatagaaattgaagtgtaccataattaggaagaaggatttcagtttttaagtggggtgtattggcccccatacaggatgacaacaacttgtaaataaaatgccacgtaagtgacttgaaaaagtaaaatgtttaatttttttcattcacatgtacatattctcttgctacattttaaatgaggtcagaaaacattttatttaatatgaatttggcttgcattccacttttagctatttttcttacttggaacatctttatgaaaacagaatctgcatattagagtgaatggctgcctgcctgtccatgaaataaaaatgttccttaaaaatgaacctgatgtcacagtgaaattatgatttaagacaggaggactgaggagcaggagctgactttcaaggcattcaaaatactttgctgtttggatactggtacctctggtaatgaaagacagatgttgaaaagtgttgaaatgcatgcaaagttcaccaaaataggcttaaataaaattctgttccatccctaagagcaaagctttaagaagtgtcatatgctgtattgataaaaacatgtcgccatcaaagaatatgttgtttggcatattaactgtattaatattgattggccgacttcaataatcattttcttttaaattatagaaagattttcctagaaaaccgtagcgttcatttcatctctaaaacaacaaagagaagaacgaataaaatgttgagcttgcagaagccaagttgaaacaactcaacatattctaaaactacagtcatctggaaatttcttaggtcagagctgtttttgattccccctgagctccagttggtttgtgttaaactgactctgtcacaatgaaagtttaatgtgaaggcagcgtattgtagacacagttactggttctctggagttcaaaggtaggtttttggagtaaaatattagccgttttctgcctctgagatccctgtgtttcagaagttttgtgagctttttccatttgctaggcagagtta

SEQ ID NO: 74416 - DNA, 1050 bp, Homo sapiens
actgcatttgctggctcactaaaaagaaagcaaacaaactgaaattcaatttaaatcaggagtgcctgaagagatttcctgagaaccagactagaaactagtgtttatgttggcatcacacagacacaggagagcacacacacaagcatacacacacgcatacatgcacacttgcacatgcatgtgcacacacgaacttatgcacacacgcatgcatgcctgcacaaacatgcacatacgtaaacacatgcatgtaaatacacacacacacagacacatgcgtgtacatagacacgcacacacgcacacacagacacgtctgacgggggttgagggagtgggggaaggagtgctggcacatgtggcattccattttctcaggggcagctgctctgtgaactctccaagcccagtccaaaggatgccatctcaggacccggccctcattctattaatagaagtcactccagaatctgcctgctcgcctcctttctttaggcactgcctgcctttctatacatcttaaaagagaataagatgtctgcccagcatggcaggcagcatgctcctctcgtttgcaggcgctgtccctcgcaatacccatactgcagatgaggaccctgaggtctggcagttagctttgccccaggtcatctggctgcactcggaggcggaagattccagctcaagactgtgagctttctcatggaaaacaagactgattctgccacctatactgaacttaggggaagattcgcaaccactgccttcagaaatttacaaaccagatcaggaaaggagacggaggcagcagtgtaactgagcacccaggggggacaaaagtgaggactggaggggctggctcaggtcaccggccacaggggcagagtgggagccctcaggagtgcctggagccactgcaggtgtctcacttctcgggacatctggaagcagctctgcccttcagtagacagaccccaaaggcacccagggtagggccccttgccctgggggaacctgcagaagctcctgcagaagtctgtgtctggg

SEQ ID NO: 74417 - DNA, 1022 bp, Homo sapiens
gaccgtgagccctgtggaaacccacccatggaggggtgcatgcacctgtagcaattggcagggaactgagcgggagattagggcactcattaactgtcttgaatgtttggttaagaggaagtgatcttcagtgagggtcagcgtgtttttcttgataaaggaggctctagcaaactgtatccctttcaaccgctttaggggagaatgtctgatattttttctttcctttcccacattttaaagtgtgttcttttccttcctgatggatgcatctggtggtttaaggccaataagtgttgcgttgagcctgaacagttgtttgttactctcaaaatgtctaagactttcatctccagcttatacatgtattgatgtcaggtgtttaatatttcccctttgattcatttgatagtgaatggcttctgaggtcaggatggggacactgccaaaactagctgctctctgctgagtctctgttttgcaggtgacatttgatagtctagatttgatatcattaaggtattttagggaagtcaatgtataagttttagaaagttcaggtgcatgttgaggactattgttgtgagaatgttatgaatacacttgtgtctctcctgggattgactttttctttccctttagaaaacgctcacagtgtattacatatcatgctaaatggatggagatgaagcaaatccaggggtgctcattgggaatatagttcctaaataactgcagtaaatgtaagtcatgtcctggggaattatttttctaactcaaagcatgaaaacatgaacaattcagttctgtctccatgtgtgggagaagtaaactcaccacttacttttttctttttaatccttttttttttagaggaaggtgggtagagagtgttattgggagtaggggtagggatattgagggaagggagaatgatatacacacacacatacatgtacacacataagtacacacacatctatgcatatacacacatgcatctgtacacacatgtatatata

SEQ ID NO: 74418 - DNA, 1057 bp, Homo sapiens
aaccttggattggaaatactggaggagggggaaaccaattaaaaaaaaacaataaaaaacaacacagtataatgattatttacatatcatttataatgtactaggtagtgtatgaaacctagagatgatttaatgtttacgggactatgccattttatataaaagacttgagcatctgagggttttggtatccaccgggatcctggaaccaattccctgctgataaaaagggacaactgtatatgaaagcatctttgtagaacctgttatgtaggataacccaacagaggtttcccttcccgaagaatattttgctataggtttctcggaaaacctagaacatcaaatctgtgagggcaggttacatggaaagtttatttaattgaattagacatgtaggaattcatagattaaagtattactggcgttgtttatgattgtaaacacaaagaaatttattgttggtagtatttcatgttggcaaggaaattattacacgtaagtgaaagtgctaggggagattccaagaaacttagggccttttcaaaggggaaaaagacagtgtttcagtagtctttccctgataccctttgtcgtatcagctttgtcatttgtaatccagctgccttattggctgtgataatatgccttgctagtggcaggttttactttttcttcacctttgtgagggattttattatattatcctcttgaaactactgagttttgtttacgttaacatacttttgaaactcaattggcacattaagattatctgactttagtgtaaaactttttaaaaaagttttgttttaaagtaaattgaggctgggtgtggtggctcacgcctgtaatcccagcactttgggaggccgaggcgggtggatcacatgaggtcgggagttcgagaccagcctggccaacatggtgaaaccctgtctatacttaaacaaacccaaaaacaaaaattagcccggcgtggtggcgtgcacctgtagttccagttactcaggtggctgagacaggagaatcccttgaaccccggaggcagaggttg

SEQ ID NO: 74419 - DNA, 1093 bp, Homo sapiens
aaggttgctgacatttcatacagtaactattgtttttataattaagagtttatttgaaggttttctggaagagagttttcactaacatattccaagcatctacaatagtgcttggcacataataggctttcaataaatatttgttactaatagaatgaacttgaggttgtaagtgatagcaagtgagtttcattttaaagtaaaaaattagttttgacttattttgtgctatttttaaagagtaaatatctcttccagtaaatttaagcaagaggcaaatgttagcattcttcaagcttagtgtgagtcacacttgtaattacctaggagataataaaaatgaaaatatgaaaacagcacatgaaaaacctgataaattgttcagtcattgtgttttttgggaagttaccctgagaagtcattttgtatgctatgcatccagctctggcttccagccttgtaaggtgatgtgaagggacagggctgggccctgaaggacttggtcatctcccatgcgggccacagtgcagcaatttcccagtgtttaagaattgcttagggagtcaggagggaagggccttgcacttgtgaaatatgttgtgggatttacacatttcattttcacaaaattctgaaaggtgggaaattgataagaaatgttttgaaactacagacacaaaacttaaaactaatagcttaaattctagattagcttttgttctatagttgtaaatgtcaaggtgcttttcttccaggggttagtttagactgaattgtgtttgtaacagattgtttttggtgtatatattcttatttactgtcagtttaagctctgctaagatttgttaaagggaaaaaggaagtaaacttggttaatatgtcagctgttttggtgcatgccctccttaattacctgtagaaaatcagatattatcccccaattgttttgattatgaaaatatttttataaattggttttaaaggaatattgtgtgagtcgcatttattggtaaactttgagaagcactgggttttaagctggaaaactttgaaatttggaaaattaaaaaaatttaattactgttggaaagca

SEQ ID NO: 74420 - DNA, 1045 bp, Homo sapiens
gcactctgagttcctgaggagttcccttatgtcctgggaaccagcgagagaacaggttcccagtgagtaattacaaaaacacaaaaccctgagttcttttcagaccatatttagatgtgcagtctacatttaatgtgtttttaaaaatagcattcttatccaaaatatgtgtttttggccagatttttgtcagtttaccttgtatgttttctgtgatagtttagagaaagggagtggtcttcagttcagaggtgatacagtattcagatggaatgttcactcttgccctttagggaaggtttcaaggttagattgggtggtatccacttgggattctgagtatgcgagtgtttttaaaaaatgctgaccccagcatctctctggagagtttctgactgagttagcttggtacttagcgctgtccagctgggcatggtgaggagtgccagccatctgtcagggaggcagctgccggtacccacccagcttggaaaaggcagggaggaagccacacttttctctaactgtctcgttgtagaatgggccagcccagctatgctgagagtttgaggggaagattagtgtggcagtgactgagatctttaagaaatgtcgggccggtcagaaggattgttcatgtgggtgtttatttgcacgaaagccccacagatgatgagtgaaatgctttattttcctcctaggctacggatggtgagcggatgctagagagagccacttaatgtgccgtcccccccctttttttttgttttgaaaactttaaaagtaacaaaggttgggagactagagttcggtgaacatccgtgtgcccttctcacaggtcaccagcattctgagttcaaatgcctgttctttttttttttttttgagacagaatcttgctttgtcacctaggttggagtgcagtagtgcaacctcaactcactgcagcctctgcctcccgggttcaagcgattctcgtgcctcagccagcctagtagctgggattacaggcacgtgccatcactcccagctacttttttttgtg

SEQ ID NO: 74421 - DNA, 1196 bp, Homo sapiens
gcctgtgtaggctgtatgggctgctgtgtgtgtgtacgtggtgagttgtgtctgagaccacccctcctcccctgggtgctgcctgatctgcctgcatgaccgctgtgggacaccactgtctctggtgtcctttcctggctggcagtgtggtggtgtgggcaaagccaggctggtgggctccgatcttggttctgcctttgtaagctttgtcacactgtcttttgggagctcgtgtgtgtgtgtgtgtgtgtgtgtgtgtgtgtgtgtgtgtgtgttttcgttttctgcctgtaagataaactggcatgcagtctacactgaggtacgggctgtgtgggccagcacagcatgccgtggtcctaagcagggaggtgtccttcctttcccctgcctgttggggctgcgcttccctgcctcgtgtggaggttgcgcccggtctgcagaaggcagagagcatcttgttgggaagagccctgcctgccttcccgttgctgtgctcctgcctccctgctctgctcctctcaccccttcctggaaactacctaaaatacttggttacttcttttttgaagatgtattctctgtcctagtgtttgggtgttgatacagtggaatccacaaaattgaataagatttgattttcattttaaagtgaaataaatcatttgggtgcatgttgggtgaaagtgccgtaattgatagcatccgtcatcagactttaattttacccctggggtgtaggagtgggtgggattaagtacaaaatctgcagaagccaggaagtgaaaacgtactgctggatttctgtttttcacatgtccccaacaatatggaccatttgcattaaacttaaatagcaccacttatttaagattcattttttactcttgttctgaaatcacaagttccatttgacagtgataggacaaaattatatttttaaactttgcaaaccacactccagagctgtgctaaaaataacaatttcttgtgtcaagaataactttctcaagttcctggaggaggcgagctgactggtggcaacgcagaccactaaagcttcagtgagcccagaaagtgtgcgctcagtcccacattgcagaggcctctccgtcagtattgagatggtggaaagtgaggagaagcaaaaagacgactacttctttccccatttcccggtctggtctttttggggt

SEQ ID NO: 74422 - DNA, 1036 bp, Homo sapiens
gggttttgtgacttgctgccttgccactatgaaggttagtagaaatttatgtatgtatttctttttgtagtatacaaaattgacaaaataaaaaatgacttgaattttcagagcactaagattagatctgtagagctgaaagacattcagatctcctatttaaaaatgttatgatgaagagaaattttatgttttgcatataaggaagctgaggcctatttaattccttttaaaaaatgcagcttaacccgtatttgttataggtggttatgtcagcctagatgctgctctcatttgagttgggatttcttcttaaataataaatattacaacaaatgtattctgtatgaaagatgattctaaagactatctgttctaaggactgttttttaaaggaaggatttagcttcatgaaatcagttatattttgtgccttttgttagaaatggcatcggtaagcacatagaatgcttagatgtgttcacagctttccttttacgttttgtggttccatctgatatttccttgtgaactttaagaaagtgacctctggttttcagctcctttcttgactcttttagtgatttggtgggtttttctcttgaggtagtttttcaaagtctggttcttctttatttatgtttaaacatctcatgactatttttacttatttggaaaattatagacagaaggcctttagctgcagatgaattttgaataatacagcaggactttttcacatttggtgtcacttttcttagcttctcttggcgtgagcttcattacagcagcatgcggtgcctgcagggtgggtggctggttggatgctggtgcacgtctccattcggatgccttttcactgtgcaccggcccctgtgctgggtgttgggagatgtacaatctgccactgcagatttttagtctagggaggcctgtagacatccaccatcaaactatcatgacacgtgttctgggggagcctggctggggacctgaccgggtgtggtgggggcagccaggctgtcaaggcagggct

SEQ ID NO: 74423 - DNA, 1758 bp, Homo sapiens
gtggaagtttgaaatgagcacttttagatactgttgctggggatgttgcttggtgtagtttgtagaaactttttggaggacaatttagaaagatgtattaaaaagttaactgtaataaatatgtcttctgaccagaatttaatgtatagctggtttacaggtatattcaaagatagacatacaaatatttttaatgcagccttgtctacacaaggaaagtactgtatatggtatctggaaatatactggaaataatctaaaaatccactaatggagagtgggttccataatgagtggtatagtcatatagcataacattaagtgttatgtaagcaccagtaagtactgccagataaatgacatgttgtcttaacttttgtgacttgtggagaagtgcgtgtagtgtgactctgtctctgtcacatggatgtgtctgattaggcatcacagtggcagaccaggacctttgaatgctgtgaagagggtgtcctctggggctggagtggtgctggtggtggtcatggggcactggaagggaggaaactgaaatttctctaaatgtatttctactgttgggcaattatgctacctttgtactagtaaagtataatccattttataatgaagtagactgttcttggtataatttttctcccactcttcttccccttttaggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcggtaagtggccgagcctgggctgtgtgtggctttttgcgatgagcagaaagaagtaaatgtacttgacatagtgtttactctccagctggacctgtgcaaatgacctggtcttaggatacagttttttgttagatgtaatggattttcacctcagccccacattggggccctggcatcaagggctctctagttactagccagcatttcctttcatcctggcattttccagacgtgaagagaaacatctcgaatctttatcattgcagttttactgtgaaagaattgatctttttttttttttttaagagctagtgtcaggacttggagttggcagtccgcaggctgtgtttaatttttgtgactatgggtggtacttttggcagtggtgtgcaatgaagtaatttctgtcattctctttgtactagtgatagtattttacaaatgcattgcttccttatgttttgtagttgttcacattgtttcactgactttccgattttgaggcttgtgttcttatgaaagaatagtgatcctcggcacatggctatggctgccgggctgtcgtgcttcttgtggaagcgtgtgggtgggtggacagaggtggggggtgggatttgtgaagggaacaatcatgtgtgtcactttacttgcatcctgccctgtagttgaaaaacaccgttgtatactacagttcctcagattctgctggggaaagagtgacttacagagaatagctgatacacagggagctgtggaaaggacatgatacaaaattgtagctctgctctagggcttgggtgactgagcctcagagccacaggtgtttcatatggaaaatgaggatgatagttctcccttgtgcggtcttgtggggttgaatt

SEQ ID NO: 74424 - DNA, 1026 bp, Homo sapiens
tgtatgaataagtgagaatgtattgttagctctgggagacaaatagcacatcttgatgcatgtactagatgcgcagaaaatacgtgtaatgtgatttcctgatttaaaaagcactagctctgtaacagactcgggtgaaaaagaatggaggcagggattccactttcttcacttacgtcaggtccttcaggatcctcagcgtgctcctcagtctcatgccaaagaagacagtgtggtgcggtgcagtggcaggaggacctggggccgctgtctggctctgcttttctcagctgtttgagttgggagaagtcagcttctctaagaggaaaagttttgtgtgcagagccccttgctcggtgccaggagtgcgaggagcacctgcagttcacatccaggtgccttctcgtcccaccctgggctgggcctttgctgcagtgatagctggtggaaagcattcctacttggtttcatcagttttgcactttatatttatctgtcagtttttaagacttaaattattttggctaaatttgctacactagtacagggtattgggaaacattttaattttaaggttaatttataattattctgctatctttaaatgaagtagtaaagattgttaacattgataaacctttagtttttaataaatgtggtaataaggtgtctgagactgtcatattcactagggaaagtctgtagttcccagaaattgatttcaatttttagatgcaatctaaagagtaaactgtttttttagttgagagtaatattacatatgttaaaatacatagatttcaaaggcacagtccagtgagcttttacaatgtatatatctgttgtaaccgctacccaaatcaaaatacagaacctatgtatcaccttagacatttacgtcattctcctttccttgttgtccacgcccccatcctacccttcacctcttctctgatttctgtcaccatagattagttttgtcatctcttagacttaatacaaatgggatgatgcaggatgtccttt

SEQ ID NO: 74425 - DNA, 1041 bp, Homo sapiens
gtcactaggactgttagtttcctaaaatgcgaagccattcaagagcagtgcttgcgggcgtgtgctgtgttgatcctcttctctgttattaccttaatgagtgtgtttgtcaggtcttaatgtacgtgtagcattttcctgaagtaactagaagaaagaatacaggtgggtttttgagtcaggagggtctttgtgcctccttcccagggctgcccagagagtggaggggcaggctgaggcccgctcgggacagcagccccggggcaagtcaccattgctttagtgctgggagtcagagctgcggcgagaggaaggtcccccgagccagcaggtgccgccactgtggaacatgaagcttgtgtgccctcccgaggtccctgcaccacgagagttcccgctgtgttggccacagattcctccccaccccaaagacacagcagtgaattggggtcaggcttccctgtgccaaggctccttcctacctcctgcctttgtacttggattctttcttggtcctcttgccagcttttccatgtgtgtgacggtctttaagctgccacacctggggtagactaatctgctcatgctgtggagtaatttttaaggattggttcaagtgcagtgggttgaagtttaaagtcttatttgcatcctcactgtccttgtgttacttgggtttaagttctaagtgtgagccctgcgagcgcagaatgccaactctgaccgttttagcagctcagaccttctgcagcgtccagtgatggcagcaacacttgtccatggccagctattttgaatgaactatgggtgtcataatttagcctttgaaaatgatttttttcccagcagtttgttcctctgcacttggctccatgcttgcatgtgttttgtggctgccgtcagcccacagcactgtgtcggtaaggactgaggagacccactgtgtacgggctgctggcatcagcagaactgaagctgaaagagcagtctttggtcagagtagctgtaactagctgttttgttttattatggcactacttt

SEQ ID NO: 74426 - DNA, 1023 bp, Homo sapiens
tgggcttgtcactctgtcccttgtcgccagttgagtttcttgcttacagtacagtattataatttattatttgagataaaaatttttgtattatacacacatctgctacaaatgagctttttttggttcacaaacacagttcctccaccaattctaaaatcatttaatattgactttaataatggtacctttttctagaaaagcactaattgtttttttttttgtgggggggggtcttttttagggaaagcttccaacgacaggaatgacaatcacaaagcttgaggacagtgaaaatcatagaaatgcatttgaaatatcaggtgataggcacaagctgtgtgagtgctgtgtctcggggaggagaggcagcttgtccccgcgtgcagattcttgcttgcgtatttcagaaggtggtgtttaagcgctgagtggaattctggggggtgtgcacgcacgtgctttttacctgtgtttccactcggcctattttttccttctctcctatagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccgtaaggacttggtgcttctcctccttccagactccaggcgtggcatcccgtggctgagctgtcagcaagtgatcagttgctttaaaacctaatcaatatttggataaaaagtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaa

SEQ ID NO: 74427 - DNA, 1060 bp, Homo sapiens
aaaattttaaccaagtagtcttagatgaacagaccaggttcagttggccacccaaccgtgtctgtgagttctgcatttgtgaattcaaccaactgcagataactactcagaaaaaagaaacaataaaaagtaacaatataacagtaaaaaataatacaaataaaaaataattatacttataacagctatttatatggcatttacattgtattaggtactataatttagaaatgactcaaagtatatgggaggttgtgtgtaggtacaatgcaaacaccatgccatcttatatcagggactggagcgtctgaggattttggtgtccaaggggagtcctggaaccaatcccctgtgggtgagggccgactgagggctgagctttgtatgtgtcatagtgcccaccacatttcttcatgaccagggtcctgtgatacgctgcggcttcacggcccctggctgcctaaggggaatggcccacaattccttttcttttcttgtcacattgcctgtattctgtacttccatttctcctgtgcaagaaaagcattgaacgatacattgatttttgtttttaattcatattatgggcaaaccactctggggcttcagggagcttgcagtcatatatgccctttaaacctaacactcaaaactagggagtaataggagaaattgctcgcttgtgctggaaaggtggtatacttactcaaggtgtctggaaatgggatcatagtgaaagcagctctttttacattaaatgcttagtaaaacgggttttagaaggataatatattttacctaaaatgcagctctgttcaatacacacatttggatgccaagaagattttgtaaaccaaacttccttggtattgatttctaactccaggaagtaacggccctcacagtctgttatgatgtagttctcgcagtctgagaacagaggtcaatttgatagaagcaggagtagggaggggccagggctactgtgatttgccttcacctagcgaggggcatccccgcctctgcatggagggagaccctggcggcccagcctgcctct

SEQ ID NO: 74428 - DNA, 1087 bp, Homo sapiens
gttgtggctcttcctgtcgttctcctcctcaccccctgcctgtcgcgcctgtccctccgcccgcccgtcttagcatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacac

SEQ ID NO: 74429 - DNA, 1012 bp, Homo sapiens
ctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcccgtggcttttaatatttgttacatgggggaggggaatagcatagtttgcagtgtaatataatttggctcttctacctgaacggaacatcttccaaaggcaggcaggtgatagatagaacccttctgtctgccctgatagaaaagcttgcactctcttagattagccgtgttctggacaagacgaagtcactccttgtacatttcttatttcatctctttcccgtttcttaagaagctttcagtcactggcgggtttgtcttcagaaagaagcattattttttgtgtgtgcgcataaatgggaaaaagcacaactttaaaatgtttttatttagactaaggccag

SEQ ID NO: 74430 - DNA, 1042 bp, Homo sapiens
ttattaaatgttgctgtagagtaaaatgtttttattgccagatctttgatgtataaacactcactgtatatgttctgattggtctcatatgtctttgctgaaactcttggaataatggctcaaaatgggatgaatatccagagcagtacagtcacaacctttaacttcctccctgttgaaaatgctggggtttcaacaatccgtaattccgatttgaaaagggctacagtttccttccctctctggctttggtcatgaggaggcctgggctcggtagacagaggtgaagagaactggtaaaagatgccctcctctagcttgcctggatgaacgtttttaaatgcataattgctagaacttaatatttaagtgacatggtatagtcaagttgtttttcttcattctgccatggtattcgcctgaggtttatttattattttttcatgatcctaggttcacgcaaagaatctgctccacaagttttgcttccagaagaagagaaaattatagtggaagaaactaaaagtaatggtcagacagtgatagaagaaaagtaagatgtcttccggtattctaaagcagatgtttgacctctgcggtggggtagtagagtccagacaactccctgagggcgggggtatggcttcagaagcttcactttttttttttttgagacggagtgtcactcttgtcacccaggctggagtgcaatggtgcgatctcagctcactgcaacctccaccttccgggttcaagcggttctcctgcctcagcctcccgagtagctgggattacaggcctgtgccaccacgcctggctaatttttgtatttttagtagaaacgagttttcaccctgttggccaggctggtctcaaactcctgacctcaggtgatctgcccgcctcggcctcccaaaatgctgggattacaggtgtgagccactgtgcctggccagagcttcacttttaaaatgtcttcataggctgaagttgcccttgactaggcttgaacctgccatgcacagaggttggcagtttttag

SEQ ID NO: 74431 - DNA, 1082 bp, Homo sapiens
ctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccgg

SEQ ID NO: 74432 - DNA, 1065 bp, Homo sapiens
gcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcacagaatgtgtcgcttcgtcttctttgatgtgttttctgtgtgcttgttagctttacagtttctttgggctgttttagatttgaaaattctgtctgtctttgatactgaagataacatgtttcctttaaagtctagagtttgagaaaatttgaagatttttttttaaaagacaaggaaagaacactggaagtcttaggaaca

SEQ ID NO: 74433 - DNA, 1122 bp, Homo sapiens
tcacatcccaatgaagcagagatccaaccgtgtaaagtggtgtaaatgcatcactccaggaagatcacagcgaggaagggaactcacgtccaagctgctactgccgctgcttttgccacctctcccatcccctgagcacctttttatctgtaccgtgcaggtgctggcctgtttgtaagtgttggcatgtatgtcgaacatggcttaagttagaacaatcgccgcatgcctgtcatccattttaaaagtgagccttaatccctatagcagcttcatgactggtgttataaggaacccagaagagaacacaagctctcaagaaagtttttgacttggagagggctcactgttttgcaagggggtatatcatttttgcatggaagcaaccattaagttctttccatcattctaactttaacagctgggttgtgtgactgtgcttttcttgactcctggtttctttcgggcctgtaggaagagcctgggcagtgggccctgccttggggctctcactgtgccctcacattacttttcatttctttgacatctttctcattcaaaacgacgaatgaacctttgtgctgtgcaagttgtagtattcagtgacagggtattatgagctctttgtgcacataattccatgttatgaaaacctttcaccaacttcttaaattggctggtttgaagtgcacattgtgttatggcataatctgtattattaagaatatgaattgggaattagcattagatctttcagaaagaattgggaattcaaagagaaagacttgccttcattcttcagtcttgatttagggtatgttatttaacatgtcatttcttccaagtatctgacttcagtttcttcatgggacttgctgagatgatttcaaaacttttgtttaactatattttgggaacatttaccaagacgtttcttaaagaaaataatcctttcttcaattgctgctgttctgaaagataaaccagactttgtggtttatgataagccaaagatatggtctgtaataaatagtgttgctagacagacactgtacggagcgcatcattgaggttgagtctccatctttaggagcttggcatcaacgacaaagaacgtgagca

SEQ ID NO: 74434 - DNA, 1050 bp, Homo sapiens
aggagattagactcagagcggccttttcgtggctgggtcccaccttgggatgattctaaaaggaggcggctctgaggacggccacttaggtcttggaggccctgccactcagggagcctgcaagcttctcgggctgcagaggggctggcgtgttttccagcccccggatccccgctgggtctgccaagccccaatcaaggggctgtcgccgaggctgccccttcaagagattgctggaggtgggtggggaggggatggaccatctcgggacccctaatgggctcagtagcctggggctttcaccacaaaccccaggcacggggagcatggcaggcgacccctgagtgtgctgtggcctccgtcacaggcaggttgggaggttgtcaccaacagtgccagccacagcagcccagccctgtgacggctcagacatgtggccaccagtcggatcagggaacctgcagaaggcaagaggcgtgtctcggttccacttacagtcctctgagaactctcagagagaaatcacagattctgaatttgaatatgaagaataataaatgagaaatgaaatcacaactcatatatcgaatgcaccactgcgcagcagacaggactttaaatagattcacgtagacacatttcaaaacgggcaatttggatattaaaactcaaatggcatcagtgactttagggagcatgtgccagtgacacgcacacagctgagacacacagtgacacgcacacagctgggacacagtgacacatgcacggctgggacacacagtgacacacacacagctgggacacacagcaacacacacatggctgggacacacagtgacatacacatggctgggacacagtgacacacgcatggctgggacacacagtgacacacacatgcctgggacacacagtgacacatgcatggctggaacacatagcaacacatgcatggctgggacacacagcaacacacacatggctgggacacacagtgacacatgcgtggctgggacatgcagtgacatgcacacgtctgagacacac

SEQ ID NO: 74435 - DNA, 1082 bp, Homo sapiens
tgggtgtgtgtgtgtgcgcttgccgtgggggggtgtgtgtgtgcttgccgtgggggggtgtgtgtgtgcttgccgtggggggggtgtgtgtgtgcttgccgtgggggtgtgtgtgtgtgcttgccggggggtgtgtgtgcttgccgtgggggtgtgtgtgtgcgcttgctgtgggggggtgtgtgtgcttgccgtgggggtgtgtgcgcgtgtgtgtgcttgctgtgcgcgtgtgtgtgcttgctgtgcgtgtgtgtgcgcgcgtgtgcatgcgtgtgtgcgtgtgtgtgtgcacgtgtgtgtgtgtgtatgtgtgtgcttgccgtgcgtgtgtgtggtgtgtgggtgttggggtggggtggggcaggaaggactccatccccatcttcttaaggaatgtgaatgtgaccattgcctgaagtagaaaacgtttgcaagtggttccaaggaattttagacccaggagcactccgagccggatgtgggagctgaaggacttcacattttgttctctaagtgccatcgagcggcctctcagcggcgggatggacacggcagtgccggtggggggagcctgacactgttctatttctagttcttccattaccttgatgtgtgaccttgtaaaatcttcccttaaaaaaagtatctctgtggctgatttcttcttcatcttgaaagtacaggtggtagtcatgaatatttgtttcctgcaggttggttttgtaaacctcttctcgaaggaaaagtacacacagctgtggagtattgttcttattaataacttcatcttggcatgcactcgccggcttctaagtctttatattaatattctactgcagaaaatatgccacaatagcaacctgtctgatttctctgtcttctgttttagaagctgacctatacactaaatagttgtcctaaacagaacacattttttttctctttccacgtcaatgtctaaccatggcatctggtggatccttgcagtccagctgtctgttgccagttgtgttggtcatcttggggctgccatgacaaaggaccatagactgtgtgggtcaacccacaggaactgattt

SEQ ID NO: 74436 - DNA, 1048 bp, Homo sapiens
acaaagctgatttccaaatggctttaatgacagacaatctgcataccaatcgactcgtctgcgcacatgcaggctcagaacaatgcgggaaaatatgcaaaaaggtctgagatgtgatggcaattgcttcccagtatgctgaccttcggtaaacgaaacaaacaaagtacagttctctttggatgagacattaatgatcattaagaatgggtacagctgcatcgtgcaagtgctttgttaaaaatattcttttcattttgtgtctgtcccgtaattataatggaagtattgtgcaagtcagccagtaagcatgtggagtaaaatatttgggttttataacatccgtgcggtttttaaagtgcattgtcaagtggagtggctttgccatatccttcatgtgtcacctctgacttcagcctcacggttttaaggtgccgcacgccatgtaattgtaagaatccactgctctttctcgatatttacatcgtgcacacgctggcctccgtgaaagggttccctgtggagttctgagacttcattctggttaatttggggaaaacagcactgcacccttctcaatcactaggaccacgttaactgctctcctctctccctaaaggtccaacatctcaagaaagccacaaaacatggtcaactcaatttctgaggcaaatgcctgaagtgcccactgagtcattaaggaccaaggagagtaaggaaacccaatgttcctcgtgagaaagtgatttagaaatgatcccttaattggtcttcaagctggggaagaccttggtcacctgtttcaactgtttggatgaggaaatcagatcttgggaggtaaggactaaactctgaccttttttctctcttacccattccttacacaactgtgacctgaatgctttcctaaggagtaagaagaagccagctctggaaaacaagaaacgaaagacctattcctttgtctccttgagccaatcatccaagtctgtgaccagactctcctcccttttgtggtttaaacagtgcagcacccccagcattcctt

SEQ ID NO: 74437 - DNA, 1016 bp, Homo sapiens
ctttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgacgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcagatgcattcgttatttcttgagtagtttatgaagggacagtttacttgctggatttgggggttgagggttggtagaatttgatttaatatagtacagcatatgaattatttaatcagtgaaaccaggaaagtagactttgtgtgacttttggtatagaagcaaaggcaatgtcaccgctcaggtctcaggagcggtgctttagttatctgaatccacctctgactcctttaggtgtggattacctttaaaactaaaggggctgtcaggaatcctggccatgcagaaatgaattcatggcaaaggccagaaattcaatgtaattttagttttgaagttcataaaatcagaaa

SEQ ID NO: 74438 - DNA, 1073 bp, Homo sapiens
aatctcaccgaaaccataacacggctgaacatcacttaaaacaacactttattatgcccctttacattgaaaaggaattgtagtttgaggggttttgagtattatttgatttgaaatcttagaccgtatttatagttttagtagggaaaagtacactcataattctaggatttcagatgaacctcaaagctgaacccattcttcggatgcacattgaccatatctgtgtgttgtagattcctaatggcaagaaagatacttggggtatgtggagtgcacgctgtgctacaggagccccatgagacagatgctcggcagatgtcacaggtctgagggcagctgggtctcttctgagggtcttagagctgagagtgcatctcatgactgtggacgctatagttcactgtgtttaactgtctgcggagccatgtaaggagcgctgaggattctttgcagagttgtaaactttgtaagtaaatcttagatatgcctctgatacatcagtcatagccattggcaggggaggcgcttgagcccttgagtgggtgtgctcccttgcgagtcgctgggcggtgcatggatgtggacgagggccctttggagctctggttggttaggttgccacctcctgcctgtttattgcctgagggacagtgtgtcatccctctctttaacaaatgaattttctccatctgaaaggtgcattgtctaagtctgccatcaatgatccctaactaaaaattcttctgcctccttgaaagcaagttctttttttgtcttttgaaatttatttttttaaacatcgtttgttactggctgccatatatttcatttaggtgagtgctggtatataatgtatatcactgtctgctttacaactctctggctctccctcacctgagcctctgtgttcgagaattctagccccttcccgagacccaggcaccgggcaggtgagggtgtccttctctgtagtacgtcctcctcctttcccaagtgcacggcgcgtccctggagaccgggtgccagggtcggatggcgatgctgcctgttagtggaatctgtgccttcag

SEQ ID NO: 74439 - DNA, 1007 bp, Homo sapiens
tttaatttatttttgacacagagtctcactctgtcaccaaggctgggagtgcagtggtacaatcttgggtcactgcaaccttcacctctgagattcaagcgattctcctgcctcaccctcccaagtagctaggattacaggcacaagccaccatgtctggctaatttttgtatttttagtagagatggggtttcaccatattggccaggctggtctcaaactcctgacctcaggtgatccacctgcctccctcccaaagtgctgggattataggcatgagccaccgtgcccggccttaacaaattatttaaattagcaactttcatatctcctgccttgttaatttgcatacattacgtattattttcatagcataaaagataccatagtacagataattgcatcgattatttcacagagtctgagtgccttgacaaataggtaaactgaacattgcctagataagagataattaattatttcgtagtattacagatctcattaagagtgtcaaagttgtcatgccatgtacataaacaattgctaatgcaataatgttgaatgtttaggtctgtaaagctctactttagtagaaggactcgaggaaaaaagtttatatcatagatttatttaaaaaaggcaaatctatcactcgaggccaggagttcgagaccagcctggctaacatggcaaaaacacacctctcctaaaaaatataaaaattagctgggcatggtggcacacacctgtaattatggctactcaggaggctgaggcatgagaatcccttcagcccaggaggcggaggttgcagtgagctgagttctcaccactacactccagcctgggtgacggagtgagactcttatctcaaaacaaacaaacaaacaaaaaaacaaaataaaagtaaatgggtgaaaataacctgaaggattcttttcagacgggagattcttctaggcctaccttccatgagattcaccacccttaggagctactgttacaga

SEQ ID NO: 74440 - DNA, 1054 bp, Homo sapiens
gaacggttggttttcttaaaatattgcaagagtcatcttggaataaaaagatttggaacatatttagaggcagtgggttttcgtcgtaagcaaatggtgatgaattttaaacgcatagtcacaatattcattcagaaatacaccatgcattgccagatgtttgcagagcacctactgtgtgctcattattgcctaattggtgaggttgtagaagttaacaagaagatgcactcagaactgttgagcagtttttaacaattgggcattattttactgctttttctttgcgttaacaagttcttcagcaagaagcttaaggtcttgcaattatgtgtttgtttctgttgttaggtctctccaggtgacactggatgggatgtcttcagcctcgattatcatgttgacggaccaattgcaactgtaagattatcctgcatcattttatagtatttacaactattaagattgttaaacattttgtttgaaattggctttcttctctggggacttctaattcaagtgatcactcgacatctaagatctactcattgaatgaatacttaagccaaaattgtgtgtgtgttttaaatgattattaatgagtactgaaatgctctattattttaaaaattcttaaaaatatcatttgttctatcataggtttcagcaactccttaataaatggactgttcattttcttccattattcttatactgtggcaactagttaaggataatgtgaaaggaactataaagtgtattttaggggaatcatatttttactacttagataaaatttggtatttagtattcatttaaaccgatgaggaagcagctgtactttgttcatagtgcttttacctacataacagttaccacattataaaaggctgaccaggaaagctgtctttttacatgtctgcaattaaaatgcctctttttagtgcgcatttttaaagtattcagacttgaataaatttccttgaccaagataccctctaaacttacttcagtcatttttatatctgaaatactgaagaaggacattgcattt

SEQ ID NO: 74441 - DNA, 2843 bp, Homo sapiens
tgctttcttccgctatgttactgcttagagtcaggcgtctttattggtgacaatctggttttgtcccctagacatctccaccaatctccgtagagttcactctatggtgcatgatactactactcaacttttgcgagttgtacaattcacaaagcttatttgcatgtgctgttttggtcttaagactaatttatggaaacatcttatgggtatggacgggtgactcagcactgacttgccctattaccagtgtgttttggtgagatttacggttagttacagtgtattaagggatttggaaatcatgaagacacacatgtaggtgtctgctgtgaacccagctggcagaattgttttcatgtgtgtggtcttagggctctggtctcctttgtggaatgtccagctgtctgtgcctgcggtcagtctgttactgatgccacaggcagtggttggccctgagtctggatgtatgtgccttcatttctcctctgtggaaatacaaattacatatgcatgtgtgctcttccctgttgttctttacagctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaagtaaggcactattttgatttctataaataagtaatatatttgacatgataaggaatcttgtatttaaaagaataaattatattaaaagaaaatgagttgaattcttcgagcatactttttaaaataaaatctgaaaagaatgtaaaattttcaaaaggtaaagccccttcatttttctctggttatcagcagagcatcattgtcatgttctgtgctttattcataagagaaactggcatttctttccaaaactgtggggcttacagtcttcatgtatgaggagttggtcaaatcacacttaactttagcttgagtttgaaataaagctgaaaaataaaatatatattttaaagttgaattttacttttatatttgtagttaatgttcacctaaaaatgaaactatgaccttttcattttgctccctgacatttctcatggcatcttcccttccagagttaaatgtatgtccttctccacaagttctggaccagagcctgctgtgcttctaggtctagagacagtgcagaccccggcccaggcagcgtgagcctgggcatgagcatcccaggggtccacagcctgggcctggagattttcacccaagtgtttagaagaatgaaacttcttttctggtgttccttttaggacacttaaagtaagataaatgttccctttaagacacaaaatagtaacttacctttaaaccctgccagtgctccccaagcaattgttttaggcctcaggtcctcaagtttcagtgtatcacagactagaaagcttgctgcagtagcttgtgggcccacttcagagaatgagattctcaggtgtggggtagaggatttgcatttccagccagttccagctgctggtgatgctgcgtttgtggggactacacattgagaagcactgtttgagacatgcaggctcttacatcctaccttctagccagaagccagtctcccgtgtgaaaactcatgtggctttttgaggcgtacacagccatagctggcttgtgacatgctcatgccttagtcatagctgatgcctgctaacacatttgtaagaaaagaaagttcactagtacagtaaatgctggttgtgatgaggtcaacacctgtttgaagtatgagtggtgatgagcttttaaaggggaaatgttctctaatgccatgggggcatggggtgtgtatgtgggtcagttggtgcagatggagatgaggagccaaagtgaggtttggaggacactgatggtgtcataggtcacatcatagagccggctgaacgcattcgccttgtgcccaatcttaatgttgaaagtatcacatgcgtgctataaaatgaaaaattcatttctcctcaatgtcgtattttaagttcctagtttttaggtttatttgacgttgtgtgtctttttcaccttgtctctgccctgtgttttgtagagcttacacgtctacctgagttgattagtggtgttcctaacttggtcacccccgattagagacgtgttagcttcatatttataaaagcagatatcagtaaccctcaagaaatgcttgctgaaagtgtagtgtttcttggccctttagaatcatgacatccatgtacctaattgctttgatttgatggaggcctctcctcttcccattgggtctaaaaggaaattatatcagctcatgctactcataggccagtctgaagtttgaaaactttgttaacatgtatagcacatttaagtactttcaatttaagctgaatcaaaatcagttctttttttttcttttttttgagatggagtctcgctctgtctgtcacccaggcagtgtagtggcacgatcttggctcactgcaacctctgcttcctgggttcaagcgattctcctgcctcagcctccaaagtagctgggattacaggtgcccgccaccatgctgggctaatttttgtatttttagtagagataggatttcactatgttggccaggctggtctcaaactcctgacctcaggtgatcctcccaccttggcctcccaaagtgctgggattacaagcttgagcaaatgttcctggccaaaatcagtatttttcagattttaaagaaatgtaact

SEQ ID NO: 74442 - DNA, 1030 bp, Homo sapiens
agaaatactgaaagaacatgatggacaatattttcataatctaggaatgggaagatcttaggaagacaggaaactcagaaaccataaaggaagactgacatttatctacatataacaaaaaaatagatcagaactaaaatatggaccatactataaacaatggcaaatgattaacttggaaaaattaaatctctaatatttaatgattcacaaatggtcactattcctaatgtacaaagaatttttgtatattgatgagagaacaaaatgaatagcaagatgggtcaagggcatgaaaagaccattcacaggagaagaaaagcaaatggcaattagaactatgaaaatatgctcggcttcatttttggttaatgacagcaatataggataaccatgattccacctgactggcaaaatctaaaatgagccaggatgcaaaaacaggacatcttgcccgtgggagcgtcagtctacacagctgtgtggaaaggaaacctggcattgtctataaaaactaaaagctactttaattcagcagttgtgcttttataaaacaagtttatagaaataaaagtgcaattctattagggtgtatgattgaaaaatgagaatggctgcattgttgtagtggcaaataaactggaagcaacagcaattgaattttctccttactgctcagtttcctttctaacggcagtgatgtaggtgcccgtcagggtcagggcaggggagctgcatgccagtgaggaagaaagctcctgagcacagatggttcctgggggagccacacaggggtcacttctacagtgccacctggctggtgctggccccttgtacacatgggtacatgtacagcaaggtctgcccatagagcttgggacttgtctgtgaacagaggacgccggcctgggcacctctgtgttccaggctttggggctttgcaaaagagagactgcaagggcaggcagactgatgggaggagacacacagctgctgcctgtgagggaggggaaccccaaaagcctgcacc

SEQ ID NO: 74443 - DNA, 1841 bp, Homo sapiens
taccctgtaaattatcctttgttgtacagagaatctgaccaatttacccattcccctggtccggttgccattttattgtatctaagtgtggccttaggagaaatctcttggtagctgcctgcgtgattggcaagttgaagttggaattttttatggtctgtattaatggatctgattctcagaagttgcttgctaagaaaattaccctcttcatttctgtttttagtagggaggccttggcatttgtccagcaattaatgagaaatcatggtacaattatgttttattttttttcttaattctttctgcgtttgacataatggtgaaaattaaagaaccttgagtggaaaatgccttagtaaaataaaagcgtatcgcaattatattctgaccttggtttttttccctctataactctatatttttcacagaattaattatattctaaagcgtacccaagctgtgtgcttgctacgagatgtttgctgctggagtgattgcatgctcctttgcccttagatgaagcagtgctttcataacttctaaacatgcctgaattgcctgaggttttttatggcttacattttctttattgttcatactgataaaaatccggctgtactccaactattaggataaattagtgtgttgtctgtagaaacgagctcttctgtctaactgaataacagacatacaatttatatgcagttaatctaatctgtagcatggcaagctacagagcagtcccagcatgagcgcggtgacttcgtcactgccgagattactcaacgggggcttatttctgtcatggacaattgaagtctaggttaagtcgatgacgcctccgtgatagtactgctgtttacccctgaagggcaatatagatctcaaaaggctaaaatagatcagtgaatgcttcagtcatttacattgatacttaaagataagacattttagttgaaaataaacgtagcagcctcttccctatggtcataaaaatgttggcacttattcatgtgcctacttaccaggagattggctgtacataattgatagtgtctggcccttaaaaggatcaaatagaagattttgacatcattaaaattttgtttcctgaaatacttactcttggaagtagatttctgtgaaagaaaaaaattcatttttggttggttgccctgggaaaatgacgttatttaaaaaacaacaatttactggtagcatgtgttcagtatttggctagaattacttgattcttttattaaacagtgttttttttctaatagaaaaatatttgcagtttaaacaatgttgatcacataagcacatacagaggataaagttaaaattctccagtaaccctgtcaggaccagacacattctgttaatatttgtatatactgattttttctgtgtatttgtgtgtatcgtatgcgtagtatattgtcaacttgttcaagtaaataatgaacattattttatgccattaaatttttttttgacaccaaggcttattaaaatgatctctgaaactctattttgtgaatataatcgtcccatggattacgaggggaattggttctaggacccctgtggatcccaaaatccacacatactcatgtcctgcagtcggccggtggaagctgtgggttgagaaagcgggcctcccgcacaagtgcgtttcacaccccgaggatgctaagtttctgtgtgcgccgttggttggaaaacatccacctataagtggacctgcacagttcaaattggtgtgattcaagggtcagttgtatatgcgattttttcctgggaagaactatacttttcatcagattgttggaaag

SEQ ID NO: 74444 - DNA, 1109 bp, Homo sapiens
tcacaaagaaatagaaaacctgaatagacctgtaacaggtaaagagattgaatcattaatcaggaaactttagcaaagaaaagtgcaggagccgatggcttctctggtgagtgctaccaaatatttaaagaattaacagcaatcctatttaaagaattaacagcaacccttctcagattccttaaaaaaatagaataggatggaatactacttaactcattttatgaagtcaacatgatacaacacacaaaaactacataccagtagttcttaggaatatagatgcaaaaatcctcagtaaaatactggaaaacagaattcatcagcatagtagaaggattgtacacaatggccaagtggaattaatcccaagaatgcaagggtagttcaatataatcaaagtcaatcaatgtaagacatcttactaaggcagtgaaagaaaaaatgatcaactcaactggtgctgaaaaagcatttgatgagattcagtacccttttatgataaaacagtcaaacttggaatagaaaggaacataactaataaagggcatctgtgaaacaccaacagctaacatcatacttaaagattccatgctttcttcataaggtcaggaacaagacaagggtgttcactcttaccacttccttttagcattgttgagaaagttatggccaggataattagtcaaggttttttttttttttaaaaaaaaaaaaaaaaaaaaaggaaaaaggtaaaagcatccagatagccagattggaaaagaaaaagtaaaaccagctgggtgcagtggctcacagctgtaatcccagcattttgggaggccaaggcaggagcacggcttgcggtcagagtttgagaccagtctgggcaacatagcaagaccttcctctctacaaaagattaagaaaaaatgagccaggtgtagtggtgcacacctgtagtcctagcttcttgggaggctgaggtcagaggatcacttgagcccaagaggttgaggctgcagtgaactatgattgtaccactgcactctgggtgacagagtgagaccatgtctccaaaaaaaagtaaagccatttctgttcacagatacttgatctgatttata

SEQ ID NO: 74445 - DNA, 1012 bp, Homo sapiens
cactgtaacttctgcctcctgggttcaagcaattctccttcctcagcctgctgagtagctgggattacaggcacgtgccacctcgcccagctaattttcatatttttagtagaggcgggatttcaccatgttggccaggctggtcttgaactcctgacctcaggtgatccacccgcctcggcctcccaaagtgttgggattacaggcgagagccaccacgcctggccatttgtctgtgtttttaaaggagtccttaaaggtaccgcgagttctttattgattctctgccttatgtgttattcaggcttgtgtattcatttcctttcgtgatagtaatgatgggactggagagttgatagggaatgcagagggaattgggcaaaaactgataaatcgattttcttctgtacttttttctttaatatgtttaaactttgattcattgaggtgagacaaaagcagacccttaggactagtgtggtttaaatttgggaaacttttttgaagcactcttgttgcttagaatatgtataaggctaatgttcatgttttatttatttaaaaataaaataatgcatgtctattgagtataatattcaaatcagcatctcaaattattaatgaacttacctcaggtcttgcctcattggcaaagattttcacttttaaatgttttccttttgatttaattttagacttagaaaagttgcaagaattaatgcaaaacattcccaggtgtcctttcccaagaccacctgaatgctcacaggctactacattgatgtcatcattcccaggtgtcctttcccaagaccatctgaatgctcatagggctactacattgacgtcctcattcccaggtgtcctttcccaagaccacctgaatgctcataggctactacattgacgtcctcattcccaggtgtcctttcccaagaccacctgaatgctcataggctactacattgatgtcatcattcccaggtgtcctttcccaagatcacctgaatgc

SEQ ID NO: 74446 - DNA, 1051 bp, Homo sapiens
ttgctactttttgtttctgaaaaattcctcagcagtcctaaagagaagagtgactcacacacttgtgtaaagccagggttggagtctggacctcctggtttctgaatcatgacatgttactgctgcttctaggtccaaagtggtattaactgtaagaaaacaaatgctctttatctcaattacttgggcgtctttggttggtgagaagtgactggtgtgtactatgagtgtaaatgtggatgtttttgtgtattttcctccatttctcccaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaagtaaggatcggtgttcggttctgagacttggatttaaaaagcatgggcacgcagttatgctgtttcatttttcccctcatgattaccatgttctcctaacaggaatgcaactgcacttccattgaataccatatacattttacacagtgcctcgacagctggttatctcactgaacagcagataagttcacgagttctttggttagtggagaattgtcccagtttattcctcagcaaggtggaatcactcgtccgagtttactagcacgtggatggcaaaacaggacgaggcctcctgagtcttggggcagtcatcatcgcagattctgctgctttgccatgattactttgcaaactcactttggtgctaacagcttaatgaaacaagttagttgtgtatgtagctattgaaatagggtcagttctgtaacgcagcatgtgctgcttaaaaatcactgttgtgtaaatcacatgatagaaatgatagggcttttggtggaaggtagggtgaggggcaccacactcaaaacctttgtcagtaagacaggaatctaacaaaagttgtagtgcagtttaacacgttaaagtttaagaaatacataagcactgcca

SEQ ID NO: 74447 - DNA, 2032 bp, Homo sapiens
cctaattttcacataaactctttgatcccagcctaatattttccgtactttacaaatgtcagggaggttagatgaattgatcagattcatagagcttaaaagttgctcatcatctaatttgacagtgacttttgactctgaattcatcacttgcgagttatggtgttgtaggtgaaatagtatcataagaatgaattttggtgtttgtagttaccacacttattttttttctgtcttttcagttattcgacaacgaagagaagcagatgctgcattattttcagaactccacagaaaacttcattcacaggtacagtgcagaattctggaggtcattgcactcattgttgaggatatgatgagtggtataggaacctttgaatgttttttgtggtatcatattaaacttttctataattggtaattgcttttaattatagatagcatttgctttttttgtgtgagcttcagtattagaagttttagctggatttaatgctaaattgcttataaagatgaatgaagctgcacagggaaagtcaacagaatttgtgagtttttattgtagtcgcttaattacactgctgggaggaagcacattggtagaagtcttatcttcatataatagctaaactttatctgactgataaactttattcattgggtcataatttgtactgccatagtgaataacgaaaaaattgattttgaacgtggttggatattgatacttgaaaatgaatgatttttctaaccttttttttttcttttgagacgcagcttcgctgtgttccccaggctggtctcaaactcctgggctcaagcaatcctcctgcctgggcctcccaagtagctgggactacaggtgcatgccaccaagcccagccttgtattttgataaaagattttggcagcctgtataccaatacattaattgaatcatagggtgagatttttctgatttctgactataaaggaacttagttcatcccgctttctttccttttatggagaagaaagtgaatctagagaggtttagtgctttgcgcaacaaatactgttagtgttacacagtgaaaatgattgagtcaggcctaatgctgctagtaattaaactcttttattttgagtcttcctctgttgttatattgtgctctggaaacaagcttagttcatttgctgcccattttgattccttaattgtttgacttggattcactgttttaagcatgcttttttccataatatttgcgatattatctttgtaatgtttacagagtaagaaataggaaccttttttgtccattcatttccaggcaaattatttcaaactgctgtatcatttgctttcttaaatctttctccatttttaaaaccattttctacacactgtatgttaaaaagatttgcttattggataccatatttctccagattcttagccttaccaagatgcccaaagggagatttcatctagtaaaagctgttgtatttgttaatattagccattggatgaaaacatatttagacacttttttttttttttgaggcgaagtcttgctctgtgccccaggctggagtgcagtggcgcaatctgggctcactgcaagctctgccttctgggttcacgccattctcctgcctcagcctcccaggtagctgggactacaggcgcccgccaacacgcccggctaatttttttttttttttttggtatttttagtagagatggggtttcacggtgttagccaggatggtctcgatctcctgacttcgtgatctgtccgtctcggcctcccaaagtggtgggattacaggcgtgagccaccgcgcctggccctatttagacactttgtgacttaaaatggttgttttccaaaattttgtttggagctctgaatgtttattcctaaatatcaatgtcttaaatagtggcccgctccctagggctcgtccccaaaactgacttgcttggctttttcattgcatgactgaaacatgatgaaaaatactaggaaataatagtataaga

SEQ ID NO: 74448 - DNA, 1300 bp, Homo sapiens
aatggtacaggatgccatttcttgctccttgttttggccaggttggtggggcagagagtgaggatgcaccatgagggaattttctgagtaatggaagcaactgagttacatcttaagcaccaaaatgtggaaaagaagttactcaatttttgaaggaagacttcaaagttacatttaaagtactgagaatgcattttgacctttcatgcttcatgacaattactgtacataattcattggatgttctatgataatcttggggcaatcatgaataattttgtgtcgctattaaatgagtgacttcacacagttcttgctgcatcttgtaaagtttgattctatcactttatttatctaagaaatctttgaggacaaccccgtcctcaaagttccccccgggaactgtgctaagtgctggtgatgcagatgcacaagtcattcctcccacagatctgacagacactctactggaagagacagatgataaaccagccatgttaattagcaataagtactgtggcgaaaaagtagggtaaaggaatagagagggaagaggcaggtgagggaaagcctctgagatatttaaagagacctgaatggagtaagggagggccatttgaacatctggggaaggttctgagtagagagaaccagtggaaaggtcttgaggtatgagcatggcctgccatcgtttgtttttgtcattagcagactgagtttcctttcacatgtttcatgttcctcgtcatagggggaatcagataaaactaagattgttaggacttacccaccttaatgtcagtgttttccttataccagtggttccagagtttttttttctagggataaaccacacattcatacattcccattgttataattggattttgaaattcattcatcatgagctagaatgatatttctcaacctaagaacttttttttttttttgagacagagtctcactctggtcgcccaggctggagtgcagtggtgtgatctcggctcactgccaagctctaccttccgggttcatgccattctcctgcctcagcctcccgagtagctgggactacaggcgcccgccaccacgcctggctcattttttgtatttttagtagagacggggtttcactgtgttagccaggatggtttcgatctcctgacctcgtgatgcacccgcctcggcctcccgaagtgctgggattagaggtgtgagccaccgcgcccagccaaaaacttttttttttttacattgaagattctttgatataaaagttttgtcccttctaagagactga

SEQ ID NO: 74449 - DNA, 1020 bp, Homo sapiens
tgtgggcgcggggccggcgggggctgcggccgcggggcgcatgctcacttgcgccggtgacgtgcgcgcccggagcaggggcaggagccagcggggcccggaggctccagagggcggcgggcaggggaggaggagactcgggaggagcagagcgcaggctccgccgcggccggggtgctccagccgagcccaaccgagcgggcggaccgacggggagagagaaggcgccagagcgcgcgcgcgcggccccgagcagcagccttgccgccagtggagcagctgccgacgcgcggggccgcggacccagcattcgccggccgggccgggcatgagcgcggaggggccgcggccgccccctgcaccgcccggcgcgccgaggccgtgaccggagcggggggcgcggccgcactagtaccccggagcccatgggcgcgccgagccgggcgcgggggcgctgaacggcggagcgggagcggccggaggagccatggactgcagcctcgtgcggacgctcgtgcacagatacgtgagtgctcccggcgcgggctgggggacccggggaccagacagacgcgggccggccccgcagcccggaccctgtggccggtccagccccggggtcccgggaggtctccgatgtctgggactcggaccgcccccggggacgagcgggatgctggggaggggcctcggagttgacaccctggggcttccgacggggtctaggtgggcacagcgcggggccccagccccgggcggccacctgctccctggccgcggccgcctggcgcccccttcccgcccgcagcgccctgggggtccctcggagaggctggctggggttcgagctgtcccggcggaccgggcgcccggagggagccaacttcgaccccgccggggcccgggtctggggaggaaccttcagatgcggcttccgcgcagccgtgtctgtaagattaagggattgggaggaagcgttacacttctgcagaaaaaggtagcaattgtgtttgttcttta

SEQ ID NO: 74450 - DNA, 1004 bp, Homo sapiens
ggtttggctatagtcagctaaatttctagggataagaacactgtcttcagtttacaattagttaaaactgtgttgaatccatgaataaaaatacatagttgcttaactacacatgaaatcctctatttacagatgtattaaaccctaaaacccaaaatacaaattgttctctggtgcttggagcatatgttcaatagaaacagggttaataaaagattctcaagtcccagacttatcaatgtttttttaaccaagttaaatgctggtaaaaatgctatttatttgcaataaaaatcaatagcaagcaagttttacagagtagaaattcaagaagatcagataagggatgattttctctttcacttggatattattatctgagaagaacaaaatggtacatcccagaggtgccgaggttaggcgtcggagtctgacagacccacattcaagttccgtctcggctgacggctgcgtggccttggcaagttggttgccccctgtacgcttggtgccccatctgcaaggtggggactatgatggtgcccacctggtgggtctgtgcagtgacgggacaggtcacggcgctcgtgcacgctgggtgcccagtgcacggggcgtctttgttgcgcgcatggacctgcggctgcatcaccgtccatgcttctgggcttcttaaggagaccgcctctcaccttgggctttccggaaccttctccccgcactcctcttcacgtggagagtgggtgaccttgccctgctctcccggggagagcggtggtcactggtgggaacgcccctgccacgcccagcagcctttctgcctctgcgcttgcctcctccggttggagcgagtgacccgttctgccgaagtccagtcccgtgtgtgctgcggccccgtctctctccctctctgagtgacactgtctgccctgctgcttgccgtcccgctgttggcaccgctttagaccccatatttcccagcggtcaccgtgctcatttttggc

SEQ ID NO: 74451 - DNA, 1091 bp, Homo sapiens
caatgggatacgctggtcctgctgtcccaggcgggggagtcacgggagggctcgagtgccacaccacccacacgtcagccaccatgtgggttcccaaggcaagcagtgagttcccaagccagctgtcgtccacctttctgggttagtgtctttttaaataatcaaaggtctttaccatccattaagtactggcccagttgttgtacgcacaactcagaggtgattgtaggttgtgactgctctcagtcggtagttagggtggcctctggcgattgttggaggaattatgggtactttgcgctctctttcactgaaaatgcaaggccaagtggctccagcactcagcagaaaccataactggttttgatgctcttgggagcccaaggccacagtggctgctctgcccccgcgttgtcttatctggaaaggtctgtgggaggcgaggctctgactgcggcgtgcgtctcaggtttgtatctggagcacgtgagagtatgagatgggctgggggtgtccccctccctctgtacttgctcaagtacaggagcagcttgcctgagtctgagatgggctgggggtgtcccccactctctgtacctgctcagggacaggagcagctcacccatttccttcattctttctggctttgttgctcaccattgcctgggaaggaagtggctgcctaaataattaaataatctcctgcttcagagaaaagaggatttcctccaacctattttcagcaaaggattagggacaatgaggtcctgccagtagaatgccatctagattttggtgtggttttccaaggtctcagattgcccacgaagacatggaaatggctttcagacctcagcgggacccctggtgtgggggatgggaggtttgcaggcaaatgggaccacagattctccttcactttccgataaaatgcctcacaaacgtggaataacgggcatctccttttctctctagaaagtgcagtgaggtgacgtgatttcactcagataaatggagacaaaccattaaaatattaggtaaccatcaagtatacacgtgcttttttgttttcagtaataaatgactttggt

SEQ ID NO: 74452 - DNA, 1088 bp, Homo sapiens
ctgcaagctccacctcccgggttcacgccattctcctgcctcagcctcctgagtagctgggactacaggcgcccaccaccacacccggctaattttttgtattttttagtagagacggggtttcaccgtgttagccaggatggtctccatctcctgacctcgtgatccgcccatctcggcctcccaaagtgctgggattacaggcgtgagccgccgcgcccggccgcgttctgttcttatgtacacgccctgagctgtttccactggcagtcagctttgaagttcactgtgtggctctcacaggagcgcagaccctcctggtgctcaccagaagaccttggcccatgagggctgcgtaagacagggtggctcgggcctggggtgctgggccccaggtctccctgcagccctgaacgatgctctcagcagcaggtacaggtctccgttccgacgaacgtgcctcaaggcaacactctgggcaagagcttttgatgcaggttctgaggcagctgcctaacaccgctctcctttccgcagtgtgcaggagaagagaattgggtggacagcaggaccatctacgtgggacacagggagccacctccgggcgcagaggcctacatcccacagagatacccagacaacaggatcgtctcgtccaaggtaacttggcttgggtctgagtgtccataatgtgtctaaaaagcagctgccggggggtgttagtgcttctcggtttcaaagagcggctctgctcctggccctgctgtcacagccaccagccacccccagcaagggcttcggatcaggacctcaccgagggcgctactctctccctctcggtgactgcccacaggaggctttccacctgcccagggctcacagcgcagtgtctccattctcgggtgaccgtgccacagaggcagtgcaggtctgaagtccaggatccaaaccctacccaggtcccacttctgaggcgcctggccacgtgcttgtcgtgggccaccctggccagagtctcagtgccagtaaggtagaaacgataccagccaccccggagaaagagccaacaaacgcaggctggacagcaa

SEQ ID NO: 74453 - DNA, 1079 bp, Homo sapiens
gaaatgatttctacctaaaaaaaagaaatgctagtagttaagactttttaagtgccacagaagcttgttctcagcaagtttgcttttatgaaatcaaaggatgaaagcctttgtcatggaagaagtcgtaatagaggatgaaaatgctgtcgggttatttttaacttctcatctgtttgacggaagtgcagttactggtgataggtgatgatagagtttgtttccttcttgggggagagactttgggcagtgtcaaaacctgaaatgacagcccagcacgccccgttccctgcttcctgtgctgtgcagagctcccccaggcctgcttgcaccccccacgtggggaatcctgaactccacaaagggatggatcactgcatgcctccttttccagatttgtactttggggcacagaattcacatggttcccagctttgcccacaggaggctacagaattaaatgttggcttagactatactgtccctccatgccttcaagaaagttgaatccttctggtaattggggagaaaaaattccctctgcaattcgtaggtatagccagtgttttcatgacttctatttgtataaatgatttccatgtttattatatcatgtaatctctaaaacaaccctgtgagcccaccaatactgattattaccaatgtatccatgaggaagctgaggcttagagctcagtcatgtgcctgaggccacagaagaggatagagcccctgtagtctggcactgggcttggacttccttccgcagagccaggggccctttcttttcatttttgagacagagtctctctctgtgcccaggctggagtgcaatggtgcgatcctggctcactgcaacctccaccgcccgggtttaagtgattctcctgcctcagcctcccaagtagctggaactacaggtgcccaccaccacacctagttaatttttatgtttttagcaaagatggggttttgccattgttggccaggctggtcttgtactcctgacctcaggtgattcacccgcctcggcctcccaaagtgctgggtttacagacgtgagtcgccgcgcccatcca

SEQ ID NO: 74454 - DNA, 1100 bp, Homo sapiens
acaaaactaacatggccccacagatcaggataaaagtatactgaaaagtcatttcaccaggcttagtttttacatctgtaggttgttaccaagtatgttttgttataagagacacaaagagatcccatgaatatgcagaagtaaaattgccgctggtgtctggttggcgtgtctcctgtcatcggcacatgcttgtcttaactcgtgatttaatctccacttgctggcaggacagccccacagctcagcccctggacccggcaggtcctggctcagagaccaggtgacccagtggctgccttccgcccatagtccttgtctttggactctgaaatcttgtatttagtagtagcgctcgtataacttatgcctaagcctgaggtgttagagcagcatgttggaggcctgctgtccctcctggtggaggtgctgacccgcaccttctgctcttgcagttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggttggtgtctcctgagtcatctgctgtgatttattaacatctgggtgagtctgcttcacgttcctcaggtcctgtgcctgtcatccgagcgtggctgtacctgtagctggcgtaagacagcagcagggttgttttgaaccctatttatgaaacagtcagccgtgctgttacatttacaacagatgcagaattacctgcacttgctgactcctggaaactcattggagcttcctgggcagaactctttctgtgtgcaggtgtgaatcaaggctggtgggtaaaagtggctttgccagccttgcactctgcttctgcacctgatattcaagtctcatggcgagctgggtattttcactttaaagatgaacaaaccagattttcagtgacttggtggattgcaaagagttcagacgcctccattcagatcctgctgctgcatgatggctg

SEQ ID NO: 74455 - DNA, 1050 bp, Homo sapiens
ccagacgccacacaggttttctgagtcttccggtaacaggacagcaccagccaaaacgctttttcctttggttttgatctcttagggtaacgccagttcattgacaaggatccaatctctgacacaactttgagtctctgttcagcggtgtttagggagggagtcggtgcgtagggaacgcagcctgcttggcagaatctgagcctatgccctgggtaggatggggacgtagtgaggagccggtgccacagggcccagactctgccccactgggtacacctgctgcgtccttcaaatccaggcctctcagggcatccatgggaggacacccctcacccagcagccctctgtgtgtcccctgaggaagggccagggctgccccagccattctgctgtggagagctccacagttaccagatggaatcacgtgagcacccgtgtggacggtgtgaccttctgcatttctctttcaggtttgaattgctggaaattttgagttttgactcagtcagaaggagaatgagtgtaattgtaaaatctgctacaggtaaaatttctttttcttttgatttattaagttatacgtggtggttgtgttttattctgatgactaaattctacaggagctttaaggatttagggtttaagaatgatttattctttttttaaaaactatagacaaatcctctcaaaatactaattttttatttttaaaaagtgcaacatttctggaatgctgaggaaggagtcctgggctaaacatccggcacccttgctctgtccatcttttagtgtcgagttggggccactttactgttgaaaattgcttaattccatttgtgaaagttcctctgcccatccctatcccccacccgcttttctccatgcagagctaaatgacataaaatgtttttaaataaccattttcaaggaaaaggtaatgtgggtttgcaaatgtatctataataatgttcaaagttgcaaagtgagctttgttgattggcagttgccgtaacagtgtgtctgtgagaacagcacactcggttcgtg

SEQ ID NO: 74456 - DNA, 1585 bp, Homo sapiens
cgcggccatgttcttgtgggaaacgcacacctgaagttttttctttaaatagttttgaaagcactatggaatgtattgtaaacatggatgtctttctggtatcaggaagcctagaaaagttctgactttgttataccacattttagatatgataggccaatttctcttgaactgttcatgaataaatccatcattggtcagagcaaaccagtggttaaggtaaaatgcgtctcacacaaactctggaaaccaaggaggtgaaaagttgagcctttgtgcatgtgggtgcactaatctgtcaatttcactaaaaacacagaaccagggtcctcagaatgacgagcctagagcattcacagaccttccatgtgaggaagacggtttgatgtcctcctctccctcacatgcgtaactgcacataaaccttacagaattacttcccaaatggaacagcaactaaggatttgccattcgctcttcatgtattccatagtacttttttaagttctcaactggcttttgaaacatttcatacaaattaacttgtgtttcagtttcctatcttgaaacaagaaggcacccacgtttccccccatctcttcattcttacagcttgaactgttacatttaggcacatagatgggggggaaaagattataaagaaattgactaaaaacttggaaattatttttacataaaattgtcatatttgattttgcacgttacaaatttgaaaattaaaatagcattaggaatagtttatgtttagaaatagatgctttataccaaatagcttgaagtaccttggaatagtgatcttacagaatgcagggttcacatttgcccctgtatatttaaatatattttcccaggatttacacacttttccatatatttaagtagaggaatataacaataactacaagctacttcatatatctcacatctctactgccaaagtttgtctaccagccttttccagctcacgtcattttaatcatacctcatttcttttactttattttgttttgctttcaatatgaaaaaggttttatcctatatggagaaaacagacagaatgtcgtaaattacctctaagtagttaatttttttatttgcctaggctaacttttcatctttgttatttctgcctagtgaatgaataacctgttcagaagtgaaacagagaagataaattccgcatttctttcttttgcagattgttaaattaatcaaattttcaaaagagcacccaatcacgttagcaattggcgatggtgcaaatgatgtcagcatgattctggaagcgcacgtgggcataggtgagcttcgtccttgctgctggcacatcctggtggccaggtcaccccttcgctagacaaaggcccatggcagcacgcaggtgcattcaggacacccccgtcaccaccctcgtgtgtgaccgggaaggctcatgatgatggtttcatccgttcttctccccgtccctgccctgtgtgtggtgtgcagaaagcatttcttcagctccttcacctccgtcttctaggtgtcatcggcaaggaaggccgccaggctgccaggaaca

SEQ ID NO: 74457 - DNA, 1052 bp, Homo sapiens
agaggcagtgaccacgacccacctctgctgctttactgggaagcctgcctgtcctcagagggccgctgcacctgtcacggtccctcaggactctattaacaatgcaagttttcaagtttcatccccgaaatttccaatcactccttgaggtggagccctggactgggcagtgctgaagcccaatggggaaatgaggggtgggggcccctggcagtggctgctcctgcagggtgtgaggctccccaggtgggaggaagacggggagtgagtgggggccggggccccagccctgactcactcacgtagctcagacacccgggggctggctcccagcggtgctgctgtgctgggagggaagacaggttgccctcccttggggggcacagcctcacccaccacccacctccaacaatcagaatgggaccctggcttgagagctttcttgggacattggtgccgatttgaaatgttgaaaccgatgccaccagttcccggcactccctccttcatgcctcctgccacagtttgtaaaatcagagcgagcaaaactcgtggtgaagagactgcctctcaatgtagtgaaaatgtccacacacagctccactgactcgggggccacaggcaggagaaacgcagcagaacgtgccagttggctgcttataagaaggtcccactgaggggcctctgtgcaggaggggagacagtgggagcaggagccggggccctggctgagactccgcggcccccagtgcttcaggggaaactcaccggccccaagcagccactcactgcccagccctgcctgtggcccgagaagcagctgtccagtggtggttttctctaagcacggtccttggttactgagctctttagctgtgcagttccacagcgggcacacgtgttcatgacagggctctgtgcatgggacacgtgttcataaccacatcccatacatggggacgtggcagacacacatgtaacaaggacatcaggcacagaagagacagcagggctgggggtctgaccccgagagagagcaggtgcagcttggg

SEQ ID NO: 74458 - DNA, 1354 bp, Homo sapiens
aggtcttctgtgtgccagccggagcacatagcttgtcgcctctccaacagacatggaggccatgaagacatctgctcctgccagcatccgccgctgccccctggtctaaaagtgggctgacctggggacggcccctcatcagacagatgcgtgctgccggcctcctgccgctccccttgctggtcagacccacagggcccgtgcacatccggggccccagtgggctgtcagaagccatgcaggccccatccgtatggtgacatcctaggcaacatgtcaaggggatgcaagctgggcacgtccagtactaaatcaacccggtccctgtggggtggggcctgccttccctggggcagtgagttcgccttttgttcaagggtctctgggtaccggtatggcgttcgagctcactgcacaggaagccagctacagggaggaagctcgtaggtttcccgtccatggcctgtatccctggggcccctgggttcttccctgggatggtgggacagggggacggtcactctgttggtactgaaaaggagaggccctcattcctagacagagacccctcgcctccatatggcttctctggtggggtggatcccgcccggcctgccctcaggacgagggtgtgtcctgagttgagtctagcagttcctgcaggaggcgatggtagtgagtgcatcccagagtggctcaggtcaccccaggcagccccgtgggtatccctgagactgaccatgtgtctcgttctctcagcagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcc

SEQ ID NO: 74459 - DNA, 2092 bp, Homo sapiens
gtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaag

SEQ ID NO: 74460 - DNA, 1088 bp, Homo sapiens
tgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttg

SEQ ID NO: 74461 - DNA, 1077 bp, Homo sapiens
ggatggggagtggtgaaggttccctgaactgacagggaatgagaggagcagacccatttgagggcactttttgcagaccatgtgtagacaggaggtagcaattgtgccgccgtaggcaccctgggcagcccagggaacgcttgtccacagagggagaggctcccatccactctgaggcctttccagagttctcctttcactggtctccaaagagattctgtagaaccaagtgaaactgctgatactcaatacgtttctcatgttaaacaaaaacaaaaacaaagcagccatttcttacagatttattcaatactttctatctggttattatgcctcttattctgtaattattttttattatgaattatttatttccagatctgtctggcctataaggcctgtaggcactataagggggagtactgcgtcaccttcatctttttatccctttggccttgctccgtgcctgaaagctcaccacactggaacgtccaggtgcacatgtgccactggacaccgggatgttgccggatgctcttttggacgctggaatgctggtgcattgttgccggatgctggaatggtgcacgcacgctctgttggacgctggaatgctggtgcattgttgccggatgctggaatggtgcacgcatgccctgttggactctggaatgctggtgcattgttgccaaatgccggaatggtacacggatgctctgttggacgctggaatgctggtgcattgttgccggatgctggaatggtgcacgcatgctctgttggacgctggaatgctggcgcatgtgcacatgttattggcatgagctgtagttcaaacctcagccatatgatgcttgaattcccaaaccattcgtggaaatgtgtacttcttcctgctggaattctctctctctctctctctcttttaactgattggggagtgaggtgggggggggggtcttgctacattgcccaggctcaaacttctgggctcaaatgatcctcctgcttctgcctcagcttctgcctcggcctccggagtagctgggactacaggcctgaaatactgtttcttta

SEQ ID NO: 74462 - DNA, 1030 bp, Homo sapiens
ctcaagcaggtttccaaacaggcacaggctccagctgcccgaccccaccagggtgcccagctcatggtgctgcgggcgccacaaagcaagcccgtggcagagacttgcctccaagcgctcggccaccgaggaggacgcagcgcttacataatgtgccgggatccggggctatttttagccaccatatgtgctgtcttaagagctgagctctccctaatttggggtgttcttttttcttttctggatgccttcagcatggcttggaatagaaaaattagacattggaagagccaaaatccagtgttcctaaaaccaggctcccaatcgagagcaagacccatgtgatgctgagggcgtgtgggagaaggataggttcacagctacccacccagggggcagaaagatgagatcctctgagaactcacgtctcttctcccttaggcagttgtgcggtcctcagatagaagcatcttttataaaatgctgttgcaacatctaaccctcttccactgtactgcatgtgtgagtgtgtgagtgtgagtgtgtgactgtgtgtgtgtgcgagcgagtgggagtgtaagtgaatgtgagactgtgtgagtgtgtgagtgtgtgcgcgagtgggagtgtaagtgaatgtgtgtgagactgtgagtgtgagagtgtgtgtgtgtgagagtgagtgtgtgtgtgcgtgttcacattttgggaatttgtaatagagtatatatattcatgtttagagctagcctaaatcaaactaaatctagatcctcaagtaggtggctggagaaagtgaatctgatttttagactgcatggggccacaactctctttcctgtaacgccggtgcagtctgtgtgtgcaggaaaggtagaaaacaaggtgtctgagggaccccggacttctaggtcgtccagcaaatctttcacatttgcaaagtacgattgtatgcggcccccctgtgccagctactggggctctggggaggagctcaccgtgggggcggtgggggcggtgggagccgtgg

SEQ ID NO: 74463 - DNA, 1325 bp, Homo sapiens
ctgagtgttttggtgctgagtgtttgggtgctgtgtgtttgggtgctgagtgcttgggtgctgtgtgtttgggtgctgagtgggtgctgaatgtttgggtgctgagtaggtgctgtgtgttttggtgctgagtgtttaggtgctgtgtgtttgggtactgagtgggtgctgtgtttaggtgctgtgtgtttgggtgctgagtgggtgctgtgtttgggtgctgtgggtgctgaatgggtgctgttttggcactgagtgggtgctgagtgggtgctgtgtgggcgctgagtgtttgggggctgtttgggcactgagtgtttgggtgctgagtgtttaggtgctgtgtgtttgggtgctgagtgttgggcactgagtgggtgctgagtgttttggcactgggtgctgagtgttgggtgctgagtgggcgctgagtgtttgggtgctgagtgtttgggtgctgagtgtttagtagctgcgtgtttgctgtgtgtttgggtgctgtgtgtttgagtggtgtgtgtttgggtgctgtgtgtttgagtgctgtgtgtttgggtgctgagtgtttgggtgctgagtgtttaggtgctgtgtgtttgggtgctgagtgttgggtgctgagtgtttgggtgctgagtgttttggcactgtttgggtgctgagtgttgggtgctgagtgggcactgagtgtttgggtgctgagtgtttagtagctgcgtgtttgctgtgtgtttgggtgctgagtgtttgggcactgtgtgggcgctgagtgtttgggcgctgtgtgtttgggcactgagtgtttggatgctgagtgtttgggtgctgagtgggtgctgtgtgtttgggtgctgagtgttgggtgctgagtgtttgggtgctgagtgttttggcactgtttgggtgctgagtgttgggtgctgagtgtttgggctctgagtgtttggacactgaatgggtgctgagtgtttaggtgctgagtgtttgggtgctgagtgtttcggtgctgtttgggtgctgagtgtttgggcgctgagtgtttgggtgctgagtgtttaggtgctgagtgggcgctgtgtgtttgggcgctgagtgtttaggcactgagtgggcactatgtgggcattgagtttttgggcgctgtgtgtttgggcgctgagtgtttgggtgctgagtgtgtgggcgctgagtgggcattgagtgggtgctgagtgtttgggcactgagtgggcgttgagtgttcgggcactttgtgtttgggtgctgagtgggtgctgtgtgtttggtcactgagtgggcgctaagtgggtgctgagtgttttggt

SEQ ID NO: 74464 - DNA, 1062 bp, Homo sapiens
tctcgccctctctcacaggcatctttcccggcaaacctgcagctcgtcctcgtgcttcgcccgacgggttttttccaaaggactctctccgacatcgctttcaaattcaatagagatgactttaagatgaaggtgccggtaagtgcgccccgcctccatcctgcggtagcagaacggaactcattgccgtcctggcccatctgtgatcatcgaaatcctcgaggagctgacttcagggccacacggtcaacaaaaccccgcaggacctggcgggaagttgcacctcctcaatgctgccagaagcagtacaatcctttcttcccccacccccgcccccagcccccaccccgccagaggtgcacagagcatcaacctcagagaggccaccgtgtgggcatcccatcaggacgcgggtcacgcgacattcatacccccaggagaactacagaacttgagaccctaagggctgagagtccgcctggcccacccgcgaggaactcagcccaggccctgcctgcaccccagggatgagagaagggctggggagggggctgtaagcatctctggacctgggagggagcacccactgctgacagggatgggccggacctgtcctggagcagccaacagggtgacccctgccccatcgccaccacactatcccggcacagggcagcatctcccaacactgcccactgagaaagcaccttcagtcctgatctgctgtcctttaaagaacaaaggcttcacaaagtcccttagagcctgtggagcccggtcaccagcccgagctgtgtagctcccccggagagccctggtcagctgccttggcgagctcacatcttctctgccacaaagagaacagagacatatgggccagcaccaggcaccgcagagcaccccatggcaccagccagatgctactggaaaccaggcaatctggggtgcaggtcgctcactgtgaagctactccctgtgcgctgggaatcaggtggcaccagccctccctccccaccctcgttgcgctacagcctcaatgccaaaggtgcaagagcccttctc

SEQ ID NO: 74465 - DNA, 1079 bp, Homo sapiens
cttatataagctacctttaatcattcatggaacaggatatggcctaaataaataatccgtagaacagtagttttaaaaaagaaacactcccccgcccccccccccgccccccgaaaaaaaaagcctcatacttcagagcaagtagggtgggcgtctgttctcatccagcccgtccgggtttaacttagaagtgtgtggcccctcagaagcaggagggtgggcatctgctctcatccagcccgtctgggtttaacttagaagtgtgtggcccctcagaagcaggagggtgggcgtctgctctcatccagcccgtccgggtttaacttagaagtgtgtggcccctcagaagcaggagggtgggcgtctgctctcatccagtccgtccgggtttaacttagaaacacgtgcaggagatgctgctttaggatcaggccgggagctcagagatatctgaatgcctcaggtcctcagggcgttctgaaagactaaccaggcaacacactatttcctttttgatttgtctgatgtcatcagtccctcaagaggaaactcaaggaacatcaagaagctggaagaaaggaaaacagaccccctaagcctggagggatacgtcagctcagcgccactgacaaagccccccgaaaagggcaaaggtgggtatgtgcagggaccgggcctcacacggaggcctcacacggagctgctcacggagtgctcactgcatccgagaaacctgcgcttcctgcagtgtgaagaagctttgcagagcattcagggccccttgctcccctcttaacagagccctaggaccccacagaagagcccctccctctccattgctctgcacccctgcatcagcaaggccagccccagaaggagcctcggccgagcgtgcaacccggagccgccttgggccctccctgcgacagccggacccgcctccgcatcgggttgcgatgccctctgcatagtttctttctcttccttcatagatgacacggtcactagctctgcctcagaaagctctgcgctttccagaaagcgctttaccctgcagggttttgctaacctcaaaggtc

SEQ ID NO: 74466 - DNA, 1054 bp, Homo sapiens
acggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcat

SEQ ID NO: 74467 - DNA, 1059 bp, Homo sapiens
ggtgtcccggaggcgagggtgtcccgggagtgtgggtgtcccgggggcgtgggtgtcccgggagtgtgggtgtcccgggggagtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagcgtgggtgtcccgggggcgtgggtgtcccgggagtgtgggtgtcccgggggcgtgggtgtcccgggagtgtgggtgtcccgggggcgtgggtgtcccgggagtgtgggtgtcccgggagtgtgggtgttccggaggcgagggtgtcccgggagtgtgcgtgtcccgggggcgtgggtgtcccgggggcgtgggtgtcccgggggcgtgggtgttccggaggcgagggtatcccagaagtgtgagtgtcccaggggcgtgggtgtcccgggggtgtgggtgtcccgggggcgtgggtgtcccgggagtgtgggtgttccggaggtgagggtgtcccgggagtgtgggtgttccggaggcgagggtgtcccgggagtgtgggtgtcccgggggcgtgggtgtcccgggagtgtgggtgttccggaggtgagggtgtcccgggagtgtgggtgttccggaggcgagggtgtcccgggagtgtgggtgtcccaggggcgtgggtgtcccgggagtgtgggtgttccggaggcgagggtgtcccgggagtgtgggtgttccggaggcgagggtgtcccgggagtgtgggtgtcccgggggcgtgggtgtcccgggggttgtgggtgtcccgggagtgtgggtgttccggaggcgagggtgtcccgggagtgtgggtgttccggaggcgagggtgtcccgggagtgtgggtgtcccgggggtgtgggtgtcccgggggtgtgggtgtcccgggagtgtgggtgtcccgggggagtgggtgtcccgggagtgtgggtgttccggaggcgagggtgtcccaggagcgtgggtg

SEQ ID NO: 74468 - DNA, 1012 bp, Homo sapiens
ctcctgagtagctgggattaccagcgtgtaccaccacatccagctaatttttgtaattttttttgtagagacgggctttcaccatgttggccaggctggtcttgaacttctagcctcaagtgatctgcccacctcgccctcccaaagtgctgggattacaggcatgagccactgtgctcacggcctgaaccttttatttagagtggtaaatataaagtgttactgtgaactgtaaagcataaattctcttgaaacagaggtttaaatctctttctatatgttgcattctttctgtgcctattaattttacttttgctatttttcttttttaaaatcagatggcctctccagaggagaagtgtcaacaagtcttggaacccccttatgatgaaatgtttgcagctcatttaaggtaatctgttggggaggaagaaaaacacacacatctggaaattgctgaattaactggggattttatcttgcattatcttgtgcttgaagcagtgaataactgactttgaaaaagtgggaaaatgcatttgtaacttcagtttggtaaagcctgtggaaattgtaaacatcagttatataatactatttttaacatcacacagtatttagcagagtgcctgcttagtggtctttttagtagagtttggagccgaactgttcacttacccttttcgtggaaatatgtctgtttttgaagctctttacgttactgggaaagaaattagagttgagcaaagcaaacaatgctactttttatgtacacttcatatctactgttttatctctaaaggatcagttcaggcagaagattgtgtccttatagccatgtgagatttgattactgtctttcagagcagcctgggctacaggaccagtgtggggtctgtgagcaggaatgttctgtgaaccccacagggtctttggaagagttggggcaccaccgtgttccttgtagtacaaagcacctgtgatttcctagctctgtgcagtgtgcgatagg

SEQ ID NO: 74469 - DNA, 1057 bp, Homo sapiens
acccggaaacaggcctgtgaggatcaaacctgttgagaagtcccaagtgactgggcaccatagatgctcaggagtggtgcaggccagctgcctgggacccgaggtccagcaggtgcaatgtgcccacattaactgttgttacctctacccccatgccaactatgactggactgcagtgttccaacgagaagtgccctaaacttagccataataagtaatttatttgtagattcctgaagtactggggtagggtgtggggtgcctttttcttatgattacagctatgttaacaatagggtttttttatgaaccaatctgttgttcatactgaagaattgatgtagcccttttgtttgcaggctgtggaaaatctctgttctcacaaagtctccccaatgctctacaagcaactgcgtcaggcctgtgaagaccacgtccaggcacagatccttccgtttagagaatatcctttttttggttcataaagtttctattcattatctaagtcttttaaaactgaacattattatgataaagagctaatgagtatccttaatattaaaacaacagcttttaaagttctcttttatttgataggtttgtaagcgaaatttaccatttaaattattttgctgatttgaattaaagggaaaccgtgttcatttattgggtatggttgaagtatttaggaaatgttctgaaaaatgtcttcaagtttgagtatcctttattctaataaacaccatctgcattggctttctgtgataggcaacaaagtcccatcgacttggcgacttatggagacacccacttatcagcgcacagttgtgtctgtcaggaggccaggcaggattcagtggattctatgctcagtctcacgggcagagtcaaggtgtcagccaggttggggcctcacctgaggtctttgctagcacgggcaggcagttggcggaagccagttcctgtggtagtgggactgagggccctgccttctgtcccgtgttgcttggtgtcactctcagctccacatgcacaggtccttgcctctcctctcaca

SEQ ID NO: 74470 - DNA, 1943 bp, Homo sapiens
acaccagaccacttgctctaggagcccatattctgggttctttgtcctaaactactttttgggccttttcctaaaaatacacattctaagagtcaaggtaagagtgttcctaatttggtgcatggatgagagttcatgttagttttcattgaggctggaagttaaacctgagccattttcctgtccagctgcactttgccacaggctgggcacactggctcatacctgtaatcctagcactttgggagactgaggaggattacttaagaccacgtgttcaagaccagcctaggagtatagtgaggtgccatctcttttaatttttaaaaaatagtcctagtgactcttaccaggccagtcaccatctccaggagcccccctgtgggagtatgttcagtgtctgccctttgtgaagtggggccttttgtcccgccacctacccccagggcacttaaggcctgggtgtgtttctgccggcagggacttgaaggtgtctggcagtgaaggaaggagaggatgaagggaggctggagagggagtggcgagcggccagaggcaggcggggccgtgggaagggaaagcagcacaggcaagctgagtgcacattggtgatgagatacagagatccatgattgaacttctagtgtatcttagcccactggggctgccatgacaaaacaccatagagtgtggctcatcaacagcaggagtctgttgctcacagctctggaggctggaggtccagggtcaaggcactggcagattgcatgtctggtggggccccgcttcctggtccatagccagcaccttctcactgcatccttatgtggtggaagaggcaggggagctctctggggtctcttttgtaaccccattcttgaggcttgtccactctcatgacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggttgcggtggctcacgcctgtaatcccggcactttgggaggctgaggccagtggatcacaaggtcaggagttcgagatcagcctgaccaacatggtgaaaccccgtctctactaaaaatacaaaaaattagctgggcgtggtggcacacgcctgtaatcccagctactcaagaggctgaggcaggagaatcgcttgaacctgggaggcagaggctgcactgctgagctaagatcgtgccactgcactccagcctgggcgacagagcgagactccatctcaaaaaaaaaaaaaaaggtaataattaaattggccagcatttttaaagttttccttagcagatctgtacagactcactagatagtgttttatttttaaagaagattaacacgtgctggcaggaccactgcagacaaatggtaagcttgttcactttttcatcaaaacacgacctcatccatcttccctcacccacatgattgagagctgagacatagaagttctgttgaggattctgtctgtgttcagtgctgtggttgaacagcacgatgagaaaagcagggaaggtgaactcctcagctcctgtgagagggcaccactgaccctcttggccttcaggtccacagtcacagtccgcagtggtgacagggttcttagatgcctgcatgggtctctaaatgtctctttaagcacagtttactcctcagaatctagcctgaatcccaggtctttcctgcagctgcacaaccagcgtcttaggctttgtagatgtcttggctttgacttgacgtcatgtatacatttttagtgtgacctggccgttaattacttaagtgagagaacagaccgtattaat

SEQ ID NO: 74471 - DNA, 1005 bp, Homo sapiens
aggtggcttctagcagcctgcacctttaaaattgatgctgatgtcttacctcgatctttgtttattgctgttttttctaggcttcaaagtgtgctgaattctatgaaaattacaatgagcagtctaacctttgtaacactttagtacttactggcacatttcactgttaccatttgaaacaatgttaccttctgaaagtcattttaaatgtatttggaaaatacgagacttttttcaagccattggaaaccttaaagtttaattttgagaaggccctaaatggtattcaaatatattctgctttgggttctacattgtcagataatagtattatggctaatgagatacttaagtgaaaccagaataaaaccaaaagggaggagaattaacatgattgagcatctcctgttacaaacaactccacttgatgtgaatatcttttcaagcaattctgtgaaatcattatccccattctacaaataagaaaaccagggcttaaaacagccagatgttggtgcctggaatcacattgcttgtgagctgagagtcacgggtccaatctggttatgatgtttctgcttattccacactgaaacctacacatcacctatccacctaaaaacaaatgcattcagaatttgtgtcaggtgtttttatgaaaggagtcactttataagaaaaaaggccaggcatagtggcccatacctgtgacatcagcactttgggaggccaaagtatcactttggatcacttgagcccaagaattcacgaccagcctgggcaacaaagagagaccctgtctctaccaaaaaaataaaaataaaatttttttttaaagccacaggtggtgcatgcctagggtaccagctactcaggagggtgaggtgggaggatcactttggcccagggggttaaggctacaaaactacaaaaacctgggtgacaaagcaagagacctgtctcaaaaaaaaaagagaaaaaagatttcaagtaaatagtagaaat

SEQ ID NO: 74472 - DNA, 1028 bp, Homo sapiens
cctgtaaacccagcactttgggaaatcacagtgggaggattgcttgaggccaggagttcgagaccagcctgggcaacatgaccccgtctctacaaaactttaaaaagatgggccagatgtggtggcctgagcctgtagcaccagctactcaggaggctgaggtgggaggattgcttgagcttgggaggttgaggctgcagtgaaccgtgattgcaccaccgcactccagcctcggccgcagagtgagggcctgcctcaaaaaaaagtgtattcacttaatttttgaaatgtgaattcaatttgtgaaacttttaaagttattgagtatttactactaagagtaatttatgttaaactatcctgattatatgatagcaggagaagatactgtttgctattgtaaacatgttgctgagttggtattgatttgcttttgtagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcggtagaaaaatatttgttttttttgtttgtttgtttttgagacagtctcacccatttctagacaattttttaatatgggaaaataaggcaaaatcaaccaaaatgttcaagctgctcaaggggtgtgtggaaagcgtttttatcaagtcttattaggacacaaatttaaaaaccgacacacctgcatgcatgggtggaggagggcatttccataagggaagatgaggtaagaatttagaaaagaaatgatgcttgacttcgccaaagaagggaggggtgatcaccatctttgtatcctctaatccatattaaaataggataaaaccagatgagatctcaaatgataatactatttttaagctgtacaattttttcacaataatatcaaaatatattt

SEQ ID NO: 74473 - DNA, 1020 bp, Homo sapiens
actggggtagggctgaagtgagaagatcacttgagcccaggagtttgaggctgcagtgagccgtgactgcaccactgcgctccagcctgggcaacagagtgagaccttgtcgtggatgggtggatagatagataatacatagacagagatagcagtaccttgtcatagatagataaatagataaggtaggtagattcaatagattagatagaatgaatctcactctatgtaagaagaaaattacactattaacgtttcacaagtaaattttaaaagaagaaaaagaagatctaaacgtgtggcaagaattttatttcagtgagtctggtggtgacacctgaagaagggaaaaaggcagtcctagtgaggcattgggtttcatggaatacattctggggactgagataaattctaacacagatgaaactttatattgaaaattacacggtttattttgttttaggttaattatgttttattactttctcaaaatgattgtcttggatttctctgttttagcatatgcagaatcagagtgactcaggccctatagacctcacagtgaacatactcacaatgggctactggccaacatacacgcccatggaagtgcacttaaccccagaagtaagtgtgcagaaagcatgctgtccgctcccgctgtcatgcccttaccaggcacagatatgttgccttcaagaattgttgaatggggagtttttaaaaatagcccactcagtccaaaatcaaagtgctcttatggtctttggaaatgtgcttgagaaagtgaccacttttgtcaccttctgtggctcctcccagtgcagcctgtgtccacctgctgacctgcagggggcccatgagcacaggcacttgttttggaagttatggcttattaagctgcggttcttgtctggttgttctttctttccattgtagacagtgctgaagtcttgggaatggcattatttagggccttctttgtcagccactactttagctacactaaacccttcagtg

SEQ ID NO: 74474 - DNA, 1048 bp, Homo sapiens
cctgaatagaaaaggagatcatcctgggatatataaggccaaattgcattcacccctacgttacagtcagtcccgtataaaagaaagctggactgtaatcccagtacctggggaggccgaggtgggtggatcacaaggtcaggagatcgagaccatcctggctaacacagtggaactccatctctactaaaaatacaaaaaattagccgggcttggtaggcaccagtagtcccagctactcgggaggctgaggcaggagaatggcatgattccgggaggtggggcttgcagtgagctgagattgtgccactgcactccagcctgggtgacagagcgagactccttctcaaaaaaaaaaaagtttgagagcaaaaagaagcttcttttaatttttcaaagattgtacatgcacagcttcagaggtgtgatgaggccttctcttccaggggaagaaggaattccaggtgtccctcttccagacactggtgctcctcatgttcaacgagggagatggcttcagctttgaggagataaaaatggccacggggataggtacgaaaactgcagagtgcatagctccatgagttgttcttaaagcatgtatttgttttaagataagacatagacttggtagcatgattggtttactgttgttgagtctcattcgtttaacgccagcctttgcctgcatttgcttcccattcagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgtatgtataaactttctctttttacttatagggggtttagcagggaatcatttgtttttgtagtaatgtttttggctgttagaggcctgaagcacatttctacaataatccaatttcactatgtaatgtttataagagtactcattttcctgtcgctttcattaacttc

SEQ ID NO: 74475 - DNA, 1646 bp, Homo sapiens
gtatagttacatacttcatgcatataccccttgtatgtaaatgtttgtaaatttaatgccattgtaattaggggggttttattcttcttttttagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctattttttttttcttataagttcgttgtgtctagagattgttaatattgtaatttaatgtagacttactttgaataaaattagtttaattgg

SEQ ID NO: 74476 - DNA, 1057 bp, Homo sapiens
gatgagggaaagctggcctcagactcacggtggcaatgttcatgtctagtaagtagtttaaagagcgccgttcctgtaggccgaaatgcgggaccagggaacacgtggggaagcacccttctcttctgtcagtttatagagctcagatgggcagtaggtgctcaatattgtattgactagtgaatttcgttctcatttattgtcttaataagaggatgtgtgctgtctctttaagacagtccggattgccccccgccaacactattctttcacctcctccccccgccgccctcccccgtaatatgagaagattatcttaaatgccaggatctgaaaggtgatgtagaatcaagctgggggagtgtgtgtgagttaagtagatatagaaatacactcctgtacacatctgccttgacttctttaaatccctcagtcccatccagctgtaaaactctgttactgtgagtgaatggatcttggcttcccttttttgttttgcctgttgtgtaaaatgaattctttgaactgcctgaatagccacagagatgaacttattccaatagtaagcctgaagccttgctcagctcctgcgacagggtcaggtgtagttaatgaaaggagttgcagaaacaagttttgtcatgtcacagcaactgcattgttctttgttacagatgctcacaagcctcataactttgatgttttgtttcatgttttaaaaactcacttcaggccgggagcagtggctcacgcctttaatcccaacactttgggtggccgaggcagatggatcatggcgtcaggagttcgagaccagcctggccaatatggcgaaacccggtctctacaaaaatacaaaaattagctgggcatggtggcgcacgcctgtaatcccagctacttggtaggctgaggcagaagaattgcttgaacccgggaagcagaggttgcagtgagctgagatcaagccactgcactccagcctgggcaactgagggagactccgtctcaaaacaaaaaaaaaattaactttaaaaatgaagagaaaaaatccata

SEQ ID NO: 74477 - DNA, 1790 bp, Homo sapiens
ttcactgcagcctccgcctcttgtgttcaagcagttctcctgcctcagcctccctagtagctgggactacaggtgcgcgccaccatgcctggctaatttttgtagttttagtagagatggggtttcaccatgctggccaggctggtctcgaactgacctcgtgatccacctgcctcagactcccaaagtgctgggattacagccatgagccaccgtgcctagccaaaatccaacttttaaaaaaggccttttaacaacttgcatttaaagatatttaaaatgtttattttaatgtgcgatttcaccaaaaatccttttttcttaaaaaaagaaactgctcaattacaaatttccactatattaataattaggcattgtttaaagctactgtgtttgaatacttagaaagctcaaacatgaactgaaacttgtcctgatagataggattagctgtgattgcgtaatgtgaccctttaaaccattgatgtcagcaggatgaccgccttaccctttccacttgaacaactgtcacttaggaggtttgaacaattttatactcggctgggtgcagtggttcacgcctgtaatctcagcactttgggaggcccaggtgggcggatcagctgaagtcaggggtttgagaccagcctggccaatgtggtgaaaccccgtctctactaagaatacaaaaattagccaggcgtggtgtggtggcaggcgcctgtaattccagctacgtgggaggctgaggcaggagaattgcttgaacctgggaggcaggggttgcagggagctgagatcgtgccattgcactccagcctgggcaacaaaatcgaaactcaatgtcaaaaaaaaaaaaaaaaaaagaaaaagaaaagaaagaaaagctgggtgtggtggctcatgcctgtaatcccagcactttgggaggctgaggcaggccgatcactaggtcaagagatcgagaccatcctggccacaacatggtgaaactccatctctattctttttaaaaatatttttaaaaagttagccaggcgtagtggcacaggcctgtagtcccagttactcaggaggctgaggcaggagaactgcttgaacccggaaggtggaggttgcagtgagccgagatcgtgccactgctcttcagggcaacagagcgagactccatctcaaaaaaacaaagaaaaaaattttttttctactaaccgatgttacctttgattgtgcagattgtcagttatgcggtggaaagaatgaatttgtcagcagatttgaggtcagaatgtctttgtagccctgtaattttgaatttgtattgcattagccccatcccagacaacgttaccctttcttctctgtacccaagacttttattgcatgtgcttctacatggtaacatctgttcggctgcactgggattatttttgcctgtgtatctcccttccttaactgacaggtagtaagtgctgagtacatatatgaagaaaggatcaattttatagcagtggctctcaaccaaacatatgcacggatccacacgatcagctttttagaaatatacataccacagcgaggcacagtggctcatgcctgtcatctcagtgctttgaggctaaggcaggaggattgcttgagatcagcctgggcaacatggcgagaccagtgtctctacaaaaaaaattaaaaagaaatatacggccgggcacggtggctgtcacgtgtaatcctaacactttgggaggccgaggtgggtggattgcctgagctcaggagttcgagaccagcct

SEQ ID NO: 74478 - DNA, 1088 bp, Homo sapiens
actggctgcgtaatccatgtgtctggttgttcattgaatttaagaaacacagtggaggctgggtgcagtggctgacacctataatcccagcaccttgggaggccaaggtgggtggatcacctgaggtcaggagttcaagaccagcctggccaaagtggcaaaaccccgtcgctactaaaaacagaaattagctgggtttggtggcacgtgcctgcagttccagctacttgggaggctgaggcaggagaattgcttgaacctgggaggtggaggttgcagtgagctgagatcacgccactgcaccccagcctggcgacagtgagactccgtctcaaaaaaaaaaaaagagaaacagtggaatcttgtaataaaagccatcactgctacagctgtggaaaatggaaatactcggtcgtattttctggacagtttttgatggtctccgtcttccctggaattgacaggcctcatgcattgtgcgtcagcagcaatgtttatggtgaaaaatggcaacgggaccgcgtgcataatggccaacttctctgctgccttctcagtgaactacgacaccaagagtggccctaaggtaggaaacaccagggcacttcatgcttcccttgtgtgtgtggaaagatgatttttaacatttcaaccaagtctttgaaaaatggccccatctgaacatggtgcttttcctatctgcatatctccttctggtgttgtcagtaacctgcgctgtcatgtgccatagccacaggcacagtaacaaacctgtatatgtgctgcacctcactgttcatcatgaacattttcctttttttttttttttttttttttgagacggagtctcgctctgtcacccaggctggagtgcagtggcgcgatctctgctcactgcaagctccgcctcctgggttcatgccattctcctgcctcagcctccccagtagctggggctacaggcgctcgccaccacgcacagctaatattttgtatttttagtagagatggggtttcactgtgttagccttgatggtctcagtctcctgacctcgtgatccacccgccttggcctcccaaagtgctgg

SEQ ID NO: 74479 - DNA, 2095 bp, Homo sapiens
accatgtctgattagtttattttgtttttgtagagatggggtcttgctatgttgcccaggctggtcttgaactcctgggctcaagcaatccccccacctcagcctcccagagtgttagcattacaggtgtgagccaccatgcccagctgcaaatttttgattatatgaattattaagccaactttctcttacacctgaaatacttttcagtcttttactgacatgtaatactaacctttttttggtttatattaaaaatgagtacctcagtagtgatatcttagttggaaatgaagtataagtttatatcagacttacagaaaatctctttctttgaacttttaataacctgcatcccaattgggttacatttaattgtgtttattctagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaaggtaagaaccaaaatgggccgattatgaagtgatagaaaattgggttggaggattgtctaaagttacttttacctaagaagtacaggctgggtgtggtggctcacacctgtaatcctagcactttgggaggctaaggcagacagatcacttgaggtcaggagtttgagaccagcctggccaacattgcgaaacactgtctctactaaaaatactaaaattagccaggtgtggtggcgggcacctgtaatcccagctactcgggaggctgaggcaggagaatcgcttgaacccaggaggcagaggttgcagtgagccgagatggtgccactgcactccagcctaggcgaccaagtgagactgtctctaaaaaataaaaaacacacagccaggcgcggtggctcacgcctgtaatcccagcactttgggaggccgaggcgggcagatcatgaggtcaggagttcgagaccagcctgatcaacatggtgaaaccccctctctactaaaaatacaaaaattagctgggcgtggtggcgcgcgcctgtagtcccagctactcaggaggttgaggcaagagaatcgcctgaacccagaaggcggaggttgcagtgagccgagatcacgccactgtgctccagcttgggcgacagggcgagactctgtctcaaaaaaaataaaaaacacataaagtaaactaagtactataagtagtttgcaattgtgattttttttttttaatctagaaatcaagactggaatctataactgacatcagggctaaaataaaaaacacataaactaagtactgcaagtagtttgcaattgtgattttttttttttttaatctagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagccggggaggtaggacgctgacccttggccctctggtgctagtggttgggtagctgggctgcagtggctgcgggtgacctcactgctctgtgtcctggtgctgggctctgcctggaacgcgtgtgcacacagccggcgacgtctctgcagaacgttctcatccttcttcctagggcaggtgacttgtagatgagggtagacacatgttgattaaaaagggtggaatattgaagtgaaatatcccgggacagagacagatgttgtgtggtctcccgtgggagctaaagcagtgggagtcggcggggggcgggtagagagagaggtgatcaccaggggctggggttaagttggtcagaagatagagcgtttccggaagacaggaggaattagtacagcatgtgactgcagttaataatgtattctggcttgaatattgctaagtagattttaactcttctcaccataaaaaagtaagtgtttgattttagc

SEQ ID NO: 74480 - DNA, 4723 bp, Homo sapiens
ggggtgaggtggccggccacgcagcacagcttcctgcgtccactccttcgtgacagcgttcaaggctttctcaccctcactttaggaagagggtggcacagtggcccctgtccagccacggggcttggggtgtggtgggcggtgcctgctgcccaggcagaaccgtcctgggtagtgggaggtggaggctgagggtgccccacgggcctgtgcctaccgccctgagccgtctgcaggacccagctctttcctgcgcgtctagaaaggcattagcgagagccaccttgggagactgagaaaatagtcaccaaggacgccagagtccacagatgtagttttgtttctgagtttggatcttactgtaactgctgatggttatgagaaacccagacctgaatctccctccactgcacctgcagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacggtagggctggggcctcacctgggagagggggacggcacggtagggctggagcctctgctccctgtgcactgagaacacgcgtctctgcacgtcatgctgttaagtcaggatgggagcttagcttgcaggacgtgaccctagaggacaagagctggcgtctgtgtcagtgagtccattttgtaggatcacagccgtcctgctggttccatcatccaaggctggtgtcccagcatggcctattgggcagtgtggcccacagagcctacaacttggcccctgatagaacctaagttttctttacatatttatcatggaaacatttaagtgttacatttttatagttttcttttgaaatagtttttctcccctagtagtgacaggctgtggggttgtgggggtcgacttgcgtgccgtggggtgagtttgcagggctgactgctgcagggggaggtggtgctgctggttgccctccacgcggggacgctgcactccaagagcagctgtcacggggtcagggagagtcatcttgggatcccgaaatctgtactagtgtggtctttcagtgttttccttctggttttggttaaaacaaatgtggccttgaattcacggtttcaggactgtttgtcttttcgagagtgtggaggacctgagctagggtggtgacttgcttgcttgtcttatgcagacggtgacaaggcttctcaacatcaaccccaacaagacctcggccagcgggagctgcggcgcccacctggtgactctggagctgcacagcgagggcaccaccgtcctgctcttccagttcgggatggtgaggctggggcggcacctctctgggggcgcccactgtgtctccaccacatctttttgtgccctgggtctgctcatgggaggcagcgttaggaaggaggcggcctcacttttttctgccttccctttatcctgggctttttagttccttggttcccctcccccctttccattccattcatagatgcagcagatgatgtgggcggggctgctgtgcccacagttggagtggctgcaggggagggcatgcaggccgtgcggccttctggcttcagatgctgctgccctgtggttccgtggtggcatttctgcctgggaggactcctgtgcagttagcaacataagacatgaagcatataattgtcacttgtcagtctttttaaatcgctgtgcaaatgaattaacagttcagtttcttataattttagctttccaaatcatgctttcctgtgctgtgatagctcctgcagtccccgttttccagagactgactctcaagaggtctggaaggaccagcctgggcagcacagggaggctccatttctgcaaataataaaacgagttagctgggcgtagtggcgcacacctgtggtcccagctacttgggaggctgaggtgggaggatcacttgagcccaggagttaaggttgcgatgagccgtgatcactccactgcactccagcctgggtgacagagcaagactctcagagaagggtctggaaggaactaaccaaaattttcattccccagagatacacaacgccttttatagacaagatcttttgcagttttgttctaatactagaaatgtaggaagtcaggtttattacccaatgaccattcacgtttgatgataaatgtgtgaatctactggggttaaagatcatctttctatgaatctgctccgtgattaaagatcatttttctttttaagaatgcaagttctagccggtttttcctacaaggaatccagttgaatacaattcttcctgacgccagaggtgagaacccacaatctctgcgagccccgcccccgcccgcgcgcccagggtattctggagccactagacctctgtgtgtgttgcagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctggtgagtgtcaccgagggcagctgtcgcggggtgtggaggacgtgcttcagactccgcctgtggacgtttagtcgcttccgtgtgggctggggcgacgcccctgttcctctgcaaggagctgtttcttcttgccggtctgagattctagaggtaactccccctgctttagagaggcccagcgtgtctctcagctgggagcccctggtaccatttgagagtaagggaatcattttaagaaacagtggtggcgcttctcccatgaacgttgaatacaacactgtcatctgatgtgcacagaggccctggacgcagcacagctgtccggccacagcccctgattccagacgggggagagacgtgtgtggtttcctcgccgtgcagagagcaccagtctctgcagcggcttccccaagtgacaattccagctagagctggaaccttccgccagggttcctctttgccttttggctgatgtgggggagtggtggggagagaggcctgtttgcaggcccctgtgtgagcagagccctgacaccatccgtctgtcttggcagtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaacatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttatttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttttggggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcatacagataccatggaatactatgcagccataaagaggtatgagatcttgtcccctgcagggacacggatagagctggaagccattattctcagcaaactaacacag

SEQ ID NO: 74481 - DNA, 1030 bp, Homo sapiens
agagagagcggcacccccaccccctcagagaaagcggcacccccaccccctcagagagagcggcacccccacccctcagagacagcggcacccccacccctcagagacagcggcacccccaccccctcagagagagcacccccaccctcaaaatcctactttggtaaatattaatgtttaaccagttagcaaaatatttaacccagttagcaaaattaacaccgtcatttcgatagttactctgttgtgcatagtaaatgctgcaagatgaacttcacattggatgaagcagatttgagaaacgtttgccagaaagtgtgcctccccttcgacaggaccctaagcccagagaaaggaacagaggcccctgcagctgctgtgcctgcgtgcaccaggctagatagtctggtagcctgcgtgactcctcttcctgccgacgaggtaggcgatgaggacgatgaggaccagccccgccagggcaccacccacagcgatggggatcagcatgctgttctcgtccagcagacactcctccactgccaagacagacggatggtgtcagggctctgctcacacaggggcctgcaaacaggcctctctccccaccactcccccacatcagccaaaaggcaaagaggaaccctggcggaaggttccagctctagctggaattgtcacttggggaagccgctgcagagactggtgctctctgcacggcgaggaaaccacacacgtctctcccccgtctggaatcaggggctgtggccggacagctgtgctgcgtccagggcctctgtgcacatcagatgacagtgttgtattcaacgttcatgggagaagcgccaccactgtttcttaaaatgattcccttactctcaaatggtaccaggggctcccagctgagagacacgctgggcctctctaaagcagggggagttacctctagaatctcagaccggcaagaagaaacagctccttgcagaggaacaggggcgtcgccccagcccacacggaagcgactaaacgtcca

SEQ ID NO: 74482 - DNA, 1035 bp, Homo sapiens
ccatcctgtcacctaggtatgaagccagcatcccttagctattcttcctgatgctctccctgcccccgacccaacgggccccagtgtgtgatgttcccctccttgtgtccatgtgttctcatcagaagctcccacttacaagtgagaacaagtggtgtctggttttctgctcctgtgttagtttgctgagaataatggcttccagctctatccgtgtccctgcaggggacaagatctcatacctctttatggctgcatagtattccatggtatctgtatgaaaggtaatttttttaatgatttaaaaattatcatgttacatgaatgaaccagacaactgtgccaggcactcgggccactcccaacaccattccctacgtctggcaccaagaccaccctcaccccccgtttccctgacacccttctctctgcaccgagaccaccctcaaccccgtttccctgacgtccttctctcatgagctcccattttagctgacagaaggacaaggcccaccccaaaaagaaagaggctttttattacattgttacaggcaatgcattacgtgagctggtcccgtgtacaatccccaagccacggcaaaacatcaggagaacgcaccgatctcacattgtacacagcgcagaacaggatcaccccgaatgtcaacagaagaccaaaaatcactttacaaataaaaataaaaataacacccatttttatatttaaaaaagtgccagcccttgagctgcagacattagagacgcccaaggacgtgccgccactggaacgaggccgccagccacgtgtggcccgtcctggcctttaaagctgaactgaagcgctccagacactcatctctggagttcctctgtcttaggatgttccctctctactgttgtaatgtgtgagcatgtcagcctcaccacgagtgaccttcatgcgtcctacgtgtgacggccagaggctttccctttgtaaggcttaaatctgagtgcagtaaagaatgaagaaaccaaacaccagaaccctaaact

SEQ ID NO: 74483 - DNA, 1010 bp, Homo sapiens
gggacgtcctgaaaggcctggctgtgggggtcgctccccatgagccctgtgtctgcaggcctcaccccgactcttcctctccaactttgtccctccctcttgggaggggtcctcccagggtggccctgttgtctttgtctggctctgaggggaatggggcttgtggaggtgacgggagtgtctcggggtcttttctccacattgcctggcagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggaggtgagcgcctcactcgggccctggggcgggcgggccgccagggagtgacaccgggttcccatgtctctgcagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcaggtgtgtggggctgcacgtggctcagtcccctcccagggggccccgcctcacctgcagcccgggggctgctctgaccacccggagggtgcacaggacgggcaccagtgggcatagggcacaggatgagcctccagctctgtcctgcatctgccccctgcgcctggcctccgagggctttcctgtctatggcggccctgtcttcttggccctggcactgcggacgctgctcctggtcctaatggctgtactcatctgctgtgtgtggtgccagaagtgtggcttcccgaggcccggcctccccactgggtcctggacctggcgcaggccgtatagactcaggtcctgatgagggcgttgtgggagctgt

SEQ ID NO: 74484 - DNA, 1013 bp, Homo sapiens
ggcggttccgatctttatctagacttctccctcttcttcagtattaacacaatggaagtgactcataaaagataatcagaaaatggttacgtgaatgagataatggcgtcaatgccaaggagggagctgggcgcccaggtgggcaggggatgtagctgatgcaagtgtgcatggaaaaccaggtgtgtgcatgggagcccgggtgcgtgcatgggagcccaggtgcgtacatggaaacccaggtgcctgcatggaaacccgggtgcgtgcatggaaacccgggtgcgtgcatggaaacccgggtgtgtgcatggaaacccgggtgtgtgcatggaaacccaggagtgtgcatggaaactcaggtgcgtgcatgggagcccaggtgcgtggatggaaacccagatgtgtgcatgggagcccaggtgcgtggatggaaacccgggtgtgtgcatggaaacccaggtgtgtgcatgggagcccaggtgtgtgcgtggaaactcaggtgcgtgcatggagcccaggtgcgtggatggaaacccaggtgtgtgcatgggagcccaggtgtgtggaaggaaacccaggtgtgtgcatggaagcccaggtgtgtgcatggaaacccgggtgtgtgcatgggagcccgggtgtgtgcatgggagcccgggtgtgtgcataaaaacccaggtgtgtgcatgggagcccaggtgtgtgcatgggagcccaggtgtgtgcatggaaacccaggtgtgtgcatgggagcccaggtgtgtgcatgggagcccaggtgtgtgcatggaaacccaggtgtgtgcatgggagcccaggtgtgtgcatgggagcccaggtgtgtgcatgggagcccaggtgtgtgcatggaaacccaggtgtgtgcatgggagcccaggtgtgtgcatggaaacccgggtgtgtgcatggaaacccaggtgtgtgcatgggagcccaggtgtgtgcgtggaaactcaggtgcgtgcatggagcccaggtgcgtggatgga

SEQ ID NO: 74485 - DNA, 1097 bp, Homo sapiens
cccctcacccgctcctgcccctcctctctccccaggtcctcccgcccccagccccgcccctcccccgccctgggtgctcccctgcccctcccccgctcctgcccctcctctctccccaagtcctccccgcccccagccgcccctccccccgccctgcccccccccgcccccgcctccagccccgcccctctccgctccccgccccgcccccacgcgcccgcggtcccgccggaaggacttaagcgccccggagccgggaggcgaacttgggacccgctggcctcgctcggtgcgcgcctccctccccgcatgcagcccgccgagcgctcgcgggtccccaggtgtgtggcgcggggtgcgggcgtccccggcggctgcggtccccgcgcgggcccgcgaccccccagaggaaacttcggggacgccggcctccttctctcggttttgcaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacaggtgggtcccgggggcgcaggtgggtcccgagggcgcaggtgggttgggctgggacgggccgggcaaagtccgggctcccggagcggagggagggggaggaacctttccgggcaggtcgggacgaagctgcgggctccgagctagggcagccgcagggaccggttttcccgctttgagatgggccggcgggtcggacgcgaaggagacccgtccctcccagcagggagccatatcgggatggatcaaaactcgatccatgccgggcgcggtggctcacgcctgtaatcccagcgctttgggaggccgaggcgggcggatcacgaggtcaggagtttgagaccagcctgaccaacatggtgaaaccccgtctctactaaaaatacaaaattagccgggcgtggtggctcctgcctgtagtcccagctactctggaggctgaggcaggagaatcgcttgaacccagtaggcggaggttgcagtgagccgagattgcgccat

SEQ ID NO: 74486 - DNA, 1041 bp, Homo sapiens
atcactgaatctcattgacagaagcgcggcttccaggattgaggcagcagtgcaggagctcagagggcactcagggctgccggggtggggaagggagcaatggggtggtcccacttgggaagagccgcaggagggagcaccccctgctggcaagaataccaatgacctgaggaacatgcctcctgctccgcgggggtccatttagctcccttcctgagcagctggtgtgactgcctggggcactcaccgagcatccggggccactgtgagcccacagccccctagacatgccagcacacacacaccagggctcccgacctggccgtgctagggcgaaagaactgggtaacttgggctggttcattctgtgaaacacaaatggtgtggacctcaagtcatttgggttcttgaagtgtaaatgttggattgatgtgtgactcagtgctttggagataaaaacggtgctctaacgggttttctgtttgcttgctttcctttaggagcttggcccgttcttatagatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccct

SEQ ID NO: 74487 - DNA, 1009 bp, Homo sapiens
tatgctgagtgggaaaaaaacaagttgcagaaaactatgtgtaatttgatagcagttaatgttttaaaatgtaagacaagcttatgagctgttcgtgaatatatatatacatgcagctaatgggcaggtaacgagattaaaatgctgcccttctatgtgacaaaacaggagtttataattgtaatatttaaaatgttttgttcttaaataaatctgctttctatatttggacattagcgttgttgtagcacttaacatttatacagaacgctattacttttaacaattttattgtacttgttcctaatcaaattaatgaacattaattgaagatcgctaggccactagaatatatgagagttaagctctgtattttaaacctggtgggttttttttttctctcatatattaggaacatcacaaaagatcaattccaagggacacctggaacctcctgctggactttggaaacatgattgcggatgatatgtctaactacgatgaagaaggtaccggaagttgtgcttcagatgattgaccgaaatgcttacacctgagaacgttaacttctcctgcctctagagtggtgaccccgtcactgagatgggcgtggtcataatactacccccttccttattattttctgtaaatcatacaaaagaaaaatagggttttatatttagtgtaaatcaagaagacagtcctctaagccaaagcatttcagaattggatgtgaagagttagagacccccatggtggagccatggagttaggtattgggaaaccaccactcccagattctcagtcccgcatgatgccttaggtcagttccacactgcactcttcaggctgactcggagattccagctcctgtcttcttgcataaatatatctccacatacttgtctccccccgtgtttaggactctgcgttggagggcctttggagcctgctgtgtgctgggcacgctgccaccttagagagggatggtctctgggtggaaggcctc

SEQ ID NO: 74488 - DNA, 1111 bp, Homo sapiens
taatctgtctgaaattactagctttagtgaagtcttgctgggatgccttaaatatattttactgtttgattttctgataaacaaatgctaagttctttaattttatttctaaactagaaatagggggtggggaacctgaatttctaagctattaaatgtggatacataagctaaatgattctgagaagtagttattgtccagtaccattagaattagcaaatgaaatcacttaagaaaaacatcaatcattcatttactttggcagagttgtgataaaaactcaagatattgtaaatactttatcaatacagtatattttatagcagtttgcctttgggtgagctaaatttctgtaaacttaaatttttatttcactttagggaaattaagtttttcttagtgaacagatcttctcaaaaaaaattcagtgatttttttttttccctaaaacccagaaacctagattttaaaaataggaccgttttctggataaattattagttgctcactatttctttcatgtgtagtagaaaactgcagcctattgattgatgtattggaaacacgcttgctagaactatgtagtataatcgaatgctaggattcaaacctcctattttagaattacttttcaaaatagtataacttccttttcccctgatattaactacagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtaagtcaactattcttagcttaaatgttttcagaaatgaaaatacttctaacattatttttcagcaacctgtacatactaatttcatatctgcttattttctttgtgtatctttaaaatttcttatgcgtctgtactctccgcactatcaagcctttggtttccttttaattttcaatttaacactttatttcatttcacatttttatttttttcatattaatcccttttgtaactcattttcttctttttgagttttttcctttcc

SEQ ID NO: 74489 - DNA, 1068 bp, Homo sapiens
cctttgtaaatttgatctgggtttagtcctgtctagagggactcggcttccttctctcccctgtagttttttagttgacgagcctttttgtttcctaagaagctttatgccagttccctttttcacaagaggtaacttgggtctctcagtcacttttggacatgaagcacctagtctttagacttagctatcgatcattgctttaatcactgttattttatggagaaacctgtaaggggtgacatcaaatgattgcagctttgttgactgaccagaggcctgttaatggactaagcctagaccccaaagcttctcttgctccttcagaaccagtgccttggcaccaccgtgtggttcagggtttactggagtatcttgtgacatcagacaatttgagtagattgcagggggctcttcgtgtttctggataccgacttctgtccactctagctaacagtagtgattcaaagccattttgagtggcctggatccatgtgctcctgcatctgttcttctagagttccaagaaattaggctgctggtgttatggtgttgtcacacattaggggaggcttcaaggggttatcggcaggagctcaagatcagacaccatcatatcttccagatttgcacattcctggtgtggagtcatcagttgtataatgctggttaaataattcagtcgccgaagagtatattagtctgctgattggtcttggagggtctgagggtacaatgttgaatttttttaggtgaaattcatataacataaaattaactattttaaagtgtacaattcagtggtgtttagtacgttcacaaatttgtggaaccactacctctatctagtcctaaaacatttttgtcaccccgaacgataactgtacccattagcagtcactcccaactcctcccttgccccagcccctggctaccactcacctttctctctatatagatgtgcccattctggatatttcatataagtgaaatcgtacactgtgtggctggaatcgcacactgtgcggctggactcatgcactgtgcggctggagtcgtgcaccgtgt

SEQ ID NO: 74490 - DNA, 1024 bp, Homo sapiens
ttacaggcgtgcgccaccaggcccatatttttagtagaaacagggtttcaccatgttaaccaggctggtcttgaactcctgacctcaggtgatctgcctgccttggtctcccaaagtgcttgggattacaggcataagccaccatgcccaaccaacatggactctcttaaatagacttggttaatgtcttttgcacatggtggagttggtagagatacgaggctgcgtcgccccccaaaaaaatgacctttaatcctttctataaagatgtagctgacctttaatcatctcagcccttcacaaagcaccatacaaggtacatcaacattcagtatttgattttaatctcagtgaaataaatagtttagatgttgatatttatctaggaaaaatgagaatttcttcagaaaggtgtcagtttttcagatctgattatttaatactctgatcaatagtaatgaatcattgtttaactatgtgtgacaataactctttttcagctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaag

SEQ ID NO: 74491 - DNA, 1109 bp, Homo sapiens
tcatctgaaagtggggaaaatggtcatcttgagctcagggtgttctgaggattaggttctattcacacacatggggagagagtgcgtgtgcgtgtattgtgtgtgtgcagccctgtgacagtgcctggcacagaggaagccctgtgtgaggattcaccatgttcagatggtgaccccagcgttgcttcacaaaagctcagctctgcctcctttcctggatgcagaaatgcgtgaagtctgtgtggtgtggtcattgcctgttgtcactaaaaagtgtgtgactcactgtgttctctttaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggtaggtgacggcatgttctgagtgcgtgtctaattcatgctcgtgtgtaggtgacttttggattcacagttgagggcatgtgaggaaaaattgcaaagtcttatttcccctcttaggactttcctaaccatggtggataccagggcttacattctgcaaggaaatggtgtccctgtgaactcagctcctccaaacctccacttctccacttgattaagaaaaatgcccgtgaggattgattgagggccagagagaaattggaccaagattttgaaaaaccagtcagcactggaaaatgacctgtggaactggtggattttaggaagttgcgtatgttttgctgctttaattctagcaggcactgggaattgatacacttttgatactttcttcctgtgaaatcaaggtgctttggtaactgaaggtgttcccgactctttggctttggccttagtttcatcgtatgtatgaaacattgccgcttctaagtcgtgactgtttagtggaagccgacttgctcggagcctaggcaggaccgtgtccctctgcggggaggacagtggaagccgactcactcggaagcctaggcaggaccgtgtccctgtgcggggaggacagtgg

SEQ ID NO: 74492 - DNA, 1002 bp, Homo sapiens
gtttgcatgtgtctgcatgcatgtgcgtctgcatgtatatctgcatgcatgtgtggtgtgtgtgtgtgtatgagagctatcattgtatggttgtatatctgcatgcatgtgtggtgtgcgtgtttgttctgtggtatgtctgtaggggggtatccacgtgtgcatatgtggggtatatctgtgtgttgcatgtgtctgcgtgcatgtgtgtctgcatgtacatctgcatgcgtgtgtggtgtgtatgcgtgtaggagagctatcattgtgtggttgtcattgtcactgtcatcatcattaccacttccccgatccttcttttcattctcccaatatcgtattgccaaacgtaaactgcacctgcttgggttcgtatggagagagaagccaaatgggaagaattaatttatccagaaagttgtaggttgtgccgcatatacaaatacattccaagaatatcagccagaaaataaggacagttgcaaagtctagggtgccctatgaaacttaaagtgggataggactgtaagcttgagtgtgttttaagccaatatactatactttatgtatgtaaatattgtgctttagatctaatctccagaggctacctttattgcatttcttacagcaatgagtacaactgatcaaaaattaggagacctttttgaaacttcttttggaaccagattgaggttctaggacctgtctcgtgtgctttatttcttcctttccaacccgtatgcttttgggtttcttcttgccttattgcactggctggaatgtccagtactttgttgaaaaagattgtgtaagaggacatctttgccttgctcttgggaagcattcagtctctcaccactaggtatgatgttagctgtaggtttattgtagactctctttgtcaagctgaggaaattcccatctattcctagtttgctgagagtttttatgatgaatgggtggtggattctgtcgattgctttttctaaaccaattgatatg

SEQ ID NO: 74493 - DNA, 1093 bp, Homo sapiens
caatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaatttttttgtattgagcttatctttatacaaaattccagccaatttttttttttactaagatgatttctatattaacatgctattctccaagacaccaaattaatgcagtgttaattgataagttctaacttttgatatttaaatatctattttggtgattatgtgccccagtttagaaaaccacacaggtgaggatctgagcctcacaaggacttccctaagaggcattgtgctcatctgttttgtgctgctgtaatagaatgcctgaaactgggtcatttacaaagaacacaaacttatctctcgaaattctggaggctggggacaacaagatggaggtgctggcaggtcaggc

SEQ ID NO: 74494 - DNA, 1665 bp, Homo sapiens
acttatttcttgtttttccttacttttttttttttttttaccagaaaaatcatttttcttctctgggaaggtgaacatttgtagcattgatttcccggatctggtaacatggcaaaagatgtaagtatgtttgcttcatgctgcacacgaatgtttgcctcgcactaaattctttgtagttctctgcctttatttcagaatgacaacacataagctacagtagtgtttattttcagacttttaaagcgtctgaagcgggatgaaggtgaaagatggaaggatctgatctctgaagctgcggtcaccacccacaagttgtggccttggataccacactgcagttgggtggtgatggggtggtgccttctgactttttccttatctttaccgactgtgttaattgataattttaaataaacgccttaattaaattgaggtggagggtgttgcagcaccgcagcgaatcctgcatttcttggggggcttccacatgagacgctggacgggggccaggctcagggctcaggctgtagccacctgctggcacctgtcttcctacagaggaagttaattccacttgggtggaccaagagctaaggacttgttttggccactttttttctcagaaggatgagatttcctgatttatgaaatctggtaaaaaatgctacttagcctgctttgcagttgtcatgaaactatagaatattttgaaaattttttaaagccagaaatttagtctattttattggtgtgcggttctttaccgtgcttggttatgtcagtcactgaaacaccagctggattctttagtgtttcccaccgtgcatcgttttgtaactgagtgaaaggtgctgttgatgtgtttacctacttaccgcacagagttggaaagagtccgcacatgctgcctctgcctgagatacatctgtagcgaaaatgcgtccagagtgtggagccctctccgttggcgcagaggtttcagtggtccctgcgaggccttttggggtgtctgccctccctgacctgcgaccaggcatgtcacacggcatccctgccttcaagcactggggtcccctttagagagggtgtgtgagcacccaggtggacccagtgtgagtttttgaagtcatatctggctgtgctgcgagactacttttatcctctccactgtgcttgtccgtaccatgccctgacctcgtgcgggcatgcactcagaatgccagatgtgggcatgtgctcagcgcgcaagccatgttcattacatctcctcatggtgaggagctggacccagggcctcggttagagcacgcttctggtgttgtgtggtttcctgtgtggtttcctcagatggttctcaaacacgctttgatacataatggatggtgttttcggggccctctttcattcccccgtgatttcactggcactgtctgtgagcagcatgtagtgtgaggctgggggtggggggcgtgtggaaaggtggtccggctctgcaggaccctgaatgctccatccagtgtgggcacctgagacgcagcatttgtcaggaactgcataggcacaggggctgggggctcaccttgcactcaggggttgtgatctgagttgggggttggcgctgggaggagagtaggattctgcagctggtgaggccttccctgc

SEQ ID NO: 74495 - DNA, 1050 bp, Homo sapiens
tgggctgctgtcacaagaatgccatgaccatgaactgggcagcttgtaaacaacaggaatccaccgctcacagctcgggagcctgggagtccaccatcaaggccctggtaggtttggtgtccagtgagaaccacttcttggctggtaaatagcgtcttcttgccgtgccctctcctggtggaagggccagggagcccctttatcagggcacatactccatccaggaggctgtgccttcatggcccagtcacttccaaataccgtcccaagcaggattaggaggaccacatgtgaagacgccgcacagccttcctggaggctgtgtgccccagccctgccatcagctgcctgctcccgctcacgtctccccagttcacctgcctccagtgctggtttatagaacatttgtgtgacttcttcagatgatctgtaaacagaggcagtctaggtggtgttttgttttctaatttcctttatggaaaggagagtttgcatttcccttgtgattttgacacacattgtattatgaaatattttcagtgtttgtcaaactcggtgtggggtaagcgcatcccaccaagataggcgcttacaggcagccaaggaacccaccgtgtggtttccttttaggttggatttcctgtcttacagcctcatgttcctagttggaaattaaggttgagactgtagccaggtgtgcatttattcatccgccagctctggagaggtctgctttagaggccctgcggccccagaagtcatgcctctgagtccgtggttcttagctgagggtggctttgcagtgtccggagatgattctggttgtcccacccagggtgaatgaaggctgaagatgccgccaaacaccctgcagggaggctggcccctgacagagccgtgcaggcggcagcggcagcactgttgctgcggctgagacagcgcagggcgtcattcatccccctgcctcctgagcccagagcttctccaggagaaagctgaggaaaggggccagccgtgagctgcgggtgcttgccagggatctggtgacac

SEQ ID NO: 74496 - DNA, 1049 bp, Homo sapiens
cacatgtgcccccgctgtgtggctgtgccgtcacgtgtgtacccctgctttgtggctgtgccgtcacacgtgtgtccttgctgtgtggctgtactcttacctgtgccacacttaaatagaatgtgtttaacattctattgtgaacattttcctcatcattacaatcttgatttttcaagactgtgtggattctgtaagtcatggctaattcctggtggacggtgctgttttggccctgtaggtgccatggtgatagtgacattccttctccggacctggcgttctcctggttgttcctggagttgcttgcttaactgtggtccttctgcctttttatgacgttatttgatagaacccttgagggtggttttaaacacccctagtttcgtagcccttttagctgtcatatttattattgttttgttgctttccgcaggccggtctaattgaagccaacggagaactcaaggtcttcatagaccagaaccttagtcccgggaaaggtaagggcacctgttctggacacactcttgtgttgatgaatgcatgaagcttcacatgtttatgaagctgttgacgctgaagcctcttgctaatgatggcatctcctgcatgggcacctttgtgctccgggaacccaggagggtgggcgtaggagccttctagcatttagaacacagcctgcacacacaccagtagctttgtggattttgaattctaaggtatgtatactatttgcaaaagtttagaaaaggtagaatattgtaaagaagaaataaagatagtttgttttctctccacccaaagataatgacgtttcagctgtggtgtgggctcttccagaggccggcctcacctgtgctgtttgaggaaagatgggcctaccatggtgcatgccttctgcgaagcaggcacttgccacctttaacgcttcgcgtgtgtattttactagctcttgaggaagagccgtttttcttgtcttggggaatccaggggaggaagtcagctggagaggttgaagccacctcttccagggtcccacggttggt

SEQ ID NO: 74497 - DNA, 1048 bp, Homo sapiens
atcactaaaaggaagtaaaagggtgaagggaaaaatggaagcgtgctcaagtgccctgtgtggaattctgtgccgcccccttcattaaacttgaccgttagcgccttgtgtgcggtttgggggtcacgctctgccctgtcctgttcttgcttgcttgggtcgtccgaagtttcttgttgcttttgtctaattggagaagatgcctgtgactgacaagaggaagatgagccacattcagaaccggtggggtgatgccgtcaccgtgacaaaagcgtccaccgctggacgtttttcctgctccgtcatggctgctcactgtggttaaggaaattcagcagtggctgcggatagcgaacagatggtgggcatggcaccctcgccgtgtgggaggggactgactgtctgaattgtctttttcgactgtaggtaattggtacgcctcagagaccggcagcgtcaaacaccctggtggtaggaagcccacacacccccagcactcactttgcctctcagaaccagccttccgactcctcaccttggtctgccgggtgagcacttccctctggacccttagagttgtaggactgcttgcggttcgcacctccacgttctcctgggccacgtgtgtcacacagtcgtgcgatggggctcccacgcgcgttgacgccagcctccgaatcacactcacccatcatcgtggcctgcacaggtgtgcagccgaggcgcactgcctcggtcatggagaagtcgggctgggcaccgcccaccccgctttgtgtctggtgtagtgggtgctctctgaagggctggcagctcttggccaagacggggagaagctggcctcgtactcgccacaggacctcggagactttccctcgtctgtgctgggagcatgtgggatggatttcacccactgcccctgaattcagcctctactgcccctggggttacggcccccgcgggtggtcccgccagagctgctccttccactaaagcaagatctgatgagctgtgtctttccttaaaaacacacacacgcaaagctgca

SEQ ID NO: 74498 - DNA, 1971 bp, Homo sapiens
ttgaccacaagccctgaggcggggggaggctgggtgggccgcctgcactgacggcgccatccgcctcctgccttgcagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaaacaagctgtgtttctctaattcaggattattatctagaaatttgtctgtcttgttggttttactttatacttgagtgagaaagtaggttgttaggcccagacgcggtgggcccgggtggtccctgtgggtgcaaaccccaccaccacatgttgtctgaggcacatcctccgggagcccaccctgaaaaggtggaaggtggccaagggtggaggtcttggtggacacagggcaaagaggcaccttccttttcggtgcctgtggtgcagagaaagataagccaagttccttggccttttttcacaatgaaaattgagacaaaatttaaaagtttgactttgagaacaagaataagattgagaggattctgggaagatggtggaatagggagcaccaggaatctggctgcccaggtagatgtctacctcgcgggcaggatctgcctgatgcagctgttctgtaactacggaatctactgaaggcttaaagctttcaagggaggcttggtcagcacattgcagttaattttggtccatttcagcttt

SEQ ID NO: 74499 - DNA, 1033 bp, Homo sapiens
gccgaggatgcgccaccaccccagctccagcaggaaccgagggccctctgaggggggagttatggttcccccatcacaggaagggaaactgaggcagagaggtggggtcctgcccatggtgacccatagtgcagcctggaagtgcatggccggtcctgcttccacaaagacatcaggaagagaaagggaggaagggaagccctggagatggctcttctcagaagcaagggtgtccataggcaccggcaactcagggtgcagcttcatctcatctgcttctgagaccctcctgtgagcttcccctgcagcgtcagaacctaacggaagccaccgtccccgtggccatgggcggctcctggacacaggcgactgcctgtgtgctgtcttcgtctctgtaaattagcttgtgtggatcgcaggaggcatttgcagggagacaccggcaggaagaggacggttttgtgtttgctacggcttttgtctttctggaaagtctgtaatgaactgggcctcctgctcctcctctccgctgatgtggcatggattctgcttagtgagccgttctccagtgacccaaaacacaaccaaagggcaggaccaagtcagagaagcaagggagtgcagggccaagaggccagagccctgagctgtgatgagaggctgtggcctgtggactgcctgccctcttctgtgagctgggacagcacagatctctgagccaggtcccttcagcaccagctgggctcagggctgggtcttgctcacctggcatccactttgagtccctcctttccccgccgggcgtccctggtgacggcgttcttgtgtggccacagcagcttggcttcagcctccggttttgagtttccagcttcagcagtgtggggcccgcagtggtggagggtttctgtcctgtcactggatcacgcctggtgcctccctggtgctggccctgcaggtcctgcctcagtgtccccaggtcactcctgatgtggcttctatttgacttggccgcctgtcccccggggaccta

SEQ ID NO: 74500 - DNA, 1306 bp, Homo sapiens
aaggacaatttaaagagatcaccttccttgcacccagcagctttgccaggcatgaagtgcaggggaggacgtggcatcacagcagaagatgagttcctgccccgttactaagaaacatgccctcccttcccctgtgagattactcgtgggcagggcttgtccctaggggggccctgtcattcagtggttaaccccgtggtcccagggtttactctgtggttcctgggggtttattccatggttcctggcggtttactccatgttcctgggggtttactttgtggtcctggggggtttactccatggttcctggggtgtttactccgtggttcctgggagtttactccatggttccaggggtatttattccgtggttcctgggtggttactctgtgattcctgagggtttaactctgtggttactgggggtttacttcgtggctcctaggggtttgttctgtggttcctgggggtttactccgtggttctttggggtttaactctgtggtttctggcggtgtaactctgtggttcctggggggggggttactccatgtttcctgggggtttactccgtggttcctgggggtttactccttggttcttggggatttatgctgtggttcctgggggtttgctccatggttcctgggggtttactctgtggttcttggggatttatgctgtggtttctgggggtttacctctgtggttcctggggagattactctggttcctggggctttactccatggttcctcggggtttactctgtggtttttggggggaggttatgctgtgtttcctgggggtttactctgtggttcctgggggtttactccatggttcccgggggcttaactctgtggttcctggggggaggggttactctgtggttcctgggagtttactctgtggttcctggatgtttactccatggtcctgggggtttactccatggttcttggggatttatgctgtggttcctgggggtttactctgtggttcctgggggtttaactctggttcctgggggtttactctgtggttcctgggggtttactccatggttcccgggggtttaactctgtggttcctggggggaggggttactctgtggttcctgggagtttactctgtggttcctggatgtttactccatggttcttggggatttatgctgtggttcctgggggtttactctgtggttcctgggggtttaactctggttcctgggggtttactctgtggttcctgggggtttactccatggttcccgggggtttaactctgtggttcctggggg

SEQ ID NO: 74501 - DNA, 1020 bp, Homo sapiens
gtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctcc

SEQ ID NO: 74502 - DNA, 1051 bp, Homo sapiens
aaaattccacatgtcaccgtgggccttccttttccaccctccatcgtccagcaggtgtcgggccccaggctggaggccacgtgccaggctggcaggatttgtccactgtgaagctcgacgcccccgcaggccctgtgctgcccgcccggatccccctgcctcaggatgccctccacaccctccgaattcccagccgctgctctggggcctgcacagagggcttgggcccagcacctggaaactccaaagaggcaaacgggttcatgtccaggtaaacctcaagatgtggctctgaggagtttccttttatgggttttactgctttttaaaaacactccttattttcgaaatagaatgtgacgccccaccctcaccctgtccaggaggcccagccagtgcctcttctgtgcccctagacacctctgagaactccaggcaccagcattaatatcctggagccctggagccccggagcccctgagtgtgccagatcctgagtgtgccgggcctgagtgtgtgccaggccccaagtgtgccgtgcactgtgtgtgttgtgcccccagtgtgccaggcactgagtgtgccagaccccgagtgtgctgtgccctgtgtgtgtcatgccctaagtgtgctgtgccctgagtgtgccagaccctgagtgtgctggaccctgtgtgtgctggaccctgtgtgtgccaggccctgagtgtgccatgccctgagtgtgctgggcctgtgtgtgccagaccgtgtgtgtgccaggccctgagtgtgctgggccccatgtgtgctgggcctgtgtgtgccagaccgtgtgtgtgccaggccctgagtgtgctgggccccatgtgtgctgggcctgtgtgtgccagaccgtgtgtgtgccaggccccatgtgtgctgggccctgagtatgtcaggccctacaggcagcgcctgcagatggagctcacagagaggctagagggggaaatctgcttaaagtcttgtctgctctcttcatccttcagtggatgtggaatttaatctggcagatacttacatggctgct

SEQ ID NO: 74503 - DNA, 1045 bp, Homo sapiens
tctcctcctccacccttcttctccctccttcccttccttccttcttaacccctccttccttccaccatgcgggtctggtctgggaagggcagtggtgaggctccaggagagtgacaggtccctgtggcccggacttggaccgagttgctcaggggactgagcctgcaacacctcctgagtgctgtgacttcacctctgacatcatcatatcagatccctctcgacacccttctggggagacagccccatttgccttccaaatatgttgcctcgttgatatcagcaggtccatcaacctcatggccaaaagccagcaggttgaaaatgcgcgaagcatgatgctgtttgttgtagtagaaggcgcacacgaggcacacatggtacaagatgcacacacatggcaggaggtgcacacacatgggtggaggtgcacacacatggcaggaggtgcacacacggaggaggtgaacacgtgggaggaggtggtgcacacgtgggaggaggcacacacacggaggaggcgcacacacatggcaggaggtgcacacatgtgggagaaggcacagacggaggaggtgcacatacatggcagaaggtgcacacgtgggaggaggtgcgcacatgtgggagaaggcacacatggaggaggcgcacacagcaggaggtgcacacacatgggaggaggtggtgcacacacgtgggaggaggtgcacacacgtgggaggaggtgtgcacacacgtggcaggaggtacacacagaggaggtgcacacatgcgagaggggtgcacacacgtgggaggtggtgcacacacatgggaggaggtgcacacaggaggcacacagaggtgcacacacaggtgcacacgtgggaggtgtacacacggaggggtgcacacacatgggaggaggtacacgtggaaggaggtgcacacacgtgggaggagatgcacacatggaggtggtaggcacgtaggaggaggtgcacacacatggaggtagtggacacacatggcaggaggtgcacacacatggtatgagggaggt

SEQ ID NO: 74504 - DNA, 1050 bp, Homo sapiens
gccaggctggtctcgaactcctgacctcaagtgatctacctgcctcggcctcccgaagtgctgggattacaggcgtgagccaccaagcccggcccccagcacttctgagttgaaccttcaaaccctgtgaaggctgagatgagccccaggcagggccaggagactcagcaccccgagactcagcgccccagagccatgaccccacctgatgctttcgactttgagatgcaccctgcacgctgggccgagagagtgggtcaccgcggtgccgtcggatgttgcctgcgggatggtctcagcagctcctgagactgtgggacgcccaccccctccagtcccatctgcgtcgctacccctgtttctccgtagctcatgcacaagccacagcagctctgaggtgactcctgcatttcgtcccctcgatctgggacagtcacagcatttctgtgatgctgacatagacctttcttgctcccgcctccccaggacccccagacgtccaggacgctgacattgatctccaagaccgttcagaccctcggcagcctgtccaagtccaaatctgtgagtccctcttcttcattttctctttttagggacaactgattcttttctctcttcagaaaatacacgtgaaaaacctcccacatttgagagagtcgtaagataaagatcaagaatcaaagccggcaccacatcctctcttgaaacccaggacctgagcgtccccgtcccgctcacctctcccctcctaaagtgaaccccttgcctttttcgggagcctgtggctcgtcgccggccccgtggcaggagcagcatctgacctgtcaggtgtgggaagcggctgaacaggccaggcagatggcctaacctggcgcctcctgggcgttgcggtgctggaggctcctcgtcacgcagccccctactcccctcgcggccccctcctccccacgcggccccctcctccccacctccccacgcggccccctcctcctcacatggccccctcctccccatgctgcactacctccccatgcagccccctcctcc

SEQ ID NO: 74505 - DNA, 1044 bp, Homo sapiens
gccaggcctgagaccccttccaccctccctgcctgtgcccccagaacccactcacagagccctgtcttaaacctctccccagatatgccagagccacaaaccctgtgaaatcgaccctgtgaagttgaaagacggagaaaaccttgaaaacaacatggtaggttttgttcatgaaccaaccaaagccagtcacctgcttggggtttttcagccgatggctgcctggaagctctgactcaccccgtgaccccggttggggtgggagcaggaccaggcgtggggatacccgcctcacccggctgcagtacgctggctgcactactgggaggcctcagccaccacctttggcctggcctgtgtgccgggctctgcgtcccctggggggtcccggccagctcttcctcccctggagtgatccggtctgcatgccccagctctgcccccccggagggtctgccctgcacaccctgctctgcctcccctggacaatcctgaccagctctgcctccgccccggctcctccttcccttgggcaatggctcctgcccctcccttttcctaggacaggatggcctccctgcctccccaggctgtccccagagctgtgtactgcgttttaaaacagcaaaactccctgatgttgaacttgctccaacattttagtcacttcacatgatacttcttgcagagcgtgctgtttcgtcatttctgtatgtaaatgacagagctctttgccttgggcaggcacattctagtgaacgtccattccccactcagtaaacgaggtcggggccgagccggggagccgacgtggtgcctgtgtagtgattttcacgcgtgaattgccacagctcccagcacagatttccagggagtggctgttcacacgtgtctcactgccgcagctgccctgcgcccgccctcagcccctccccacgcgcccctccctgggcgtgccctggtgctacacgcacctgtgggcagcctcgggagtgggtcccagtgccgtgtcccgttgcaggagaacctacggcagtatgtgga

SEQ ID NO: 74506 - DNA, 1029 bp, Homo sapiens
agatccacagagacagaaagtggggtgagggccactgggagacagcaggagggggatgggagtgagtgttgaatggggaccgagtctccgtttgggaagacgagagtgttccagagaggacggtggtgatggttgcacaactcggtgaacgtggttaatgccacagaactgtgcacgcgagcaggtcagagatggaaaattgtatgttaaaaattaaaataaagggactaatgcaggtaaacaagacacagcaatcctgagtcccaggctggcaggtccctgcttgcgggacttgcattagagggtggcgtgcatgtccctcgcctttcggcagtacacatggggtgcacatccacattttgacttgtggtggcaaaaaaaccaaggctttatagagagctagtgaatgcacacaagcaaaggctggaaacgtgtctgcgatgtagcagggaacaaacatttctacgctgctgatgatgtatgtcgcttttactttttaggtgaagccaaaaaccttccctcttacccggggccgagcaagatgagggattgctactgcacggtgaacctggaccaggaggaggttttcaggaccaaaattgtggaaaagtcactctggtaatgtcttctgttgctttacttggcactgatgtgttttctttggtgtagagaatgtcccaagggtgtacgtcaccttcccattttcccatgtgtggagaacgtcccgagcgtgtacgtcaccatcccgttttcccgcatgtagggaatttttctgtgcgtagacaatgtcccgagcgtgtacgtcaccgtcccgttttcctgcgtgtagggaatttttctgtgtgtagacagtgtcccaagcatgtacatcaccgtcccattttcccatgtgtagggaatttttctgtgcgtagacaatgtcccgagcgtgtacgtcaccgtcccattttcccgcgtgtagggaatttttctgtgtgtagacagtgtcccaagcatgtacatcaccgtcccattttcccatgtgtaggg

SEQ ID NO: 74507 - DNA, 1017 bp, Homo sapiens
ggcaaagttcgtccgcgagtcaatcgctcagcctcgctcagcgggcccgggccgcgccggcgaccttccttcgtctcttccgccaggcagcccgctggggtcccttccgctcagcggccaatccgcggggcgggggcgggggccgaggcctcgggggaagccgatccctgcgccccccgggtctccgccacccgccagcgccgtccctgccaaccccgcccctgcagggcccgggccagttgggagcaggggccgggccgcgggcggagcctcccggtccccgccctcgccctcggccaactggcggtcttgcaggcgggcggaccctcggccgcgctcggggctccggcgccgccgctcctcctgctcggcctgagctgcccgggctcggcgcgcgcttggggcgaggctcggcgggcgcggacgcgcagcatggcggtggaggacgaggggctccgggtcttccagagcgtgaagatcaagatcggtgagtgtccgccggcagccacgcgtccgaccccccggcccgaccctgtcctctcccgcgcccgcctcccctccgcagatccttgctggggaccccggcggagacgccctccaggcgcggcgcgctccccggagaacggctggtccggctccgcggcccctccccacctccccgcctccccgggcctcgggctgggtcgagtcggctccggggtaacgcggctccctgcgcctcctctgcgcccggagcggccccggtccctggtagcggcggaggaggtggggtccctgcgccgagggacgtctgtccgcgtgtgcgcccgagcgtgtgccccgcgtgtttgcaggagtgcgcgcgcctgaggctgtctgggcgcctgcacttcaggtgtcaaatccactgacgtcggggtctcggcatctccctttctccgctgcgcccagaaacttcctttccggggaatgtggaggctccttcacgcttctccccaggggcgtgaggccccggcgcgctgctgctgctgtgcgcgc

SEQ ID NO: 74508 - DNA, 1079 bp, Homo sapiens
tgtacggtgccttgtgctgtccgaatctagggattgtgataggaagaggccatctttttgagaagtgattgagatagtataaaccaggatttcagtatctcatgcagtgattctcaaccgtgttgctctttacatccttgggaagacagagaaacatccatgtccagttcccaactccagagcagatgctttaaagctcccaggtgatcctaatgtaccacaggcactgagaatcagtccaagtatgttggcagtggtgtgaggtgcgtcaacaagggaaacagaaaatagagtggttggattaatgggattctaacatattttagcctagtgcagtggttctcaaccaaccagagtgattttgccgccccctgccccgggaacagttggcaatgtctggagatgttgtttgtcacagcttaggggcagggagggaggttgagaggttgctgctggtatctagtggttagtggccagaggtcctgcttagcacctgcagtacacaggctcccctgttcccagcagagcaagatccacgcagtcaggagtgcggaggctggtggttcttaggtgacaagagccacctggggacctgcctcagccctgaaagagtagcctccacccaccagatgattcccgtcttcaggcctggagccactgtgtcagcttctgttgcacattttgatcttatgttctcttttgagtttgatttacttagaccaagaactgtagaatcatatttttagttgttggctttttcccctctataaatattatgaggatattcttttttttctcaccatttttaagaaaaagaacttcttgaatcactaccccttagcaagctgtgtaatgaagaacaggaattgctgcgttttctatttgagaacaaattgaaaaaagtaagtaaaaccaaagagttagcacttgctttatgtaaatatcttattccataaaatttggcatctagtcttatattaagttttcaaaattaaaactttttaaatttagcacatttttaagaatagagcgtttaagatacataagattccaaaaaaaaaaagctttcaaaaatacct

SEQ ID NO: 74509 - DNA, 1074 bp, Homo sapiens
attttttatctagaaggaaagacaagtatgaaatcattgctgtaagagcagaattatatgattgtgaagagttgtaatgaaatcatgtcttaaattacatgtgatacgaacaattgttctttttctgctttttcctgaacagaacttttctatctttctcataaactggtggatttatatcctagtaatcctgtaagtaatataacttttagtcttagtttttttttttttacctgtactttaagaaaatgcttaactcgtatttagacaatagcttaagttcaagcaaatgatgttttattaaagtgttgcaacagaatctcctagtgtttattgtacttacaaaagcagcattaacttttcaacccatgaaggtattttttaattataccaaagcaaaaaggtttttaaacccttttttctgattatagaagttatacatgcttattttaaaatacttagcgtatagcaatataaaatactgaccatgacagtcacgcctccctttcctaagaaatgtggataattgtttggcagctttctcacattgcacatgtaagacaacctgttgaattgtgtactgattccaaactgtcatggatcggaatggagaactaggaatggaaaatggaatcagggactgcgtctttaaggacaaaatcaggaatcagggtgtaagactcagacgacaagaatttgcaccctatcccagtgtgaaaccagagcaagagaaaaccagctaaatagtcagaactcggacagagagcaaggaagagccagggtcaggctgggggagatgagcagtgcaggggagtcaggactcacaggctggtttttgaaacagggactcctcaggggccttgtcttgtgtagacgtctccttgagaaagagccatggagtgtctgccctcttctcttggaccttagtagactgtattagagaaatgtctaacttaactagaatatgtgataaggaacatgtagtataccctctgtctaccctaatttgttgcagattccaattagatattccaattccaatctttgtttatggtaaattttgaactttttagg

SEQ ID NO: 74510 - DNA, 1095 bp, Homo sapiens
aaattaagagaaaaaagtaaatgctgtgttttggctacctttaaattattttgcagataggatttgaagttgacagattaatttctgctaaatcacagtttttggtgttgaatatgtgaaattttccaattttttaggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagagtaagtactggaagaccagaaacccttctgttaactagtgattgtaaatacagtaggtgatcactagagttcactgacaaaagcgactcttcagtagatttgtacttttaaatgttctattttaggagaaggagatagaaaaaaaagagagaaactgttatcttggatttccttaaaaattctaaacccaggttttggtctttttttgatctgagctaccacttcttttcttacatgattggacagttcagattacacataccccacagtgtggctgggggcactgtggaatccttagttatctctgtgttgataaggagttgaatttacgtatttgagaagaatttgacatggtttttgaaacaaaagtgttttctatttagttactagtaagtcagaaaatttaattcctggtcagtgtaggctttactgtactctagaatatttgtagaataagtgatttggtgttatactcaaagagaaaaatgtatgtaatcctttgcatttcatgatatacaaattttaaaatggtaaattagtttcagttttttttggtttttgtttttgtttttttgagatggagtctcgctgtgttgcccaggctagagtgcagtggcgcattttcagctcactgcattctctgcctcccaggttcaagcgattctcctgcctcagcctcctgagtagctgggattacagatgcccaccaccacgcccggctaatttttgtatttttagtagagacagggtttcaccatgttggtcaggctggtctcgaactcctgacctggtgatccgcctgcct

SEQ ID NO: 74511 - DNA, 1007 bp, Homo sapiens
caagcggctgttaatgtttgcattgtcagttaactgttttaccacatggtaagaaatgagttttttccctaagagggcaagtgttggcgtttgcttcttaaatgggctctagctttgaaacgtgagaggcatcagaatagattgggtgattatttgaagctaggaatagtcattgggtcacggaaacaattgggcactgtagcgtcagatgtaatattcctctagaacttcagagagcttctttgactgaagggtaaataaagtatagcagcaggtcccacttctgaaaggatagggatgggataggtattactgaaattcacaccttttgttgctgttactgcatactgagtgtgtatttgggcctttccattttaaaatatttgactgcttctgttgtatgaacgatcccgtgaattggtgcttatgagttaacctaacaattatcaaggatgtgtatatactgatattacttaaaagtagtaacagttttagataccataaacttgcatagtaagagatttgcatgatgctcttctgtttcattcgtgcctgttttgtttcattctattctgattttcacttctcagcttcctgctgttactgtttgtgcacacctgcccacagttttcttctcccttggctgttagctctctctgctgttacagacacagctttgcctccctgccaagcgatctgcctgtccccatagacacagctttgtttactttggtctctcatgtcatctgaacttataaacactatttctgtgtttgcacatgcgtgtatataaagcaggtgcctctgtcgcatagtcttgggtagttctggataatccaagtgttttgttaataggggattgccacttgccaccttgtcagttttctaagaagtgactgccttatgccccagacgggctcagcagcatcagcatcacctagaagcctgctagaagtgcagaatctcagaccaactgaatcaaaatctgcagttttagcgtgatgccc

SEQ ID NO: 74512 - DNA, 1042 bp, Homo sapiens
gtgagccaccgcgcctggccacacagtgcagttcttacctgtaacagctgaggagaaagttgtccacaggcctcatacgtatttaggaggccttggaaatgggcaactgttgaaacactggagctgcaactgcatgtgcttctgaaagtcttctgacacttcctttgcaaatggtggaaaacaaatgaaaaagaagattggaatgttgttttccttctgctctcaacttgtgctcttaaaagtataatttgacttaaatgatagagatggtgtataatgatggaaatgataaatgatggagttttgtattttattctaaatagtataatctgacttaaatgataagagatggtgttatataacaatagaaatgataagtgatggaatttcttattttattctaattatagtatttctttttaggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaatttttgatttacagaaaaatggcagagatagtacagagagcttatgtgtgcccctcacctagtttcccccattggtaac

SEQ ID NO: 74513 - DNA, 1028 bp, Homo sapiens
agcctcccaaagtgctgggattacaggcgtgagccacagcatccggtctatttgtgcattttaattaaaaagttctcagactaaaataagtttataaattttgattatgttactgtaattatgtgcagatattaaaaattgaaattatttaattttattatttaatccaaaaaaattccagaaattctgtgtaatagtgacagcctatttatgtattatcatcagagaatgaaggttttcatgagtgagtttgttgcatgagagaacttgatctttttaggttctaaagctaaactattttacctgataggaattttccaaaatgtacactgacttctatcttcctaaacagcatccttcatgactgtaccatttatgataatgtcaccaggaagtcactgctgttaaacagctttgcctgcggagacagcagtcttcaactctactctcaatagttcccttatcagtacttctagggttctgctttcatctttttccttctcttctcctgtcaggctgtctgctgttgtgttcctggctgtcaagtttgtatacctttcacagcaagttgttttctgccctcccctccccagccaccctcttccgactccacgtgttttgacactgatgagtgttttctttttctccaatgaggggtaaggactagaaagattgttaaaaaaataagcattagccaagctagttcctgtgactagaagcaaatgtgatgcttgaactgacctttgtgttcattgctcatttattcagtaacttactgagtttccctttttcacttaaaaaatattggtgggccgggcacagtggctcacacctgtaatcccagcactttaggaggccaaggcgggtggatcacgaggtcaggagttcgagaccggcctgagcaacaacgtgaaaccctgtctctactaaaaatacaaaaattagccaggcatggtggcaggcgcctgtagtcccagctactcggaagactgagacaggagaattgcttgaacctgggaggcggaggt

SEQ ID NO: 74514 - DNA, 1563 bp, Homo sapiens
gttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatggtgagccctttccaagtgctacgttatgaagctgccaaattaagaacactgagcaaatgtaattctcccgtagttgggaaagattatatttattttcttcctactttttaatgtctagatccagaatataagaagtttttagaaacctactgtgtggaggaagagaagaccagtgccaaccctgagactctgctgggggagatggaggcgaagacaagagagctcattggtctgttttgctcatttcttctcttttctttattgagagatttactcgtagaggatatacgttttttctctttttcttgactgtgataacaagttgaaacttgttacaggcttgacagaaatgtagagtgatttccagttttgacaaaagaatggcaagatggcagcat

SEQ ID NO: 74515 - DNA, 1050 bp, Homo sapiens
agatactattactatgatttattcctctttgtagtggtttttatcaacgcctgctgtgtgcccatcgcagtgcagcctcagcagtgcagcgctgagcacttcgcatgggtccctgttgtctgggaacctgtggtctagaaaggagggtgggcagccaaccggcggtttactgcagttgctgatcatttgtgttgaatcataggtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggtttttattaaacccaaaaagaaaaatgtgtctggctgtcttaaggtccaggctgcatgctgaccatgtcacccccacttggccttgtgtcttggggaacgcagtgctttgagcattttcaagagcagtttttcctgaaagtcagatcccagagtgagactagtcatcatcttttctcagataatcaaattatttttcaccaggaaaaagaaagattttatttagtataaaactagcacgtttatatgattcacttgagaataagattattaaatttacccttgagacaggaaggaaagttttaatgatatttcatggaggtttcttccacattattaacaacattctgattattggtgaatattcccatggctcacaaacacctgtaagttagatctgcacggacggtgagcacaggactgtggttacccccttagccaagcaaacaacttttttttttcaggagctaatttttgttcaggttgcattttcccagcgcagcactacagatggcatcacctttctgacagcaccaggccccaccctggcctcc

SEQ ID NO: 74516 - DNA, 1033 bp, Homo sapiens
taggttttggcgattctggagacaaaactgaaccaagtttctgtgtttccattgaaagggcaggtatggattttggttctgctgaattgcagggtattttctggtgttcaggaagaggagggcttttcacaggatctgtttctttgttcaactgattttttggtttatcattccatttgtctggggatgcatgtttggatgtgatgtgatagtatacattagagtacatcttgctggtgaagaagcatttatggcagtgaaataactttgcacttttctggtaaaatatcattttgcctagcccaccagcatccatttcatcacaaaattctggatggatggtacccatatggatttgtacattttcatagtctgtgcctctgaaactgcaatggtcacactccaaacgtgctgatggtttacgaagttcctggaatgcttccattcttctgtctgttaccaacacacacggttatattctttaaaaactttcaatactgctgcaataaagtaggaataaattattttcatgaactgtaattctgaataaaatgctgtcagtccattctataactgcataattttaagtctagaacagtgcgtgctttatttgatagtatctctagggagaatttgaagaaaaaggagatatagaacagtcccaggcactctgctaggagtttcacatacatcatctcatttaatcctaatgatatgactcaactattattttcacttacagatgaagaaacaggttcagagaagttacctgactttctctggtccaggctataggactatcagtgatgtgagcctgactctagaattagctattgcatgtgctttatactttgactctcaaactccgagtacaaaagtcctcagcacacaaagatgagtgaatatcaaaattaaatcttggctatttaaggatgaacaagagactaaaacttttgcagaaagcacttaataaattaaatctagctataaaaagatgactttaaaacatgatgctggcttgatttcatgtcaa

SEQ ID NO: 74517 - DNA, 1138 bp, Homo sapiens
ccttaaatagccaagatttaattttgatattcactcatctttgtgtgctgaggacttttgtactcggagtttgagagtcaaagtataaagcacatgcaatagctaattctagagtcaggctcacatcactgatagtcctatagcctggaccagagaaagtcaggtaacttctctgaacctgtttcttcatctgtaagtgaaaataatagttgagtcatatcattaggattaaatgagatgatgtatgtgaaactcctagcagagtgcctgggactgttctatatctcctttttcttcaaattctccctagagatactatcaaataaagcacgcactgttctagacttaaaattatgcagttatagaatggactgacagcattttattcagaattacagttcatgaaaataatttattcctactttattgcagcagtattgaaagtttttaaagaatataaccgtgtgtgttggtaacagacagaagaatggaagcattccaggaacttcgtaaaccatcagcacgtttggagtgtgaccattgcagtttcagaggcacagactatgaaaatgtacaaatccatatgggtaccatccatccagaattttgtgatgaaatggatgctggtgggctaggcaaaatgatattttaccagaaaagtgcaaagttatttcactgccataaatgcttcttcaccagcaagatgtactctaatgtatactatcacatcacatccaaacatgcatccccagacaaatggaatgataaaccaaaaaatcagttgaacaaagaaacagatcctgtgaaaagccctcctcttcctgaacaccagaaaataccctgcaattcagcagaaccaaaatccatacctgccctttcaatggaaacacagaaacttggttcagttttgtctccagaatcgccaaaacctactcctcttactcccctggagcctcagaaacctggctctgttgtttctcctgagctacagacacctcttccttctcctgagccttcaaaacctgcctctgtttcttctcctgaacctccaaaatcagtccctgtttgtgagtctcagaaacttgcccctgttccttctccagaaccacagaaacctgcccctgtatctcctgagtca

SEQ ID NO: 74518 - DNA, 2362 bp, Homo sapiens
tgtctcctggaccttggaaaccaattccttctgtatctcctggaccttggaaaccaactccatctgtgtcttctgcatcctggaaatcttcatcagtctcacccagctcctggaagtctccccctgcatctcctgagtcatggaagtctggcccaccagaactccgaaagacagctcccacgttgtctcctgaacattggaaggcagttcccccagtgtctccagagcttcgcaaacccggcccaccactatccccagagatccgtagtccagcaggatctccagagctcagaaaaccctcagggtcaccagatctttggaagctttctcctgatcagcggaaaacttctcctgcttcacttgatttccctgagtcccagaaaagttcccgtggtggttctcctgatctctggaagtcttccttttttattgagcctcagaaacctgtcttccctgagacccgaaaaccaggtccttctgggccatctgagtcccccaaagcagcctcagatatctggaagcctgttctctctatcgatactgagcctagaaaacctgccctgtttcccgagcctgccaaaacagcccctcctgcttctccagaagcacgcaaacgtgccctttttccagagccccggaagcatgcccttttccctgaactccccaaatctgctctattctcagaatcacagaaggctgttgagcttggtgatgaactacaaatagatgccatagatgatcaaaaatgtgatattttggttcaggaagaacttctagcttcacctaagaaactcttagaagatactttatttccttcctcaaagaagctcaagaaagacaaccaagagagctcagacgctgagcttagtagtagtgagtacataaaaacagatttggatgcgatggatattaagggccaggaatcaagcagtgatcaagagcaggttgatgtggaatccattgattttagcaaagagaacaaaatggacatgactagtccagagcagtctagaaatgtgctacagtttactgaagaaaaagaagcttttatctctgaagaggagattgcaaaatacatgaagcgtggaaaaggaaagtattattgcaaaatttgttgctgtcgtgctatgaaaaaaggtgctgttttgcatcatttggttaataagcataatgttcatagcccttacaaatgcacaatctgtggaaaggcttttcttttggaatctctccttaaaaatcatgtagcagcccatgggcaaagtttacttaaatgtccacgttgtaattttgaatcaaatttcccaagaggttttaagaaacatttaactcattgtcaaagccggcataatgaagaggcaaataaaaagctaatggaagctcttgaaccgccactggaggagcagcaaatttgataacacagtgtgaatatttgttctacaaaggtgtttgttggaaccattctttgtaagtatagcttatcagatagcatagttggatcagtagatgacatgtatggtgtaccgtgtttcactgtctcagttgtgttactaagaatgagcatttgatcatttttttctggtctctgtctatgtgactatcttgtaagtcaataaatttctgtatagtccagatggattaaacttctcatttcttttaaatatgtatgaataataatacaaggaagtaggcattccatttaataatcaagagcaagttgtactcaaagcattcagttaaagtgtatctgtgtgtggaactaatttcagacaatagaaaatattagttgaaatgtttaagaattaggcatgaaaaataaatttgagaaattttgtttccttacatgtatttttaaatcataagagttattttctatctgatgtaaaattagtttataaatcttaatcagcttctagatgtttattagcttttatgtcatgaaatgttggagtctcagggttgctgattttctgctaatgggaaaaattgactaagtctttaaaatagtttgcagccttctcccacaggagacaagtgaaagataagtgtgattttagatctttcttgtccatagttgttttcagtggagtcttccattctgtatcttaccctaagatctggttcttccctccccatccccaccccccacccaccgcctgccagctcacactaatagatgattcttaattgccaaatgtgttagagtttgtatatcctactcctgggccttacatgtcgcctgttggggcttaagaccaggttgataagtaggaactgaaagtcttccagattcacagtagaaaattttatagacatttctgttaaagaaatatatcgattttatgtttttcaattatgttactgt

SEQ ID NO: 74519 - DNA, 1036 bp, Homo sapiens
tcacatcatagtcaacatcagtaagttcatacttaataaaattattataaatgtaattacttttgaaagaccttggaaaatttaaactcttaaagtaaaaaagagtattctggagacaaatattacaaatataaagagggttgtaatacctttacttgccctatataatgtacagattttatggtagaagaaaactctaatggaattactcaaacttgttcagcatcagagaatttatattgaaggaaaccatacaaatgtaataaatgtggaaaaacattttttcagaaaatacagcttacaaaacaccacacagtttataataaaagatatttttgcagagggaacacatgtgtaaaaatatttagtcaaaattaagtctttgtaaactttagaaaattcacagtaggaagaactaaggcactggcacttaagacgttacactaaatcagaatgttctgtatagaaagtaatccaaagctaaaactgttggataatttatttgtatataagtttaagaggagtggaagattattttttggagttataattacattcaaggtatacgtttttccttgaaaaaaatgtagattttttgaaaagcaaatagtaaggtaattcaactgtaaaattgcttcatgctgttccttttttcctgttgtttgtttaaaagcatgtcatcaatttctgttgcatcagaaatctgagaaattcccttcttattaggtaggcatcattcattaacttttccatggaagagtaaggatattaaaatgtaagatgcatattgaaaatctaattggagaggctctttatgtctgacttttaacattgttcatgtgatacatgagttatgtgtttagagtgatattctgcattatagtgagaggaaaactttgttttagtagtaaattgttttaccaattgtacttttatgcaataaaatgtagggaattttaaaattcttttataagactgtgataacttagcttttaaattaaatgaaatagttttaaactttttaagacctgcattt

SEQ ID NO: 74520 - DNA, 1050 bp, Homo sapiens
ctcctgtaatcctagcactttaggaggctgaagtgggaggatggcttgcattcaggagttcaagaccagcctggaaaatatagcaataccctggctctacaaaaaaatctaaaaattagccgggtgtggtggcacacctgtagtcccagctactcaggaggctgaggtagaaggatgacgagctcaggaagtcgaggctacagcaaactgtgattacaccactgcatgccagcctgggtgacagagtgagacccatctcaaaaaaggaaaaagtagttttttgttactttttttttttttttggttcgcaagttttgttcaagaactcatacaaaatattccagataaatgaaatttaatcctcatctccctcctctttctcgtcctggttaatttggaagtaacataactctgtttgctgttagcagctacgcaaaccaatcacgtagattattcttcttcaaaaatttttggtgtgatatttcaaataccttttggaaaaaggcacctcagatgtcatggtgatcttgctcttgctccttttgatggtcaccacccctccaccaagcttcccagcttttcagttcactttgatcctctcttgcaaaaactgctcaaaattggcagcatccgtgattccatcttccacagggtgggtgcaatcaagagtgaacttcagaacctgcttccttttttgcccccattcaccacaagctttttcccgggtgccatggcagcagtggaggcagaaagagagctgtttctttttaaattgttattaattttataaagtttccgtagctttgggggtacaagttatatttagttacatgaatgaattctgtaacggtgaattctgagattttagtgcacgcaccacccaagtagcattcatcataaccgatatgtagttttttatcccacactctccgcccatcctcccccttctgagtttccagagtccattatatcactctgtatgtctctgtgtcctcatagcttagctctcacttgtaagtaagaacatagggtatttggttttccattcct

SEQ ID NO: 74521 - DNA, 1712 bp, Homo sapiens
ataagtgtttctctgtagtttttttctcaactctggttggaaacctttgaaaagttattttctaattttacatggaaaatatagcatgaatattaatttatatttcttgtataaattgccattttttgtgtcacttgttgatatttctgtgaagacttaaaaaaaattggtttatgagaacttttaaatttactttacttggacttaaaagagcctgcctctcattgccatattttttggatgaagactatttaatatgttttacaacttaaaatacacttaaactgatacagtgagctgataccttttttgttattaggaaaacggctacattctgtttcatgttctatttcctcctcttgatataaaagagaagtaactttaatttgtatttggtggattaaattaggaccttataaacatttggactgagattttctcaggattcccactggctctggccggctgctatgtgtatctagttaattatcaggaaacaccgtgggaaaaggcagattctatgagagttggttgcattcttttgttaggcaatgccaggaacctgccttttttggatcaaagagctgtctcattcttgtagtggcactacatgaccttacatgctccatgttttccttctgaagattgaaaactttgggaaattttcgtcccctgtgttagctcagttttgtctgatgtgagatggaagtagagggggtatacaacaggggaggtggtgcagaaagttgcaagtggtgtatccccatgctggagctttttccatcttggaatctgtagtgaacctttgtctgtctgtcttttctaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttatttttagcaatttttatttttatttttgaactttaggtccttcctcttctttggggctggaacagaattaaatttgtttggaaaaaaaaaaaaacaccacgtagtttggcctgctttattctccctaggcctgtattctttgttttaggatcacttcaatttattggagtaatacccccatttttttctttatacaaagcagtttatttctctcccagttaaaagaattccgacaatagacagccccaggcaggaatggcaactccacaaagttgctagagaccagctttcttccattttcccattctgtcattccctaggggtggtcttcactatggtccaagatgacagagcaatactgttc

SEQ ID NO: 74522 - DNA, 1777 bp, Homo sapiens
acttcactatttaaatttttaaaaatcaaaatgatttcacctatttcattcatttatttattttttttgagatgaagtctcactctgtcacccaggctcgagtgcagtggtgcaatctcggctcactgcaacctccacctcccatgttaaaacaattctacctcagcctcctgagtagctggaattacaggtgcatgccaccatgcctagctaagttttgtatttttagtagagacagtgtttcaccaggttggccagtctggtcttgagctcctgacctcaggtgatctgccagccttggctttccaaagtgctgggattacaggtgtgagccactgtgcccggcccacatatttcatttatataaagatttattctatcttaatactactacatggataaattataataatattttgaagtctcacacatacaaaaacacttatatccctaaggttttgggactaagatatccacactgttatacggtaactgcttctgtggtataaataccattttggcaaggaagaaacttccatttctctagaaagaggaggcgtaggacatgttgggcatgtcagtccttaacattgagacaggatccactgataatcttttcatcccattataggagaaagttgacagaaaagcttctagcaatcctgaccttcatctgaacagggcgacggtaagacctttggggtgtagtcatctgagggtcaaataaataagacacctatgtcttagcttgtgaggataactgagtttgcatagggacaagattgggtacagactgcgagaggaaagccatgctatttctataaatagctagctcggtttggcttcagtatctggtgtagtcactggagggaaaggagaaggggctgtggaggtggaagaataggtagagaatggggggatcttttagaagacttctgaaatgttaagtaaatataaaggtcaagtgagccaatatatacaacttaactattttagagtttggaaattagcttctttgaaatgattccatctttggggttgtgatcatcttggctaggaagaaggatgtaaggtgttaccagctcttcaggctgtttgttgcagcacaggaaaataaccaggaaggaaaacagtttatttctctagattcctagcccatggtgccattccctcgggatagtttgtctggatatacttataattgggatacacttcttgtacagttgcataaatatgaagagagttatggggaggccctggagggcttctctcgggctgcagccctggaccctgcctggccagagccccggcaacgagagcaacaacttctggaattcctggatagattaaccagcctccttgagagtaaggtaaaaatgtctgaagggctgaattccactttttttttttttattttgtcgtgggtcaataaaataagaataaataggtttacgaggtagagaccctatagaagtgggtgggagggaaggattagaatctcaaggaaggcgactagtttccagcttcttacctatttccccttctttgcagggaaaggtgaagaccaaaaagctgcagagcatgctgggaagcttgcgcccagcccatctaggcccttgcagtgatgggcactatcagtcagcctctgggcagaaagtgaccctggagctcaagccactgagtacgcttcagcctggggtgaacagcggtgccgtcatcctgggaaaggtggtatttagcctcaccacagaggagaaagtccccttgtgagtttctc

SEQ ID NO: 74523 - DNA, 1419 bp, Homo sapiens
acaaagtctccttgcaaaacctgtcaatggtgcttcgtcagctgcggactgacactgaagatgaacattctcaccatgtcatggacagtgtccgacaggctaagttggctgttcagatggatgtccatgatggccgctcctggtgtgagtgctctcaaaagatctccaacaggtttctagagcagatgttttcaatcagagcaacatttgcagtccctcttttgagtgtgattctgaggtttaagccagagagggcatctttgttttgaagacacacgaaagacattttggggaactacttttctaggaactcttcgatcttttgatcctagttttcacgtaagcaaggaagggcttttgtacagtctgttcaaacttcagtttggtgtccttggtgctctatcctagtggagttttgggtatactaagtatcgtgtcattcctggtttggatttcttgtgggacctttcaaatatactttcaagaatgatcaaaataagtcatatcttgaacttggactctgagatgatttgtcactgtgtttctctttcagatattcttgggaattcatatctttccctttacttctctactggccagaaccctaagatctcccagcaagccctcagtgcctatgcccaagcagtaagtacttatggtcaccaggccagatgaataggcaacaacagaagcaagagcattgttcagtcttctttgtggccctttagcaagcatcatgggcagtggcagtgtttgctggcatctcatttttgtgattttgcaaagatgtgtctgcagagatgactgacttcttataacttgagtgttaggaaccacttgcatcgtgtcgcattggtgctggatagctccttgacctgtctgggtttcttacacacatatataaccaaatcacagagctgcctcaacatgttcatcttttttaatgggaaaaaagtctattaaaataatacttattaatatttttgtacattcattttaaagaataatgaaaacttatacttcagtgtaaattaagtgctatccccaaattaaccgttaggtaatattatggctctggatttcccatgggctaaaagagaaaacaatgtgtagcttgttctgtgtcatttcctaggaattaagtgaattaggttatttaggttttcaagaaatttatttaggttttcaagcatttttatgttgataggcatttgcatagggctttccctcagactttgagtgccttttttctcattattagaattggcttctgacttcacattggtcctctgagcactttttatttagctctcatatttacctttcttcttttgcttctcttgatatagagaattgctttttaacttatcattacttattctgctccctgtggtagaataaagaacacagttactgtat

SEQ ID NO: 74524 - DNA, 1025 bp, Homo sapiens
aaaaatgggattatatttcttaaaaacctttggaaaacatgtcacttgttaagacaaatactcagttcttttggtggtataaagttagtggtttgagagtattcttccagactttttttctatgcatttagtaacataacttattgttttctgtgcctcattgtgtatcctgattgcttcttaaactgggttctaaatgataaaataacatccctatataagcatctttcttttccttttgtgtttgtataacattttacaatatataactttgtacccaataccttaaaaatcttttttcttttggaaccaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaagaaaggacatgtatcaagtgtctgttctttaaatcaatgattttttatactgctctgcccacttccaagcattcagtcgagacgataaggataagacaagcattgagttgtggtaggctctgaattcttcacccatgtttcaacctgtacatcattgcttttatctattgtatttgcttacatttaaattaaagctttaatttgagcagttaatctctgcaaaatgaaagtttgcacattgctacattaagttaaaagctatgtagttgtagtaataataatattagctgtcatttattgattcctaagtgctaggcactgttgtgttttatataaattcatataatttacaaaaccttatgaagtaagtatta

SEQ ID NO: 74525 - DNA, 1940 bp, Homo sapiens
tatcaatctatacatgtagattaaaggaaacacagagttggttaaatcaattttgtgaagactatacggtacaacactatagaatcacttaaaagttatgatacagttttatgtttattgaaatagaacggtattcatgacacatgaaaaacagattatatagagcaatatgtttctgcttaaatatttttatatgcatatgtttgcttaagaaaactgaaaggacatatatactaaaatactagggggttattttctctagaattgggttctacaagtaatcttttattattataaacctattttctaattttattgtattcatgtattgtaatattttaaaagttattttaggtaacttaggacaagcttatattctttacccgtgcctgcattttcagcagagaattaggtagaaagaagggtgaaatacaggaaatacaaacaactcaaagtaacatcaggacttgaaataattttttagcttttgttgtcttttgcaggagtaaaatttcaagagactgaaaccagatctgagtttcgctgttccagtctggacctctttggtgctgtaaatcctggatatactgtagatgagtactgcgtttttcttttatggtaaggcttacgttgagattgagaagctttgccatatatatgagtctttgaaaattcaggtttgtgacttcatggccagctgctaaggtgctataaatttcactttttttttttttttgagacggagtcttgctctgtcgcccaggctggagtgcagtggcgggatctcggctcactgcaagctccgcctcccgggttcacgccattctcctgcctcagcctcccaagtagctgggactacagttgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggctaaatttcactttttaaaagtcagttgaggccaggcgtggtggctcacacctgtaatcctagcactttgggaggccgaggtgggtggattgtctgagctcaggagtttgagaccagactggccaacatggcaaaaccccatctctactaaaaaaatacaaaaaattatctgggcctggtggtgtgcgcctgtagtcccagctactcaggaggctgaggcttgaacccaggaggtggaagttttagtaagcagagagagcgcaactatactccagcctgggtgatagggagattccgtctccaaaaaaaagagtcaattaaagatgttgagaagtagcattgtatagtatatatatgggttctggagtcagactgagttcaaacgcatgctctatcacttcaccagttatgcagcattggcaagtttcctaatatctatgtcttagttttatattttagaggatggcaatagtatttgactcagggtggttattttgaagattaaattagtaagggtgtgggtaaagcatacggtaaatgctcagtttgatgttaactatttgtcatcagaatccatgcgtatatttctcttagattctgtactacctggcaatttttgacatctgcataatagattgacgaaaattctttgttttggcctgacgtggtggctcatgcctgtaaacccagcactttgggaggcgaggtgggcagatcacctaaggtcaggagttcaagaccagcctggctaacatggtgaaacctcgtttctaccaaaaatacaaaaattagctgggtgtggtggcgtgcacctgtaatcccagctacttgggaggctgaggcaggagaatcgcttgaatctgggaggcagaggttgtggtgagctgagatcgcaccactgcactccagcttgggtgacagagct

SEQ ID NO: 74526 - DNA, 1065 bp, Homo sapiens
cttccttgaccaatcctacttcttttcttaaccttacttgctttctactacttatttggtggtatgttaatttctgtgagtcttgtctttctggctagattgtatctgaggttatggatttttaaatctccacactgctgcatgaaaaagaacataatgatgaaagtataactgcagtatttttagctaacaagttttagatgatcattacaagtaaatacaaaaaattttctagctagtaattaggtgaagagtagggaatagtgtgaaggttgcctgcaaagatgaactgcgtatctagtatgtatttgacctgaaagttcagatgacacgcaaatgctggaagaggaaattaaagcaagactctttcttacactgccatcttgtggcagacttgggttacaaatgttactaattcaattttcctatataaagggaagattttcttcagattattttgacaaaggattacgaagagtaaaggttaaatacaatccggcattggctcaaatgaaattgaaacatgctttgaaaaaactgactattttggattattttctcagttatctgaatcttaaaagttcttgactccttcctcttgcataactgttttcttactgtgaggttgttgacctttatagcctttcagaagttggttagactattgtgcagttttatccaagcttgtaaatttatacaaaattaagcttgtgtaggggtcctgctcggtttttttttgttgttgttgttaaattttttttgttttgttcgagacggggtcttactctgttgcctaggctggagtacagtggcacgatcacagctcactgtaaccttgaactcctgatcctgccctatttgatattgagcttgggcatttggtgacattctccaaatagatgagtcaataatttatattaatgaatggagagttaaataaaggatgaacggttactctaaattttcttgtgacttggtatagaacatgctggtgtgagttgtcatgtaatcataacctttgtgaatttatttatgttttttaaattttccagaaatgatcctaga

SEQ ID NO: 74527 - DNA, 1009 bp, Homo sapiens
gggttttaggaagcttctaggctcccactttaattcctaagaatccaaagtttaatgtataagccctatttcttctttatatctttaatcttacaggaatctaattttcttgcctgatgctatccttttccttatggaaataactggcacctgtgacgaaggatgagtcattggtttatgtgatttccatttgcaaaactccttttttttgtttttgttttcactcaacatagaccaatctccagttcaacaacaacaagtactatctgattcagctattagaagatgatgcccagaggaacttcagtgtttggatgagatggggccgaggtaatgatttttattgagattttatgagttggcattcagaaagtcagaagcagcttagtgggtggccaaaggattctctgggtttaaattgggtcagtagaggctctgaagtctgggagagccttaggaatcaagttgagcatcttgaaattggggaatggcaggcatcctccttagagttcccactggaaaaactaagagcagcccattgagtctgaaaactcttctatagttgaactgctagtagtgctcatagactatggcagttagcaagtaacttgtatcaacatgattagttccctaaatcctttcacctttcccttctccctttcctgcctgtttgtcagatgttaagcagagagatcttggagagctggcctgttactcttagggaactatcttatgtgtggcatttcctttgcagttgggaaaatgggacagcacagcctggtggcttgttcaggcaatctcaacaaggccaaggaaatctttcagaagaagtgagtgctgaaaagtgactacaaaaaaatataccctcctcttcttagatgtatattctctaaaaaatttttttttagacagtttcactcttgttgcccaggctggagtgcaatggcatgatctgagctcactgcaacctccacctcctgggtttaagtgattctcctgcctcagcctc

SEQ ID NO: 74528 - DNA, 1058 bp, Homo sapiens
ttgggaggttgaggcaggaggattgcttgaagctaggagtttgagaccagcctgggcaacaaagcgagacccctgactctcccccaaaaaaaaggaaagaaaaaaagagaatattcagttagaatttttaaaactttatgatatagatgaagaactttctggagaattggagaacatgtttctttcagggaaagagattagatggatatcttttgtttgaaatctcaatggcttttgtggtgtttgggaaggacaagcattgtttttcccattttttaaattccatttgtctccagagcttttttgtccatttagtgtcctcatttagaattagactaattttgatttatggaaagttgatgtgtaaaggagctcagtgctggaaaataaattctttggagattttctgtcttgtaagtccatcttcatagtagacctttatttgtaaagttttcttacaccttggactctacagattccttgacaaaacgaaaaacaattgggaagatcgagaaaagtttgagaaggtgcctggaaaatatgatatgctacagatggactatgccaccaatactcaggtaactctcactatacttttcgaaagaaacacatcttctttttttattttattttttagaggcaaaactgtgctctgttgcccaggctgggtggcacaatcatggctcactgcagcctcaagatcctcaggctcaagtgatcctcccacctcagcctcctcagtatcaggaactacaggcacgtgccactctgcccagctgattttttttcttttttttttgtaaagatgaggtttcactatgttgcccaggctggtctcgaattcctgggctcaagcagtcctcttgtcttggcctcccaaagtcctgagattacaagcatgaggcaccacacctactcctgtttcttcttactcagggtaaagcagaatagcttagatcattcctggactgggacaggccaggatatcttgaatcctttctacttctcacctcaggggtgctctcactgatctttgtaatcccaaagggacagtaaga

SEQ ID NO: 74529 - DNA, 1114 bp, Homo sapiens
ctactccggaggctgaggcaggagaatggcgtgaacccagaggcggagcgtgcagtgagccgagatcgcgccactgcactccagcctgggcgacagagcgagactccgtatcaaaaaaaaacaaaaacaaaaaaacgaaaaaaacaataaacgtctggaaatagggcctaagattttataagaaacttagtaggccgggcgtgatggctcacgcctgtaatcccagcactttgggaagctgaggcgggtagatcacccaaggtcacgagttcaagaccagactggccaacatgatgaaaccctgtctctactaaaaatacaaaaaaaattagctgggcatagtggcgggcacctgtaatcccagctacctgagaggctgaggcagaagaatcgcttgaacccgggagctggaggttgcagcgagctgagactgagccattgcactccaacctgggcaacaagaatcaaactccagctcaaaaaaaaaaaaaagaaccttagtaaataacagagccaagactagaaaggcacattctatcctcattcttactgtccctttgggattacaaagatcagtgagagcacccctgaggtgagaagtagaaaggattcaagatatcctggcctgtcccagtccaggaatgatctaagctattctgctttaccctgagtaagaagaaacaggagtaggtgtggtgcctcatgcttgtaatctcaggactttgggaggccaagacaagaggactgcttgagcccaggaattcgagaccagcctgggcaacatagtgaaacctcatctttacaaaaaaaaaagaaaaaaaatcagctgggcagagtggcacgtgcctgtagttcctgatactgaggaggctgaggtgggaggatcacttgagcctgaggatcttgaggctgcagtgagccatgattgtgccacccagcctgggcaacagagcacagttttgcctctaaaaaataaaataaaaaaagaagatgtgtttctttcgaaaagtatagtgagagttacctgagtattggtggcatagtccatctgtagcatatcatattttccaggcaccttctcaaacttttctcgatcttcccaattgtttttcgt

SEQ ID NO: 74530 - DNA, 1169 bp, Homo sapiens
caaactgattaaacaattaacatttaaatttgttttcacttctggatatataccaccataaaaaatttaatttagataaactgaggtataccaggatgctgaaactgtccggaaacagtcacatatccaaaaaaatggagaagttttagtcttttttaagatgggaagatctgagacataatagctgtctttacacactgacgtcatgaggaaagccttttttttctagacttattctgagttgtaaaatgtgggaggcagaacttggatggtcaaccctctatatccatggattcaatgaactgagaatcaaaaatgtttgaaaaattgcttctgtactgaacctgtacagcctttttttccttgcttctcattattccctagacagtgcaatataaaaactttacaaagcatttacattgtataatattgggtgttataaggaatctagagatgatttcttagattgtcttgtgttttgtttgttttttgctataggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttggtaggacttcacattttcttctgcattctctccttataattcctagctcctttaatggatactttattatcattatgatttaaagcttgctcatagtactgaatgaagaaaatgggatttggggtgacaggttgtatggagggaagaggaactattttgaaagttgaggctgggtgtgatgggtcatgcctataatcccaacactttgggaggccaaggcaggtggattgcttgagcccaggagtttgaaaccagcctgggcaacatggtgagaccccatctctactaaaaatagaaaaattagccaggcatggtggtgtgtgcctgtgatctagctacttgcgaagctgaagtgggaggatcaccggagcccaggaggttgaactgcatttagctgtgtttgtgccacggcactcagcctgggcaacaggagtgagaccccatcttaaaaacaggaaaaaaaaaagttgaaagatgaaagtcttttttagggaaggatgttaagtac

SEQ ID NO: 74531 - DNA, 1316 bp, Homo sapiens
tagctatccaaccacccaagtaaaacaccttcaggcatatcacccccttttcctatttgagtaactaaaaccacacaaacaccatttctgtgaactcaagtgatattagatagacaaaataacattttacatttgttgattctgttttctggtttacatccgatttctatttcttttatagctttatagagccccgtgacctagaaataaccctgagtggtcaacaggtctacctgtgcttctagatagaactgtatccaactgttccctgttgatatcaatataacttatttttaaatgattttataaaaaataattttaactctagtctcaaaagtcaaaatccacatagttcatcttataccgagtatatatttaatattattttatatatttggaagttaagatctctttacagatctctttctctctcaaatggaaaacctgtttctcatacctgttttctaaaggacctatctgtcattttctatttttagtcatgcgccttttagccacatgtcagaaagctcattatgggttatatctctgttcttagactccgtactcctccactaatccggacacagaaggaactgtcagaaaaaatacaattactagaggtgagatatgtatgatttgagaagtattatatcccttataccagtgtcctcccacattgattctatatctcatcttctcaggctttgggagacattgaaattgctattaagctggtgaaaacagagctacaaagcccagaacacccattggaccaacactatagaaacctacattgtgccttgcgcccccttgaccatgaaagttatgagttcaaagtaagaaaaatgatcatttattttcatattcttgcacccttaaccacctcccccatcccactgttctctaactacttcttgtcaagagcaaattgtcaattagggcagactttttatgtactagggatttgggaaggccaagcttttcctagctgccttgtaagactgtttgggagcagaaaggtctgccaagttatatcagaatccccaaattcttcagttcagctcagtctcttgtagagtctacatcagcctttttgtcttatttttcacaggtgatttcccagtacctacaatctacccatgctcccacacacagcgactataccatgaccttgctggatttgtttgaagtggagaaggatggtgagaaagaagccttcagagaggaccttcataacaggtctgagtctagctttgcgtttggaaagacactccttgcccgaaagtacagctgtagaacttataagagggagtcag

SEQ ID NO: 74532 - DNA, 1665 bp, Homo sapiens
cacacacatacacacacacacacacatattcctggggcttcaaaatttgagaaattgtgggaaggagttggtatttaaggttggacacttacagaatgagtaggagttttctggaccagtaagagaagggaacagtgtttcaggaagaggaaggaacatgtacagaagatatggagatgttgagagtatgtagtatattctgggtatagccagctccttggattcctggtgggagtaagggaaatggaattgaatagataaactggggtcaggctgtagagggcacagtgctaagaattttgggtggaataattatctggattttataaagagaactggtggcagtatggaagatggatggtagtagagagatactaaaggtaaggagaccacatttacacctgtagctatagcctaggaaagacgtaatgtgggcctgacctgggctgtggagatgagaaggggagatacggatttaggcatgtgttgcatccacaggccttactggtgagttggaggtagagagggaaggaaaagccaagaatgttagagattcctagtttgagcaagtaatgggatggcaccgatgaatactaatgttaaaaaacaaaaaccagaaagtggaacaggattttcagggaaggtgatacattttgctttgtacttcattcctgaggaattcatgtgggattgaggagcctgagaaaggttaactaaaataggatctttctctgtccatgtacttttttgagctagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggtaagatccaaaatgccatttcctcctgagctggggaaaaaggaaacctgagttagtggttatcctgaggttgagtctaacttagaagaaaactctggagtcttaaagagaggtgttcttctctttacctctctttaaatcctgagctcaacctattcctttctcacaaaccaggagcagctatacagaaaatcctatgatattgtccacccacaaggagtatggcatatttgtcctgcagcccaaggatcctggagttctttctttcttggtaagtcctatttgagtgtgtgctaaagcaaacattcgtctaggaccagtgtttttacaccttggggcccgtcatggaggatagggaagggaaaggcagttggctgcaaatcctcttatcctccttcaactggagcagttctaatttaggacattgtgtattgggttcccatgtaagatttcactggtacaagaaaggactctaccgttttagaaagccataggaaaccataaacctagaagttttctcaattgcattttttcccgtgtctctcttgtcttgcccctatgaataatagcatcttgagggcaaggactccatcttgtttttgtcatcatacttagcagttacttaatagatgttcaacactttttggattgagtgtgccaaagctagctgttcacttcaaatgcagtttcctgggagccgcttgttattgggaaggttattaaatcctgacctgctacccactaaagttatctactaaagcctat

SEQ ID NO: 74533 - DNA, 1034 bp, Homo sapiens
acggtgcatggagtatctaatcccagaggcaaaatgagcataaaaatgagatacctagagattaggcaacataggaagaccccccatctctataaaaaataaaaataaaaattagctgggtaccatggtacatgcctgtagttctagctactcaggaggctgaggcgagagatcacttgagcccaggatttcaaggctacagtgagctatgatcaaaccactgcactccagcctccagtgtaacagagtgagaccctatctttaaaaaaaaaaaaaagagaaaaagaaaatgagatacttgggattggattatggtgttgaggctaagggttggtgtaaagggagagaggagagcatgaaaacacagcctcttggtatcatgaacttgagccacccgaccccactgtcctgagccacccaaccccactgttcctgagttctcctccctcattgacatcttccatgctcctaatgctccacccacctctgtggaggaagttctgtttcccatgtcctgctcaatatgactctgctctgatcttgtgctctgtgggcaggaggagcacgtggtgtctgtgagccgggatgggaccttgaaagtgtgggaccatcaaggcgtggagctgaccagcatccctgctcactcaggacccattagccactgtgcagctgccatggagccccgtgcaggtaacaaaacgtcagccacctccccttccctgctgtctcttcttttctcccctgctccgtcccttcttctgactcagtctctgtgtcttatcagctggacagcctgggtcagagcttctggtggtaaccgtcgggctagatggggccacacggttatggcatccactcttggtgagttcctgcaaggaccagagtcaagggaggtggggaaggtatgcggaataaccttctgttgtgcccactctcatgagcccatctccatcccttcctcctaggtgtgccaaacccacaccctcctgggacacagcggcccagtccgtgctgctgctgtttcagaaacctca

SEQ ID NO: 74534 - DNA, 1147 bp, Homo sapiens
ctccctcagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggtaagaaggtccagtgttgctcttgggggaagcacaggaggacaggagtggagggtggcagacgacagacagcagcattctgggtcacttaagattttgctgagagcaggtcttcacgtttccatttctacctccctgtgtaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggtcagcttgcagagggctggtggtgggttgtgaggaggagtagcaaaggcaaagaatatcttggtgggggtgggggtcctttgtcgaggagactgtggaggagcttggattgcaggaaccacggggagaggggtgccgctgtgtgcaggggcagctctcatgagaagagtctctggaaggaggactttaatgggggtggctgtaactcaaaacaggaaggaggaccgcgtggtggaggtggtatccttaagcccttttcttggttcccaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggtactgaaatgggaatgggtgggtttttgagcctttagaaagagcgcagcccctgccccctaccccttcccaagtgtcttactcccttgttctctctcattctctaggttcccagggggctcagggtcaggcactggatgtggcagtgtccgccctggcctggctaagccccaaggtattggtgagtggtgcagaagatggg

SEQ ID NO: 74535 - DNA, 1019 bp, Homo sapiens
tgctgaggagcatggcaccatggatagtcactgacccatttaccctcagcctggggccctgctggagcagccagtgtccatcccagacgatgacttggtccaggccaccttccagcagctgcagaagccaccgagtcctgcccggccacgccttcttcaggacacagtgcaacggctgatgctgccccacggaaggctgagcctggtgacggggcagtcaggacagggcaagacagccttcctggtacagagtctcaggggcctgggcaggagggagggaaggctgtgtgggctaaggaggtaaggcacagggagctcaggcatgtaaaatgtgaccatgttttctgttcctgtcccatgcaggcatctcttgtgtcagccctgcaggctcctgatggggccaaggtggcatcattagtcttcttccacttttctggggctcgtcctgaccagggtcttgccctcactctgctcagacgcctctgtacctatctgcgtggccaactaaaagagccaggtgccctccccagcacctaccggtgggtatcccccaatgagcccagccttgttgatgcccacgtaccacccctgctttttttttctctcccactgaccctgacttcctctccatgtacagaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccgggtgagtgtgagaaggaggtgggtgtcgggaggcaggctggggagaaggagggatacggcacggaggagagaggcctctccaatgtggttctccttttctttctaccttcctgcccctttgcccaaatatcacagtgtgtacacctggtgctgagtgtgtctagtgatgcaggcctaggggagacccttgagcagagccagggtgcccacgtgctggccttggggc

SEQ ID NO: 74536 - DNA, 1138 bp, Homo sapiens
gcatcctccaaggggttgggttggtagaatgctggggatcctgagcagtatcctgttcccagagctggttttcccaggcaaacactcagactgaaataaatgatatgaatttgcttccaagtatcagtccttggttcctaggggcaattcctaggatgttgtttcaaccaggtttatggattataatactaacatttcacctttggctggtacttggtactctctaaatttgcatcaccaaaatatgtctcactttcacctcactacatcccggtgttgaacttgggcagggatcctggctcctcttttcctccctccacagtcagctcctcctgagggctgctgaagctgacccctcctaacttgggattttacactttttcttattccctctaaccaatggaagggtttggcctccagggctggctgggcaagggtgaattccaaagcaggggagctttatttcccctgacacttgtccaatcagcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggtcagacactcaacacccaccatccaaaaatacatgaaggacacaggcctgggaatagcccagatatttggtaaaggcacagacaatacacagttctgaagatttcccaagcagactgcaagactgcagtgtttgtcgcttactgtgcaaccacataacatgaagtctctttccttcaggagtttgatgaaaatgatggatggtccctgaatacttttgggaaatacctgctgtctctggctggccaaagggttcctgtgagtattaatccctgagaaaccctctccctcccccacattttcctctgcaactgatatatttcatttcttgacctttagagctgacttctccaaccacatacaatagtcagatcagctctactggctacaaccccctacccagtggtgtgctgctgaatatctaacaaccagctgcctagaaaaataagccttggttagtagcatctgctaaatttccatggtgtaaacagtc

SEQ ID NO: 74537 - DNA, 1043 bp, Homo sapiens
ttaagcagcccaaggctgctgggggattaatatggggctttgccctttttcttctgacccccaaaacatcttactaatatcctaaaaggtgtgtgaagagccccatgctcccaggttgtgacgccaatgaagagatgaaagcaggggcagatcatgaagcatgtgggcgaaggctctgaaggttgagtagagcaaggtggtgtgtgagagcagtaagtcagacaggacacatcagtgctggtgtgtgaagggagagaacattagaggtgctattaatggagatgtagacttttcccgtggcctggtgctgccttcagatccatctggctttgaggggctgtggatacctgctgtgattcataactgccactactaccccagggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaaggtaaaaattcaagagttaggggaaggttaataatggtgtggaggggaggttggtggtggagtacttgaaccaggtcccctccccagttggaaggggaaggtagggatacaacctagctcttatttctcacttcctaatccccttttcttttttcttttattttccttttctttttttctttcctttctttctctcttttccttttctttttttttttttttgagatggagtctcactctgtcacctaggttggagtgcaatggcataatctcagctcattgcaacctctgcctcctgaattcattattctcctgcctcagcctcctgagtagctggaattacaggcgtgcactgccatgcctggctaatttttgtatcttcagtagggatgggatttcgccatgttggccaggctgctctcgaactcctgacctcaggtggtctgcccacctcagtctcccagagtgctgggattacagatgtgagccaccatg

SEQ ID NO: 74538 - DNA, 1028 bp, Homo sapiens
cccggctaatgtttgtatttttggtagagatggagtttcaccatgttggccaggctggccttgaactcctgacctcaagtgatcctacccacctcagcctcccaaagtgctgggattacaggtgtgtgccacgacacccaaccagtttccttattttaaagggaataattgaattagattattttgaagttctcaagtttcagatctcatgattctacaaattacaccaagaacaggagagggttatgcagagaaaagctgggacgcacggaaaacattaaacactaaatcttaggcaagaggagacagcaatccgatgaggttggattacagccattcccgagtggtgccactttcccagcaaaatctaacagaatggctgacagtcttggctcttgattgtaaagaattttattttgtcacgatatagacagacctatataagttgcttgttggtcatttcccatttattttgtgctcctcttagcaaatgctttcctctcaacctgatccatgaagactctttttctgactcatctgaccaaaaagactaaagcaatgtttatctaagtgtcttcaggccactaacatgagaatcacatagggttacttgaagtgttacaatacaaatttctagggtctccgtccagaactgctgaatcagaatctctgggagtggactgctgaaacctgcattttaacaactaccccatggtattctgatgcacaccacagtttggtctgtagcagtgggtggcttggagggccaaacttagagtttggccaaacttagagtaccaagttggggtaatgcctatcggtcttgcaatactttgagtcctcctctattccttctcccctcctgcagtgcaccgagccgccctggcctgtggcagtgagttctttggggccatgctcctgagcgggatgagggaatcccagggcacagaggtatctctgcggacgatctccacccaggacctgcgactcctcgtctcttttgcttactccggagttgtgcgggcaag

SEQ ID NO: 74539 - DNA, 1497 bp, Homo sapiens
aatttttgctctcgtgtaatcccaaaaccatgatttgttgattcttttgtttttccctttaattgtaggatgtagcccatcggatgctggccacaggcgagtgtactcctgaggatctgtgtttctccctgcaggtaatgcagtaaaaaactgggacagaaagttggggctgaaggttttatattgtagagcagaactaatctgggatgcccctctaatattttctccttatctgtccctgacaggaaactgtgtttgcaatgctggtagagatcacagagcgagccatggcacattgtggctcccaggaggccctcattgtgggaggagtggggtgtatgtattattgaaaagtgttcctctttcctattcttaacactatgcgtcttcctcctggtactctaaatcattaagcgtttggagtaggcttcccaatccttgcccctaatcccctatgtcattgttctaagtgagtgcacatgacgtgttctgctggaccatgaagagatggctaaaactaagctaatcctgttccctgcctctttgtaggtaatgtgaggctacaggagatgatggcaacaatgtgccaggaacgtggagcccggctttttgctacagatgagaggtaaagacactttccctttggtttcttttttacttctcctgttatagtgattttccacccttagatcccaattttcatctctcttgcatcccagattctgtattgacaatggagcgatgatagcccaggctggctgggagatgtttcgggctggacacaggaccccactcagtgattctggggttacacagaggtgagtgattcacctcttggtgagggtagattattgggacatagacaaaaacagcagggaagagtccaggaacatgagggcagagaagaatgaaggatgttaagggctcgctctccaccatgtttcttctgtttttccacaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggttttgtatgttggtgattggattgtgttgttcaggaccaatgtagatttggtgctggataaattcttgttggagcttgctgctgtggaaccaagaatgaggtatctttttttttttttttaagaaacggaatcttgctgtgtttcccaggctggtctcgaactgggctcaagcagtcttaccacctcagcctcctgagtaaggatgccattgtgcctggcaacaatagtagtatcataactattattatagcatcgggtcccgtgctaactgctttacattcattctctcatttaaattctttgaagtaggtgtgcaagac

SEQ ID NO: 74540 - DNA, 1019 bp, Homo sapiens
tgggagacagagcgagaccctgtctcaaaaaaaaattaccactgccactgtgtcataatttagaaggattcatgttctctgcctccaagcagaaaagccggttacctactatcaagactgcatttaagggatatattaggaacttctaagccggaaaaccaatgtatttgaaatgacaatttatttctgcctgaacctacactgtctaggaatctgttcctggaatcctcagggtatacagatttcttctcaaatcagagctgtaaaaactacccattcaccatttgggaaacacctttcttccacttcttattggaagccctggtggtcatgttgatcctctgctatgtttttctcccaaagccaaataatcctctttacagacttggggtttcatggacttcctcatcacccttaggtgattgcatactcggaacatcgttaccgtatctttggggaaaccatcgatattgcagtgggtaattgtctggatcgttttgctcgagtgctgaaggtaagccagtggggctgcagagaacataaaatgtgggtgaatttttgggaagccatggaggtggagggaggaaatagtaaatgagcttcttatgcttcctgcatatctgatttcatcctcttccattccctccttccttatttttttcttctgctagatttctaacgacccaagtccaggatacaacattgaacagatggcaaagcggtaaggggacataaggtggaagcaggctggctgctggggcttcagggatttccccatatacggtatatattaacaaaatttgggacgggctttggagggtgagaagccagctgactgtaggcttagtgcctcgtacgcttattcccacatagaggcaagaagctagttgagctgccatacactgtaaaggggatggacgtctcattctcagggatcctgtctttcattgaggtgagtgtgagaggtgatgagacgggcactttcatgctttttaaatgaagcatatctgttttactta

SEQ ID NO: 74541 - DNA, 1107 bp, Homo sapiens
tagatgaaagtaccaaacacggctgggcgtggtggctcacgcctgtaatcccagcactttgggaggccaaggcaggcagatcacctgaggtcggggttcgagaccagcctgaccaacatggagaaaccatgtttccactaaaaaatacaaaaaattaactgggcgtggtggcgcatgcctgtaaacccagctacttgggaggctgaggcaggagaattgcgtgaacccgggagacagaggttgcagtgagccgagatggtgccattgcactccagcctgggcatcaagagtgaaactctgtctcaaaaaaaaaaaaagtacaaaacacattacaacttttaattgatattttaaataagctattatatcttgctactctcccctcaaacacttgcatacataggagagggcagctgacttgcatgtatctgaaaagcctccctgaacaggtgatgttgtgacagatactcactagaaatatatatgtatgtttagcattcactcctctgggcacttgggcactgggaatacaaagataaataaaatactcaatgctttgagatattcatgattaagctgagcaaaccacagaaaattataatgctgtaattgttatgttaaataaatgacatcatcatgcatagagttctgtagggtcacagagaaagaagatcaccaaaggccaggcacggtggctcaggcctgtaatcccagcactttgggaggccgaggcagacggatcacgaggtcaggagttcgagaccagcctggccaatatggtgaaaccccgtctctactaaaaatacaaaagttagctgagcgtggtggtgtcgcctgtagtcccagctactcaggaggctgaggcagaagaatctcttgaactcaggaggtggaggttgcagtgagccgagatcgtgccactgcactccagcctgggtgacagagctgagactgtctcaaaagaaaaaaaaaaaaaaaagatcacgaaagggtatgaggtagatactacttgcattgagacctgaaggctgagtagggtaagaagaagagcatttctgaaagttgaatagcctatatagaagccggaaagagtagatgtgaaaatgt

SEQ ID NO: 74542 - DNA, 1049 bp, Homo sapiens
gggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggaaaaagggagcggtggcggaagacggggatgagctcaggacaggtaagggaatgaaatcagcccttcttcctagaagctgcggcgggggtgtttgtcattcccttgatgtacggtaagtacgggccgactcatttttgcaggggtttgtgaagaagtcgcaggaaccgtaggctttcgttgggtctatagttaacgccggatcgcagttggaaaccaccagctttttgtcagtatatattactcattttatagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagatgtgagtggaatttgagggaaagagacattttttagtattgaatggtcttagggtttagtcaccccttttctccgtttagccttcaggctgttttatttttctcctgcccgtagttttctgtggggcttccccagtcttgccagttgtatttcctaaatgtctgttccttcacttccattgccattttcttttttagtgttctctcctcttcccagaatgttgcaaaaacctcttcactatacttcctccattttatcttcctgcattgcattccatatgaagcatgtcctccattccattaaccatagcttaaaaatcttagcttgctatccactgcctatagaaaaaacacatctccttggcatagcatgtaagactttcttacctct

SEQ ID NO: 74543 - DNA, 3118 bp, Homo sapiens
tggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactctacgctttttcagttgttaacttgtgtgcatgaaaatatgaggaagagaatgtgtagccccacgaaggggtaagacacgaagacagcaaggctgaaactatggctctttattttcatgtggataattcaaacaaagtcattagtagtctttgttcaatttttttttaaaaaacaaaaaaccctcaaataaaaaatcttgggcttaaaagaactctatcacaggagcctggttggaggattcctagttttatacatgagaaatagaatgcagatttctctgaagagtgtttaaagaaggaatggtagttgagggggcttatttcccaggctcaaagtgatttaggggtggtgtcacagtgctaggtatagggtgataggacagtgatcactgccgagggccttggaacggatcttgctgtcacacaatgcaggtaacagagagtgggacaacaaaaagtaatcaaggcgccaaccaacattcttggatcgagcattcatcatataagtccaaaaggtgtaggcatagggtgtgttggggtagaggtgcctaaagctgtcagccagtggcacagcctgcagtaattccccgaagccttggcgctcttgtggcgtgaagccagcattctttttgttccccttggggttgcgaaggtcaatttcttcatgtgccacattgaggtctccacacagcacaaggggctttcgggaagccaggcccttcaggaacttgcgaaaggcttcatcccagcgctgccggtactccagtcgtaccagacctcggcctgcattaggtacatatgctgttaccagcacaaacgagtcaaattcagccacaatcacccggccttcctgatcatgctcctcatcgcctatagaaatgaaacagaattagcataaaaaactataagaaaagggaaagcaatcaagaggtggggcagagatagagaattagcaattggttttgaagagttcaggcattaggcatcaatagggtctcacctatgccgtaagaaactttgagtgggcactggcgggaaagcaggcccacgccactgtacccttccttgtccgaaggagctgaccagtattgatgagagagtccaggcagctcctgaagttcagctggtagtttgttctctgaacatttggtctcttgaaggcacagtatatctggggcttcttcctttacccactgtaagtgaaaagaaaggtggaaaacgtattatcaattcagcagaacatttattgaataatctatatgctaagtcatagatacgcacgggttaaacagtctcttggcctaaggagttcgagtcaagcagcacaatattcaaacaattctaagctagataaatgaaaacaaatatagagaggtaagaaagtcttacatgctatgccaaggagatgtgttttttctataggcagtggatagcaagctaagatttttaagctatggttaatggaatggaggacatgcttcatatggaatgcaatgcaggaagataaaatggaggaagtatagtgaagaggtttttgcaacattctgggaagaggagagaacactaaaaaagaaaatggcaatggaagtgaaggaacagacatttaggaaatacaactggcaagactggggaagccccacagaaaactacgggcaggagaaaaataaaacagcctgaaggctaaacggagaaaaggggtgactaaaccctaagaccattcaatactaaaaaatgtctctttccctcaaattccactcacatctaatcctttcttcttaatccaggctcgaagcccatccacattccaagagcagatcttgagtgtggcaggtttgccactgggtgaggttttctgatctggggggtcctcatacagggctgggccctctcctgctgcctctttgtcatttttctttgcggccgtcttactcttcttggcctctggctctataaaatgagtaatatatactgacaaaaagctggtggtttccaactgcgatccggcgttaactatagacccaacgaaagcctacggttcctgcgacttcttcacaaacccctgcaaaaatgagtcggcccgtacttaccgtacatcaagggaatgacaaacacccccgccgcagcttctaggaagaagggctgatttcattcccttacctgtcctgagctcatccccgtcttccgccaccgctccctttttcccacgcttcggcattcccgttacgaacgcccttgggcagctgtaccgcgtcacccaccgaagcaatatttttaccgcgttgcctacagacgcaaagaaatcatg

SEQ ID NO: 74544 - DNA, 1082 bp, Homo sapiens
agcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcagccttgctgtcttcgtgtcttaccccttcgtggggctacacattctcttcctcatattttcatgcacacaagttaacaactgaaaaagcgtagagtcatgaccttatttatttacaagcacaggataagtccctaacctcccccaaagactgagcaaccctacccagcccagttaaatactgcaactgggggggtaaaaaaggtcgggaggaggaattaagggaaatacaggaataggggaacatatcccacattaaatagttatatacacatcagttcctgtggttctgtacagagcagcggctgaccccacccccacaggacacaatgtggggagaggagactgagggtactgaggccagagccaacctctggtgaagtgcaatagcagcagcaaagtcctaatggtgcacaagagggag

SEQ ID NO: 74545 - DNA, 1493 bp, Homo sapiens
gcaaagtgacatcccaacggattgcatgccctcggccctactggtaagaggcataaggtggggaagggcctaagtggggaactggaaagtcaaaaaaggatgagcgtatacagagaatgtaaaggtgagagagcctagtgtttatttaggagaaaaggctttgaagcatgtgcctcaggaatgttatagctgtctttctcgtttctcaataaaaatattgagatgaaatgatgtcgtttcggagaatagagagccttggggactgggtgtgttatcctgaggtcggaggggaattggggacctgaagtttaaacagtgctctttctttctcaaggattcttgagggtatacagttgggggacagagtatcttaagtacagagaagtcgagtgacttaatagacagggagtgggggatgtggaacagggactgtgaagatttttaggattaaaaatttttcaaacacaagtttgaaaatacaagtctttttcttttgtatagcaaaagaatcatcaacctggggcctgtgcatcccggacctctgagtccagaaccccaacccatgggtgtcagggttatctgtggacattgcaagaatacttttctggtgaggaaggggtattgggaaggggaggggaaaggagactaagagtcatttcgagtatatttcttagagtaatggtaatgacccctgaaaggtctgtcctatgggaacatgttctgcatccccaccccaaggttctcattgagggagaccctgcttgtgctattatttttgttttctttctccatagtggacagagttcacagaccgcactttggcacgttgtcctcactgcaggaaagtgtaagtgattagggattgagctggtaattgatgtatggagtaaaaactacaaggccatagaaagcatccatttctatttgcctccccacaggtcatctattgggcgcagatacccacgtaagagatgtatctgctgcttcttgcttggcttgcttttggcagtcactgccactggccttgccgtgagtacccttgccccaacctctttcattctgcagcctcatctccataggctaagatttgggaaactgctaccctaaaaaaaagtggaagaaacttgggggactagtttgttttgttttaagatatggatgagctaaagtgcaaagtggctgatcaaacagactttattactactacaagagtgaaaaacagccttcctttctctgtaggatgaggataggacagtgaaattcttaatttaagagttgctatttttcaaacctggctcagttgtcagatattaagaaaaactgagatacagtgtgggatgggatgagtatgttacgcctaagggaaggaagctgatcagctctgcctttaagaaggtccctgagggtggctacatgtggataaggaacaaggactgaagcgtgagttattactgttcttagaactaataggaggtagtggagaccaacattaa

SEQ ID NO: 74546 - DNA, 1020 bp, Homo sapiens
caccagagaccaaacaaggactaatccaatacctcttggattttatttaatgtcataatgttgtcagaataaagagaaagatgaaataatttcatttttttgtgtaacttggtatggggctggggcacagaccaagattgacatgaaaggatgtgagatcgcatgtcttgtgtgactatctgcttctcagacaagcagttaggaactgagatgagatagtatgtgagggcagcaaaggatgaagaagggcaaaatgatgaaaggtgaggtggaaagaggttatgagatggtaaagaaaagttaacttctggcacttgattgccacttctgtcaggctggtcctgcctctctcccttgccttctgattgtttcatttcctgtttatttgatcatatctgaattagttcactggttagcctcttccttagttcccacttccttaccaaagccctaattatatttcctcttgtttgccttttctctcctactcttctctaacatctgcagccacactctccattcactccatgctgacaaggcagtggcaaacacttttctctgctgccagccactccactgttgactggattgctgccagccccaggcaaacctgtgaagttgtttcatactctgcttctctttgagtgcctccttctctccttcctcttcctttctgggctccagtctttctcttcacttgtgcttgtcagaacctccctgtgatactgcctccaggcatttcccccatgttggctcaccgcactattatctttgcttatcaacttgcattcagctggctggcatgtttcaaaaccacactgccctcccaggcctgtgtgccttttgagaaagaccagtgctggatgagcctctagtaatgacaacattttagttgttagtggtataatacggaagagatattttgcacaggctgctttggagaactttcaaattatcctttgtttggtaactgacctacttaactgcccaatacaaagaaaaagcatcttggagtggctc

SEQ ID NO: 74547 - DNA, 1047 bp, Homo sapiens
tgccagcttctattgattagtaggcttggagggggaccacagaatcgccgaacctaagggaagccctaggaggcctgcacttgcccacaactaagaaagctttgctagttattcaggctaatcaccagctttttgaagcaggccttagttttttgcaagcgtaactaacatttggggatcggtgttttctgtttactctcctctgcctcctcacccttaacccaccctcagccagtgttgtgcaattcttagagacacttgccaacagcctcttctctaagccttcctactggaaggttgggatcctccgttttctcgctctgagacagcacgtcaaatgctaatagcagcacatgagtaaagcgcaacatctttattaaaacaatttcagcaccactcagggggctagggaaatctcagatgagccaagaccctccctcgtgacagtaaaaatcttataatcaagtcataatgtaatcagtagaaacccaagggacatcattatctgtggcacaggaccaccttcccagaagcagcctcaggtattcaagacttacttaaccacagagccactaacaagttttgcaagaggataggtttattacatacgcttcaattcaagcaattcttttactgatgacaagcagagtaaaataatttttgaatttatggtaatagtcaatgtaggtttccttcgaacagcaactttcagtggcccctttaaagttagctctgattgtctagaaagtactagtatggaatataaaagttgtgtgggcccggcacggtggctcatgcctgtaatcccagcactttgggaggccgaggtgggtgcatcacaagatcaggagttcgagaccagcctggccaagatggtgaaacctcgtctctactaaaaatacaaaaattagccgggcacggtggtgagcacctgtaaccccagctactcgggaggctgagacaggagactctcttgaacctgggaggcggaggttacagtgaacagagattgcgtcactgcactctagcctgggtgacagagcaaga

SEQ ID NO: 74548 - DNA, 1047 bp, Homo sapiens; identical to SEQ ID NO: 74547

SEQ ID NO: 74549 - DNA, 1497 bp, Homo sapiens
tgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctgagaagactgtgctatggtattattttttttctctgacttttaaattcttgtttagtttataaacatgcatgcaccttaataacctcataaactctggtcaaagactaatgcctatcagatccatgaccacaacacagaagatttgtctcatttactccagagagaatgattcctctcaaagacaattctcacagctcttccttctcccttagaatatttagaagcaaattagggagctgtcaggtctctgagcccaagcctgcacgtatacatccagatggcctgaagcaactgaagaaccacaaaagaagtgaaaataaccaattcctgccttaactgatgacattccaccactgtgatttgttcctgccccaccttaactgatcaattagccttgtgacattccttctcctggacaattagactcaggagctccccaccagagcaccttgtgacccccgcccctgcccgctagagaataacccactttgaccgtaatttcccactaccaacccaaatcctataaaactgccccaccccatctccctttgctgactccttttttggactcagtc

SEQ ID NO: 74550 - DNA, 1075 bp, Homo sapiens
gagaaaggtaggttgatttcctggcagaaaggaaagttgctggcaatcgctagggcgggggctgccaggagcgctcctcctctgcgcggagatgtctctgcagatccagagtctctccgacagcagggaatgtaggcactcacccgggcctggggagccactccaaggccggggcaccatcttcctaatgtcagtagacacttcagtgccgccgccatggctccggaggcgaaccggaaacggaaatacaggtgcctgtgaccctcagtcccaacgccgcaaggagcagccttcgcagaacttctcccgacagtttcagccaacgagaagagcgagtgtttgccagcagccaataagcaatggttatataaataatccttgaggcagaaaccgtgtttgggccgacttgaaggctgcgttgggcctggtcaccggccccagaaatcaagagggtggggtggggcggggcgggacgggacgggggcgggatggggttgggtgtgagcgcgccagcaaagactgtttctgggagtactgacttcctgtgttctttgcattcctccgcggagaactctgagtcttgggttgtttccctgtgtgaaaaagggagactgcagtaacggaaagaagagaaaaatcagatttaagcgactgaagaaaacagaaattaatagttaaatgattattgaatagttaatagtttgataaatattaaacctagttaataggtttatttatttttttacatttgttaatttctcttcaaatgagaccagtcttcttagtaagctaacataacacttactgagaacacctatgtgctaggtacttcagggaaaaggactgatccccacttcacagaaaacatggttctgacggggaccctcctgtgtctgctgctacgtcagagtgtttcccccaggcccaggacttagacagtagccgtctgattacctgaggtgcagaatctcaggtgggtccagccactattgtgacgtgataatatagcataggggaatggtctccagagtctgcaagctcatcaacaccttcattcactagagcatcagaagga

SEQ ID NO: 74551 - DNA, 1020 bp, Homo sapiens
gagtggctccccaggcccgggtgagtgcctacattccctgctgtcggagagactctggatctgcagagacatctccgcgcagaggaggagcgctcctggcagcccccgccctagcgattgccagcaactttcctttctgccaggaaatcaacctacctttctctgcctgcaggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttggtgagtaacggcgggaaagcgagaagaaacgggactggacctacatgcaagtgattccgcttttcgtctttggcccatagggagcgctgggcccactatggagaatcaggtgcaaacactgaccagttatctctggagcagacatttgcctgtagagccagaggagttgcaaagacgggctaggcatcttgagaaaaaattcctggaaaacccaggtaggacttaagaataattaaaaagtgggcgagattgaaatatcggttagaaatgaagagtaagaaataattctacaatctctcagatactgaagtctcttatttgactttctaaccagagcagcagttgttacaatgatgccttactaaaagaaggtagattattttagagattgcttaggtaaaggtcagaatgtcccagtatactgttttttgtttgtttgtttgttttgttgttttgtttttgctttgagacagagtcttgctctgtcacccaggctgaagtgtaatgctcgatctcggctcactgcaacctccgcctcccgggtttaagtgattttcctgcctcagcctcttcagtagctgggattacaggcgtgcaccaccacacccggctacttgtatttttagtagagacggggtttcatcatggtggccaggctagtctcgaacttctgacctcaggtgatccgcccacc

SEQ ID NO: 74552 - DNA, 1171 bp, Homo sapiens
tgtcgcccaggctggagtgcagtggcacaatctcggctcactgcagcctccactcctgggttcaagtgattctcctgcctcaccctcccgagtagctgggactacaggtgcacgccaccacacccagctaatttttgtatttttagtagagacggggtttcaccatattggccaggctggtctctaactcctgaccttgtgatccgcccaccttggcctcccaaagtgctgggattacaagcatgagccactgtgcccagctgagtctacctttttttttttaggagttgtaaataaaacaagaaaataacactattagttattttattactaactatacaactactttaacataacactctcttttcccaggggtggggttgggtgtaaatgggcctcttgtagagatgactcttggtcatgggaattggtgatttataataattttgccatcttagggctgctcacagtatttggggccagagcctacgtgaatatatgtgtgtggacagatcagctgccatgttggttttggcagaaaaactactgaaaggtgagtgcaagagcacttccaaagttgagggagttaagaaagcaaaggggtactagtaaaagtgttttactgggaagtagagaagagggtaaaaattaagatgaatctggtttacttttaaagttatagtcaagcaaagggtggtattagaggtttctgctggactgaggatgggttgggtaagaatcaaaggacaggaggcctaatattctccctgcccttttttttttttttttaattagaggtagggtctccatatgttacccaggctggtctcaaactcctggcctcaagccatcctcccacttcagcctctagggtagctgggattacaggcacgcaccgccatacctggctcatccctgccctttttgatatacactttacctattcttggggccatgtttcttatctggatatctcttcagtttatacctaacttcctacacactcacagttgcctcttcttttctccacaggtggttcagaatctggggagccttatattccaggtgtctttttcagacagtttctacctgtatcacccaaggcaagtggcagtgtttagaatattctaaatgtggaatgtggcagatggaaaactatggcttgagcttt

SEQ ID NO: 74553 - DNA, 1051 bp, Homo sapiens
gtgaactctcacagtcccgtcttttggtaccctgtcctttagaatactcagtcactgagctacaagtttcactccctacctgagagtgtggggtggcccctaaatatagcccgagaaatctgagctacacttctgccccaccctggtattttggtccagggcagaggagggaggggtctggaggtgtggtgttgagggtggcagtggggatggtgagtatcaagagaagggctgtcctgattcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaaggttattagagaccgtttgactcccatgcccaaattccagacctctaagcatcccccttgccttctaacttcccaagcgtactgatcttattctaactcacaccactgcttcaccactaccctagtctctctccccatacactataattgggagtcaggcccttgtctcgtcactacactaaccttcatcctttccgtgtctctctttgtcaatctctttctgtctttggtcatttgttggtctgtctttacttgcctctctttgtctgtttgtctctccatctgggacgccacatggtcatgtgtttctgtgtgaatccgtgtgtgtctctccaggaggctgagttagctgcccgaatcctcctggaccagggacaggtaacagtgtgggggcagtcccaaggtgggaggaggggctgtcctcttccccagtagaaggatggcctctgcttggccctctcttctctctttgctttctttccttctattctagtcctttcccttccctatctctcccctctccttccttcc

SEQ ID NO: 74554 - DNA, 1601 bp, Homo sapiens
gactcagtctctctggtctcctctctggtccccgccggcaggaggctgggtctccgtgctcccgcccgccgcctccctccccagacccctcctcccctcctgccgcggccgtttcctgtggctgagactctcgctcagccatgagctcaccgcccctaatgggttgcagctgcctcgctgctcaagccctagctccgcactccctgccttggagcagacggccccactctgcctcacccccgcccatctccaccttccccccacccacgcgcactgcgtccgcctggtcccgggaacactgggggtctgtctgctcgcccacacaccttggggccgggtctgcgcgctgacgcactgaatgtcccgtctctggagtggttgccctaacttcccagacggtcaagacaaacgggcaactctggatggagctcagagaaaaataagctattttgttttatggcaaaggcaaggtatgggggtagggaaggtagagaccaaggtaaaggctgcattgagtatccccttccccatttacagcaaaaaagaaaaaaaaattccagtaaaagggacttcaaagactgtcttgaaaaagaagtttgcaaaggaatagcccaaggggtggttgtttaggttaggagttggagaaagacgtctcattgactcacttagggaggggagtctggatgaagcagggctgagtctttttgagactcctagtggaggttggcagagagaggtcccactggaatcagaaaagatcagctcgaatgcgcaccatcaaggcctcctcctcccttcccacaagttcctcttgtgacttttttctctttcaactgcccccacccgattctttgtaatccaatcccacatgctctaagattgggtgattgcttcagagccactgtgggagaaggaagagggatgctagaaagacccaagacagtcacagacagtctttccatcctcctctttccaccaaatgaccatctctagcatataaatgagcatctctctttcaccaaatgatcatctctgggacataattgtgggtgatggcacctccacctaagatggggagccctggatggtgggtcttatgggaagggatttgcaggatggctgtgtggaaatctccctcatcccctcgagttctcagccataagctcagtcccctgatagcccagaagcctgtcttttctctcctgggaaagatctatgcaatcaccccaactcacgagcacccggaacagccctgatcaggggcattcacaacaaattctccctggatctccaaagccaaggtctcagagcgggagtgttgagcgccctgccaggtttgtgcactctggcccagccccactcctgttctgggctcatcagccagcatttcctgagtgctcactttttgcccacattgtacaatcggggctttggagaacacagccaaccccagaccagtgcagctcccaaggagccatgattgggtgatctctagggatctgtagcctggtcctatctctacaggagcctgagccagtggaggactgtgtgcagagcactctcgccgccctgtatccaccctttgaggcaacagcccccac

SEQ ID NO: 74555 - DNA, 1029 bp, Homo sapiens
ggtgcagctagcagccctaccctggcaactgctgcgcccaggagacttctatctgcaggtggtgccctcagctgcccaagcaccccgactagcactcaagtgtctggcccctgggggtgggcgggtgcaggaggttcctgtgcccaatgaggcttgtgcctacctattcacacctgagtggctacaaggcatcaacaaggaccggccaacaggtcgcctcagtacctgcctactgtctgcgccctctgggattcagcggctgccctgggctgagctcatctgtccacgatttgtgcacaaagagggcctcatggttggacatcagccaagtacactgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaa

SEQ ID NO: 74556 - DNA, 1109 bp, Homo sapiens
ctctcctgttttctcactgttccaccatcactgcctaaccatgtcactcggagttggtatggagatggaagagcctatataaaagaataaccggtactcatacgacatttatgagtggcaggctctgtgctaagggcttttatgtattgcctcgtgtaatccccacagcagccctgtgaggtagatctatggaggcacagtcaggtttagtatcttgccccatgccattcagcaaggaggtggcagagctaagagcaaaaacctaggagatgggcccctcagcctccacttttaacaacttgattagcctctccaggcagaaaggaagtgaataaatggaaatgggggggcacagaaggaaaaggctctgcatgcacctgctggaagaagcgctgtagccgcagggcccgatggaggccactctcaacctgctccagccgctgttcaaagatatccagcaccttctgggaggtggcattctcctccagagccagggcctcccgtgcctgggccaggcgctcctggagaagggaggctgcgctcagacctggtcctcactcctaggtagtctccccctgcctcctctcacctgccctccagccccttctcacctggacctcagcgctgaaagcacggaatcgcagctctgtctcctgcagggcagacaaggtgtccccaggcatagcaaagcttgccagctgctcctcccctgggcccgagagccactgcaacacctgaggcagatggggtgggagggcagggggtcatggagtggaaaggcaaggaagggctgagatccagcatcagccccaccaccccaatctatagaactttgagtgaactattgcatctcatctgcaatgtgggaatgacaacagtgaatggtaatagtttccacaagggtcagatgagaaaccgagtaagaaatctttggtaaggcagatgagagggaagctgggctgatgggaagcactgagggagtgggtcaaagttccagggctatgtccgagggtgaagtacatcaaactggggtgaaccaaaagcaggatgagggtcatagggatgactgacggccttcaccaagccttggcaactggtgagaaacggtc

SEQ ID NO: 74557 - DNA, 1118 bp, Homo sapiens
gcagaggctgagtagaggcagaagtgcccacagaacagggctgggccccaaggtcatggaccacacatgggaggagagggccgtgggtactgagaaagagggacagatggatgaggctggaacagagaagggagagcacttggaagaagttgaggggatcactcacgtggcgaaggaagcaggccccaatgcgtagggggtgggtggcgcagccctgaagctcccgcagaaagtgtgtccggtggaagctgcgaagcctttcccgggcactcagggcagcagcccaggtgccccgaagttcaggcgtcagctcaggcccagggggtggcactggctcactcaaggtggccacgtaatcttgttcacaggcaatcagctcagacaccagccgctgctgggcactgcaggcacaataggagtggcagaggaggtgtgggagggagccagtacccccaacaatgtcatcttcttttcctactgggcagttggctccgcctcttagcaccagttgggctgggatctcacctgatgcttcgcttgcgctccatccggggggtgcctactccccagggtccgtctggccccctagcccggcccagcagcacgtgttcccgtggtgagcacgtcctgtctaccacctcagtgctggtgacctccaggcctcggatcagcacagctcttgggggcctgccctctgcttctggagccagctcagggccctcttcctcatagtcctctccacatggggccagggagcaatgggatggggctggccgtggcccagggctgctggggagcagcaaggagctgaggctgggcgaggggctgcggggcccccactgggcccctccactgctggcaccgtctgcccgccgtcgtcggtagccccgtgggctcgcctcctctcccacgtgttgctggatcctcctctctagctcttggcagcgggcctggcagcggccccattctcgcagggctgctgggctgcccaggtccagggccagggcccgcatctcctggaaggtgccggcactgggctctggggcccgccgcagggccagtgcagccagcacagcctcccgacccggcccagctcctgccagccgagcaaagccctc

SEQ ID NO: 74558 - DNA, 1455 bp, Homo sapiens
agtgtgctttctcctcatgccctaggaaccacccctaattccaaaggcatgtgtgtccttagtgggaaagtccctcttctagtctggtttggaatgcctcctaagtgttctgcatgaatgataaggaaaacctcatgaggtagaccaaagacagggacttctaacatcccctgacaccctaactcgatagtcgattacaagccaaagcctattctagatgatgcagattctgaacctctgttggggctgaatttccagaacatcctgagttctcaagaagagaatgacttcctgtcacctccaccactcactccaggaatcgtaccttaaaggcctgcttgtaaacaaacatctctgaccccccttcagggcccttgagcttgctgaacaggaggagatgctcgaagagaaagacatggcgaaggcacttctttcggccacagatgacagtgaaggggtctcgatgcaagagctgtccctgctccttcagatctatctggagaaaggaaaaggaaaagtggttggcccaggggccctttgtttgtattttacagggagcaaaaatagatttatagggcaagtggcctaatgcactggttctcaggtagagtcaggaagtcagggaagccctcagcctagggtccatcaactggtcaccatgcacagtgcacccagctgagcagcacagccctgcctctgaagacggcaaggtgctctgcatagtagggtttatagccacctgtggggaagcctttgcatgctggggatccaggaagagaatcagcaaagaactgaaagggaaataggtctattccagaggaggatacaggattccaacatgttctggaacctcagggctggaaaaagactaggtagacgagacaaggtatgtgttgggtgttgaggtgcaggaggaagtatggggtagatggggaaagataacaattaggaaaggaacaggagagtacaaggcagatgtacgaacatgggatgttgggaggacatagcttctttatttacaaatgaggaaagtgaagtccagtgaagttcagtgactcaatcaaggccacccagctggttagaaattagagcctggagccctctgacctggagcctggttctcctgtcaccaacctacacggcttctgaggccagggctgggcagtttgagcagcagtgactggagctagggcctcacctcacagccacgcaccgcctccacggccagcaggtctctgccacgggcctcttgttcccggagcagctgtacagcagccccaagggcccggcactcagaactgagctcaggcccagcttccctcaggagctcctccaggagccgcccataccgagtcagctgttccagaggctgctgcagggctcggggcaggtaagggccagcctccatggagccctaggttgaggacacagacagggatgaggggaggggtggag

SEQ ID NO: 74559 - DNA, 1056 bp, Homo sapiens
ggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctgcttccctctttgggtccttctgtcaggaaatagtcacctcttcagacacttagttatcacccaaagagtttgataagaaatgcagaatattgggttttacccccaggtttcgatgcagtagctctgatggggcccaagaattagcatttaacaaacagcc

SEQ ID NO: 74560 - DNA, 1465 bp, Homo sapiens
ctgcaagtcccaggcctagggaattttagcctggagaattttaaccctttcctgctcagagcatgtgctgagtccctatctgtgcagatggcccagccccgccccccgtccctcactccagcctcttgagctcagagccagtgtaatcctcctcttgtgtgagggagcctctcccctgcagagaggaggaaagcctgcctcggaacagccctggacaaaggggctcagatgccccatcatactgcaggctccaaggtttgaaacaaggggatgaatcctatacggtatttgcagtttttagccccttccccaggctagctgtgccccttaacttccactcctcccccaactctctcttcattccctctccctctggctccctcccccttcatgcccctccccctctgtctgtcttcagactctgctgctgggaggtgtttctctcccatgcatgaatgagtctctgtaatgaatggaaatgaatggatcaggaatccaggcggagggagggagaatgaggggggaaagacagaaagacagggtaagggcagaaggaagcactgtggaacctggaaggatgtttggctggctgctcagttagggatctcagagcaactggtcccacttggataaatggggagcatggcaagcccacctcatttgctcaccacactgcatagcccaacctacatgggagaggggcatattgtgatggtcttccccaccgccagggggtggggtggtagctgtggttgttctggaccatgcatttaaaatatagaatttggggaagaaatctggattatctgggaggcttgtaggcttggcaagtcaagaggtacagtttttgagtatagcagccccttcgtgcctcaagaagcaagtagggagaatggattggttttgggaatacagaatgctgagagtctgggggtagggagtgactttactgctgaaaactagggctcatcttttcctccaaatctgtctcttgctttagctccacagcacctgttgccttcattagcagcttttcctcctcttccctgcacttcccagaaccaaagaatgtgaagggggtccatggaggtgagtgaagctctggcttcaacctacaagtacctacaactgtatactccctctcctgcctacctctctctctctttgacctcccattattagaagttaactccttggccctgacatctcgattcccatacacctccccccaccccatcttcccgaggtgagtagcaccctgtgttcctagttcaggccccagcccaccttccctcgtgttgtccttctggccctcgaggcgacgcccttgcttcctttacagctctaccttcaccctttgctctacgcagatctttctccacagggctcacgtccccgcgccccgagcggccacttagcgccgtcgccgccggctttcgacggcgagctggatctgcagcgatac

SEQ ID NO: 74561 - DNA, 1652 bp, Homo sapiens
gagaaaaaaatcatgggatcaggtgtctggaacctggtttgatatggagatgattcagatcttcattgggcctaagaaggtatctcagtgagttttgttgattttaggccaccttctggggaaactttccgtgctggggaattcagcttcagtttgggccttcttgtatatcactctatttctgttctggaaactgctatgtgcaaagtggtttattgttgttttgttttgggataggaagctttgcccttttctgactcttcttgcctcagatatgaggccagcttcctaagagattttgcttgctatcctacagacagttttaggggccctagaatcttctcagaatgagagtatgtgcccataggttagtcagctatgaccatgcagtattcccagcccccccgccccacgcctccaccatctgcttcctctgaatataccagattggctgtacaccaggatgttccgggaatccccaggagagcaacagaatgtgatggacccaaatatgatgcctcagtaactcattccaggatgtacaaactgtaactgtcaggatgctccttatagctaattaaaattcttctagttacatctattttctattagctctttctattttcagtgacatctaaaaggccaaaataatccctctggtaccactgggtttttttctatggttttcagataggaacgaaaaaaaaatgctctagcttttctgtgttgtatctgcgatgctaaaatggcaaacagcccctctagcacctcatagctctatctatggtactgaggtggcccaagtggcttctgtggtagcccactgcactctccatggtactgaagggatgaccatttgttttaacatctctctggggtccaaaagagtcctgtgacttagaatcacaaacttttttcgagcaggaagggactaacactataaattagtccaatccccttattttactgatgagtaaactgggaggttaagtgatttagtaaaggttgtagggttatcaatgttcagactaggcctacaatagccttgtacccttcagtcctattctaattcaccttttgtgacactattcagtaagcctggctaggctcttagtcccaggaaaggatccagaggatgagagtgggtgccctaatttgaagctacagaaatacacatattaagtggtagtggaggtcgtctagtgacccttggacaaggacactttgttaattaatcatctgctaataataatcctatagcccagattccacatgtaacaggtacctgccccttcatggagttttaccacatccactaaatgtcaaaaattaaagaagccttggacctccagagccttttctctctgctgacaggcaggttgactcctggcacagttcttttctattaaagatccttaggcaaagtaatgcttgcatctttttctttctcagtaacccatttcagttttgtgatgcctattgtaaggaagttctttatatctcaaatatcctttcttagacaaaaaaaaaaaaaaaaaaaggttagacccacattcatttagccttgaccagatactattctatatgaggcagaaaggtagactagatgacttctggtcatcctcccaggtctgtttccatgaatcttgatt

SEQ ID NO: 74562 - DNA, 1850 bp, Homo sapiens
aagctggtctcaaactcctgggctcaagccatcctccctgcttggcctcccaaactgctgggattacaggtgtgggccactgtgtctgtcctgatagatatgtttttctacctattcgcacctcagtttattcactgataaaagggggctaacaatatgactgtgaagagttgttgattcagggtgggtgtttaataactattagtggtgctgatgaggtcacaccgataagtctgatgcccatacactaaaagtgttattcagaaggaagctggggacacatttctacagtcggaagcagaaccagctgggcccaaatatactctatagatcaaaacaaatcccagatctacctaggtgcccttggcaagttgcttaatctctctgttcccttatctataaaaggaagttaataataccagtctcaaggggttgctttcagcatggaagagagcttagcccagtacctggtacacaagtgctcaatgttagtggctatgatcatcatcactattattatttcttgttgttgacgataagaggagactgcgccagaagactctagaagttagtacgaggagggaggcagggtcctgggaggcaagtgatcttttgtaagccactcctgccccatcagtgctgtgccaacatcggcgggtcattgtatctactcttttctttcccggggagtgggagtcacgttttaaagagatccagaaaactgctgtgtgtctactcctcctcaattcccacgtgcattgattttatttggtggcgatgtgagatgttgggcttgcactgaggatccccgagcctgcaggccactggggaaacagacttcctgaagcctcatttttcttacttgtaaatgggggctaatttaattatagagggttattggaaagattatatactattagataggtgaacaggcattcagtaaatattgactaaatctgagtatactacttaccagtttgtagtctagactacaatcgcctggaaggaaggtaccacttctttctcatccctcacagcgctgagcccagtgcctggcacttagtaagcactcagtaaatatttgttgtattgaagagccattaaagtgacttgaggaatggaaaatagaattcgagaggaaggcgcaggaattgtttatcaagaacggaaaggaccgaagagtaactttaataatgtttcttatacggccgacattaactatctctataatcgcccctcctcctcccccaaaagagagacagaaattgtaagggagaggctttgagataaaaccccaggaagaacttcccgagtctgtgcatgttggggcagaaagagcggcagagccaactccttccctggtatgtccgggtttagggagggaggggcagtgctgcttggaggctgggggaaggacgagatgacctttcaaaatctcttccagtctcctgttggaatcctctgtgcgccccacccccgctccctcccttcctccctccctccgacagcgccccccgtctccaaaccgcccgcaccccgcccctggcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccg

SEQ ID NO: 74563 - DNA, 1060 bp, Homo sapiens
cgcgcttctgactcatcatctccaacccctttctcgcgcgcgctccaagtctcaggacttcggacctgggccctcctgcgagggggtgcggcgacagcatctgggaagccccagctctgccaagcgtcagctccgagccctcgccagtctctgaagctgccagcgcagggctggggacccagatccagctctctattgcagtggctgggggagcggcacgccagtgcaggaccgcccgcccggctcctccccgaacgcggggccagtggtcgcgtccgagaaagcgccaggctaggccccgacttccccgcctcgcgtcactcagcacatccaacagcgcccctaccgcggagagaaggctctttatttcctagccggtcacgggctagcggggcatcctgggacttgtagtctccgctacagtagaaaggagatggatcgaaaggggaactggggcactcctgaattggattcagggagttggcgtgtgcagggtccgggatttggagtggatgggattatgaaaggtggacagaaaagaaaagtgcgatgaggcaaatgtgaagctgtatggggaggtgacaggaagagaggatatggatgcaagggagaaagcagcttttcagggtggtgaggtgaggatatattctcgtccaggtgtatcttcccctaacagggaaggaacgaaaaaagggcctgctttgagtgaaaactgaaggcactcccggacttcctattggactcgaaggatcccagcaagcttctgagtttggtggggtgggatgcaggaatgtctggagagcattctctcagggtggaaggagagcagcacgtgtctgttcccgctgtcccaccctctcatttgctcctgtgctggccaccgtgggaccattctccaaaccaggaacctcttccaactcagagaagccctgaaaaccagagacaggtgtgagcaaattgtagaggtgagaaaggagaaaccccagacagaaacaactgcttcctcctgcccaattttctatcctgtttcccatagtcctgccaatatttaggcagcttc

SEQ ID NO: 74564 - DNA, 1048 bp, Homo sapiens
tactttaaaactataaaccacttcaggggttaaaaataaattgcctgtagaggtaagaagtagtttaaatgataatttcttaaaactcaagagccagttcagctatagttcttcaatcatcagtctgcattagataaacatagtaggaattcaggttttggatatatgttacagttcatgtagaccttgcaaagtccaagagtcttcgattaaatattaaattcttaaaacctttctgataaaacctttttcatcatatccctctagggcattggttctcagagaaaggtcatttcgttccccagaggatattttgcaaggtctggagacatatttgttagtcacaactgaggagtgggggaggagggaatatgtaacaatggaaggcgcagtagatgagaagtcagatttgggatttagttccagtgctgctaatgccgctttcctgtgcattatcctctgccagctgcaagcaaagactattggagacttgtcctgtgttcctcattattccccctccacactgcctattgccacagtcccgggctgctccatgacagcgttctgctttgctgcagtgattcccagcaaccactgtatctgcctctttcttcatcagtttggcagcctctgtggaggtcactcattttacttgaatgggaacttcactgaaagaagaaactgacaaggtttctgctgacgtcagtttttaaaggccgtgacccctatctattcttttaaacattaaagaaatccagttcatgatatgtggcttcatatgcagctgtggcacattggtggtcgggaaattctccatgtgaatacattttaccctcatttctttgaaattctgtcatttattctggcttttaatacgtgatcatagacaactgacagtatttcacaaatgaactcttttccgtttctgaatctgccttttggcaagatggctcaggttttgtgtccagggctgtgtcctctgctgccatctcgtggcctcttggctgcccaggttgaggtctcacaaagtgcctttcctaaggtaatg

SEQ ID NO: 74565 - DNA, 1015 bp, Homo sapiens
cagcccaatacaagccctgtttttagctttattccgagaggaactgctttgggaattatccccagtattctccttctttgttgcaagtaatgaaatccccttgttaaattttccttggttgtggtcattggactgtcactggccaagcgaccagctcacccattgtgtggtaacagtagcagttatatttgagactctattactcttcactgttacgctgctggtgtttataagctgaggctctgttgctttaggaatagtaattgaaaatttctttgttgctgcagaactctcatctttgacttgtagaggttttctaaatgaattaaacttagactgaacaatttggcctcaataagattctatcacagacttcttgggtgtgtcagcctcttgcttttgtttttctgcaacaatttgtttctgtttactattattgttagggtgaaatgtcttacattaatgtcatatgttgacattgggggtcatcttcagttggtaacaacttcagggtttgattattatcctcaaatttatgtgtgacaattactatagttgaattggtcagttcattagaaggttttaaaggaatacaatttttaccaccattgtattatttttgcttctcatgagtctgttgacattttctttaccagccatttctcactgaagtttcaaaatatttctctcttcttggaactggtcctcaaatgtcaccactctctggcctctattgaggttacatagctatggtagccaacttacagattccagcccaggtccttatcattctcagatgcaaaaagcctggacactatctgattttcctgtttgtatcaaaaaatgtttttcttcttaacagatgtttcttgagtctttgtcttattcgctctttgaacatgaattgggccttggaggccactgcaggtcttgggacatggcttgggtatttgtcacagcctaaggtgaggggatgcatctccagctttgactgcagatgtaggactccttcagg

SEQ ID NO: 74566 - DNA, 1073 bp, Homo sapiens
ttttgtgcagtaccagagaccatttcactaattgctgagtagcactaaggaaacagtgtgagtcaaagcaaaatgggtggaacccaatattgaattgtgattttcactacacaagaaaaaaaattaggcggtgttcactggttgtggcctgaaggagtcctacatctgcagtcaaagctggagatgcatcccctcaccttaggctgtgacaaatacccaagccatgtcccaagacctgcagtggcctccaaggcccaattcatgttcaaagagcgaataagacaaagactcaagaaacatctgttaagaagaaaaacattttttgatacaaacaggaaaatcagatagtgtccaggctttttgcatctgagaatgataaggacctgggctggaatctgtaagttggctaccatagctatgtaacctcaatagaggccagagagtggtgacatttgaggaccagttccaagaagagagaaatattttgaaacttcagtgagaaatggctggtaaagaaaatgtcaacagactcatgagaagcaaaaataatacaatggtggtaaaaattgtattcctttaaaaccttctaatgaactgaccaattcaactatagtaattgtcacacataaatttgaggataataatcaaaccctgaagttgttaccaactgaagatgacccccaatgtcaacatatgacattaatgtaagacatttcaccctaacaataatagtaaacagaaacaaattgttgcagaaaaacaaaagcaagaggctgacacacccaagaagtctgtgatagaatcttattgaggccaaattgttcagtctaagtttaattcatttagaaaacctctacaagtcaaagatgagagttctgcagcaacaaagaaattttcaattactattcctaaagcaacagagcctcagcttataaacaccagcagcgtaacagtgaagagtaatagagtctcaaatataactgctactgttaccacacaatgggtgagctggtcgcttggccagtgacagtccaatgaccacaaccaaggaaaatttaacaaggggatttcat

SEQ ID NO: 74567 - DNA, 1036 bp, Homo sapiens
ccttgctcctggcttactgcagtatcctcctgtctacccttcatccacttttatctctttccaatcacttgttcatacaacagccatattgggtttttttcaaaacacacatataatcagggcacttctcaacttaaaaccatttctggcattacttgcccttaggataatgacaaaactttttaacacagtccacaaggccagagatagcctgacccttgctgatctgtccagcctctgctatatgtccccttattttctctgttccaaccacattggactttgttcctcttactagtcatgctccccacctatttggttccctagttaacttctcttcatccttcgatttcaacttgtgtcacttcctccagaaagcctaccctttctttcttaaccaggccgataggctgtcaaaaccaggaatctcttcttcgtagcactacagtcatactcattgatacgtgtgattattaatgtgggttttttaaaaaattagaatgaaactcaagagcagggaccacatctattacttgtgattaatatattcctagtggttagcacagtgtctagacaaatatatgttgaatgaataaatagaaaagggagaggaaaaagggaaggattgaccctctgtgaggcagtcttgcaaacagcagaaatgcaaagcaaagctgaagaactaactattcaacacacacctagaggagcgttgtaatgtcttgtgcctgtctcaaatgggtgcattcttatgggtaagttttactagtccagctttcactgtaatagttcacattcctctcctagtgtcagtctccaacaaatccctcagtaattcgtaatcagtaatctcatgccaaggatgagagaggggcattatccaaaaagttgggtgtgtccatttttttttgagtcttgctctgttgcccaggctggagtccagtggcatggtcttggcttactgcaacctccgcctcccaggttcaagtaattctgcctcagcctcctgagtagctgggattacaggcgcctgcta

SEQ ID NO: 74568 - DNA, 2175 bp, Homo sapiens
aaactaaaattcagacagtgttcagtatgttgattttttttaacttttctatattgaactcctcctgtaactggaaatatggaaggcagtaaaacattacagaaggtctgatgcagtggtgcgtgcctgtagccccagatgcttagggggaggctaagaccctggggatctaggctgtagtgggaggatttcatgaggccaggagtttaagttcactgtgatcatacgtgtgaatagtcactgtcctcaggcctggtcaacatagcgacagccctgatctaaaagacattaaaaacaataaaaaccattacagaacgtgctttataatagaaccaagggcctttattaccgagaaatctgtactggctctgtttctccctgggtatctcctgtgagctcctgatgtagtctggtggcagtgtatttgctaactcatatcttcggtacatttgattttaatctagtattttgtttatattaaagtgaaaggagatgaccttcaggccattaagaaggagctgacccagataaaacaaaaagtggattctctcctggaaaacctggaaaaaattgaaaaggaacagagcaaacaagcaggtaaatgggttttctgcttgcccttggtatacagttgggttagttacataaggcacttgaaagtacatgttggaatagtggaatataaagcaatgtaatatgaaacttggggagtgtgaattgggaagggtatttgtgtgggaggatttagatttgtgctgcagttctgtgatccttagtggggattgtctacgtcctgtggacattactgcccctagacagacttgtccttctcatccgcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccaggtgaaaaccacgggaaaggaaagaaaaaggtggtggaggggggctcagggacacatggagtgcctctaactccatcctgtttgtgtctgtttctcacagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaaccctggttttttatttttgtattttattattgtttacttcaaactttgttttacagcgtcctccacaaaacctctagaatgcactagatatatttttcttggagtcataatcatgatgcataccaacacaacactactcaaattatatttcattgagatgcatgttgcattgaggagtcaacttgacatagagtggagactttttcaaaatggcttttacatcctaatgaaagtttgggaagtatatcctctctgccttttcatcagtgctttgtggtccagctggcaccctttctgaggtttgtgttttgtgc

SEQ ID NO: 74569 - DNA, 1077 bp, Homo sapiens
cttctgtgggtgaaaagaatcagagatttcgctaatgccatataccactgtttatatacccttttaattggaacattttaaagagtatttgaccgtatgtgaattgtttattgtaatgtatatttgaaaataataagatccaaaggctattcattataataaatgccctgttaatactgacactagtacagaggaatcatttatatccagtgccaaaggccagccaaccatataatttgatatatgttttattttcctgaggaaaagttgctacagtattacaactattttatgtgcctaggtaaagaaataatgggataagatttctaaaccccactgtggaggtttttgctggccttcttaatgaaatttaataaaaggaaacgactagagacaatattcacttactatttatcataaggtctgttgaattgtgctgagttaatgttaggtttgaatgaattccattttcctcttatccaataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagtgtatgtattatttcattttgtgattttggtatctcttgtgttttgagatagggaagctaatgcagttacaatatttttgtgccacatgactttgtgtattcaaaataatggaagaggctgggtgtgtggtggctcatgcctgtaatcccagcactttgggaggcccagcgggtggatcagctgaggtcaggagttcaagaccagcctgtccaacatggaggaaccccatctctaccgaaaatacaaaaaatttgccggggatggtggtgcgtgcatgtaatcccagctaattgggaggctgaggcaggagaatcgcttttacccaggaggcggaggttgcagtgagccgagatcatgccattgcactccagcctgggtgacgagcaaaactccatctcaagaaaaaaaaaaaaatccaaaataacagaggaga

SEQ ID NO: 74570 - DNA, 5144 bp, Homo sapiens
tcaccatccgatattattaaatgtcctatattttaggttatataaaaagtagccttcgagtcattgcagtctgtaaaaagatggtattgatacttatgtatctaaagcatactgcagattaattgaagtatctggaaataggtgtttccagtgtaaatgaattgattctatttattgccttttgaagaaaattatacttaatgggtaagtgtaagctatccatattaatctagctaatgaatggcttgggacagaatttgacgtttgctatgctgtgtgtatatatacagaaccggtgaaactcaataaaagcaacgtgaatcaagattattgatggcagggaatagttagcatgacctgtaatgtgaaaaacagcagaaactggtgtcagagaatttaggcaaatctaatttgcttgagtacttagaggagggccacttggaattatgtccaaggaaattatattgccaatgatctgccagggagaatttttttttcctgagaatttagagtttagtgctgctgaaatagaatggaagaggaagaagttgactttctagagtatattcagaggctggagtctctgaaattattagcaaatacatacttaatgctgtgagtccctttaagttgcctaatactctgggcagttaacagtgattcagagtgagagtggagaatgttttatcaaggaatattgtttttagcatctgttcacctgtatacttttttttgctttacagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttaggtaagtgaattttttcattgatgatgtaattcaggcctgagtttttctattcacgttttttttttgtctttatgtctgtaaaactgacagcatgagatattctggatattgcgactgtttagcctaataaaaatacattaggcttatagttataattggctaagtaaaggatattcttcattgtaccattttgtgtagtagagctaggacaactctactacaatcgtgagtagggggagctgggaatgacacttcacaatgtaaaaacgttgcctaaatggttgtgtcctgcccacagcagactggaggagccctctagtgttgattgcttgtctccccattgggatttcactccatccgttgggccgactgcagtttggctcagtgttagattttcttgtattttaaaatgtaatgacacctcagagtacttactacctatgatttggtttattcaagccagaatccagtgtccacatgtttattttattagttgtactagatgtctgttttaacttctcattttatgtgtaccttgtgcctcagtttcaaaattatcatacctttgtttttacaaagttaagatgattatttttaaatttatatttgtgatttagtttattctttgtatacattctactatgtatattgactcaaagcatggtaggttagagttatgtgaaacaattctttgataatgttatgtaaccaaccagatacataatttgggtctatttcattgtttttacatcttactggattgctttttcagaaatttaattctctttagttttgaaacactttatatggtttcaaagtcagaattgtaaatgaggttaatgtaccaaaacctgaaggttattcatgtaatggtgttcagcaaatagacaatatattcagtcctttttttttttttgagacagagtctagctctgttgtccaggattgtgtgcagtagtgcagtcttggctaattgtaacctcagcctcccgggttcaagcgattgtcctgtttcagcctcccgagtagctggtactacaggcatgtgccaccacacctggctaatttttgtattttttagtagaggtgaggtttcaccatggtggccaggctggtcttcaactcttgacctcaggtgatcctcccgctttggcctcccaaagtgctgggattacaggcgtcagccattggacctggcctgagtcagttttcagttggtcatttgatgagctgcttttgtataaaaagggaagataaataagattaagtttaagatatccacatttggccaggttcggtggctcatgcctgtaattccagcactttgggaggcttgagttgggcaggccatgaggtcaggagatggagaccatcctggctaacaccgtgaaaagccatctctattaaaaaataaaattagcaggctgtggttctgggtaccggtaatcccagccgctcaggaggctgaggcaggagaattgcttgaacccgggaggtggaggttacagtgagccgtgattgcactccagcctgggcaatggggcaagactctgtctaaaaaaatacccacactcatctagttaatggtttgaggtggaatttggaatttatattttggggcatttgtatattaaaatgaagctcattttaataaaagcagtatatatgaaaatggagttactgttgactcgagtgctgtagcatgactgggaaggtaaactgaattttagagagtttttggctttttgacatgggctttttagaacaaggagaagataaattcttgtttggtaggcagtgggtggcagggtaggtagctgggcatacgtgttacaaattgtatttgaaaaccagggttgtttccctttgctcttttattttttttggtgtgtgtaaaggttgtttaagcaattgatcaattattcagaaagcagtcgttaacccaggatattttacgtgtagaacagctaatccttacttataaagaaaatctgaagttgcctttgaggatgatttgaggttgtcacacttcactatgttaatttgtgaattggcatatattttaatatatttcattctaatatatttgtaataattcggaatgagctgaaccattcttggaaaggcaaccagtgatagttttctcttgtaatagtaactgagtgaacagtcagtaccttgaatggggagagttgagttgaagtggtatctgagggtggagagtaccaaagacagacttaatgttagtctcaggaacacttgaatggtaaagaacagactacaaagaaacggaagatgaagccttagccttgtaaaaatttgtgagcctttttaatattaaaaggagagatgaagctgagcttgatagctcacacctgtgattccagcactttgggaggtcaaggcagatcacgtgaccccaagagttcgtccctacgaaaaatagaaaaattaaccaggcgtggtggtccctgctacttgggtgggaggatcacctgagcttcggaggtctaggctgtattgagccattattgcatcactgcactccagcttgtatgacagtgagacagtgtcttaaggaaagatgagttgttttgttccacattttctaatttatgtgtctgtgtgattttctaaacttcgtagtttgtattagctgggcatggtggtgcccgcctgtagtgacagttactctcgaggctgaggcaggagaatcgcttgaaccgggaggtagaggtttcagtgagccaaggtgacaccactgcactccagcctgagcgagaaagcgaaactatgtctcaaaaataaaaaaaataaactttgtagtttgttttacccggatacaaagttgtcattaacatttttacttttgtttttcagatattaacctggctgcagagccaaaagtgaaccgaggaaaagcaggtgtgaaacgatctgcagcggagatgtacgggtcagtaacagaacacccttctccgtcccctctactcaggtccggaactttattatttataactgcattgtgtccatcagtgggcatcttctctttctgttttctgggtgtggggaggtttaagtgtactgtgttttatctgtgtataaataaggttttattatttttgtgttaatatgtctcttttttgccctagagaaaatttctagagaattaaaaatccctgaggtttttgctattgatattaaagagtagtttgatatttatagcataacctgaaatacttatacaggatcgttgagcttctaagacactagagagtaagagagggtagaagtgtggtataagaatgcttagtttaccattctgtttttcagtgtttagtttagctatgtcgtatgtggaaatcttagcgaattttaacctgaatttccaatttgaccgctacatttccagtggtctaaggtgattggaattgagtgatttattgtatgaatgattggggatcattcagtgctaatcttgttgatctatttgttgtggtttatttggcatggttctcccctcacctgacattgtgaattagtagaaacatttccaaattaacccttttcggtatttatttttcagctcctcttttgacttggactatgactttcaacgggactattatgataggtatgttaaaatgttttgtatttctgctaaacagctatttagtgagaaccatttcgttcttctggtttgtggtgatgaacatcaaagatgttttcaaacatactcccctaactccaaaacaaaaaaacacctttttctaaatcattaagtagattattaggtagggtgatactgattttaatgcattatttcataatccctggctaacgtggtgaaacccgtttctactaaaaatacaaaaaaattcgctgagtgtggtgactagggactgggttatgggtggctttgggtaacagatttagaactgttgatagcaaatgcttaacaggaaataggatgatgtgcttaagagtgttaccacattgacattctgataacatcagtctcagttaacatgaaggaaatgttaagacttatttggcttgtcgcgttcaaactcatgcagtatatgtaagtatatggagcaaactattgtatgcaatagacttta

SEQ ID NO: 74571 - DNA, 4017 bp, Homo sapiens
cctgggctcaagtgatcctcgctcctcagactgctaagtagctgggatttcaggctaccacaccctgctaatgttttttgtttttaataaagtctcgtcatgtttcccaggctggtctcaaactactgagctcaagccgtgctctaccctggcctcccaaagtgttgggattacaggtgtgagccaccacacttggccttaaaatattttaatttcctcaaatttacaaaggagaataagacctcatggctaaattgaacagtgagtgcagctagttcattgtttgcacaaggaactacagtctaattgcagttcctattttagctgatgaaacaaccagtttgtcatggaaattattttagtgtggtattatgtaccagatttttagaatccataacttgaaattagctttacacgctacatagtaaatagtggactacagaaacaaaagtattaacataaggaccttaatttttttcacctattttatgaccttaaatattcagtatttttttaattccatctgtattttcgttttgtcagtgagtggaataatgtgctccttatttaaaacatcttttcccctaacagtagaacctattaggtcttgtggtttgatcactcactggttttgagaatagatgagtcatctctagtatagatcttcatggtaggccattcaccttcagtctattactcatagcaaaaactccacggacttttttaagtttaaaacccatgaatctgcttaggttttataatctcagtatttgacatttgctcactatttcatctctatttgttggcccggtttttctgtattttctttgcccaaactgctcattatcaagatgaacatttgggatatactctttttgagaccctcaagggcatattgacatgaatttagttaattttagtcatctattgatgttgaagaattgtgaagacagtcactggtagaggtgattctatggaggctatcccatcccagtggaatgttaatgctttaccaaaatgtgttagctgcagtagacagatgtttctgtcttgggggtttagggcacaacatttctgaggaactctgactcaatctgtcccttctcctttcacagggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacaggtgttttttttttaattgtttccaaaaccgggacctggatttaagatgtaatttttaaaatttctatttctattttttctgcagcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcccgtttttctaatctgggctatttttatttttgtttttttacagtgagatttttttgatcttcagctacagtaagttattccaatttttttttaacatttttcctgactttccgctgatttcctttttattgttgttactagttactattacttattattattatattaatacttatgatggtgatgatgatgatgataatgacactgatgatttttaaccggattaaaatcgagtttttctgaatgtttctaagaatttctccggcctcctgattgactttggagttttgcatcttgggagagaaagcgaaggcattagtatttttaagtggtttgatcacgtaaaccttttctctcccaaccccacccttgccctcatccccttccccacactgaaaagaattttactggctgttaagtctatgaccttatttttcctgatctttaacttaactgttttagagcatctctggacgtctgtatttttaattttttttatttttgtttttttatttttaatctttcatttgttaaatttttaaactgtgctgcaataaaatgtgtgtggtactacttaacacttatgatcgtgatggcattttccctgaaagccatcttcctcctgtttcccttgaaatcccatcctgcttttcctgtacactacccctcacaaaccacaagctgcagcaacatggatgcccagcctggagcagcagcagccaggatgacctggagccaggggggccttcggaacagatgcacacccttcctgggtgatggtaagaggtgtgaggtccacttggattcattacaaagactaggaaataaacccgtttaacagtttagctgatgtgtataggtcatagcatctggaagtgtttgaaacttttgtgtgtgcatcttgaggtgtttcccaagggggaccacctcagttatttgtaaactaatggaataatatgagttgctaattaacttgggctgattagaacattttggatacttggaaagagcagctgaagtttaaaatgaaagtggcttgttttaatgattagcaacaagaaaacatattggggagtccctttttttagattgttacaaatcagtaaacattttctgtcatttaacatattccttgggtttgtgacatttttggattatattctatttagactttttatctcattaatatttcacaagagtcaaaccataggagatacaacataatattaaaatgctgtctcactggagggcttttaaaaatttgaaaaaaggtaggctttttgacctcacaaagcagggaaatctgtttaacctctacatccaaattaggaactgtctaaggctgaccccttttacagtggtgactcaagacccagctagattttgggaattctaatgtgaattcatagagttctaatgctagattaggaactctaatgtgttctgatgttaagaaggagtgtattctgtgttattcacaggaatggtgtagagattagtaaagatgtggatagccaaagagaagttgagcaacccgtagtattttactcactgcagcaaaatgttttgataaccattttagagttgctctgataggtttcaagctgggagataattagattttattttaaaatatttctattttttgtagagacagggtctcgctatgttgtctaggctggtcttgaactcctgggctcaagcgatcctcctgccttgacacccccaaagtgttgacattacaggcatgagccactgcacctaacctggaataattttttgaaggcatattcggtactgttgtactagggtaaatcacaaacttgcccccttataccatactcggatgaaaagtgaaatctagttaaagtgaacaccagaggtacactcaaaacagaatgggagaaaaagcaaaagattcctggaagttatctagaaaaagaatgggaatctttattttttaaataagtgcaagttttattgatgctctctattgtatgagagctattttttcttctttgctgctgtcagtgtacggaagctgttcactataggttcagtttgatttattccttgttaattctacaaatttattatttttatgggacatgttgtgtttggggatataaaaaatagtttattatgtttaagggcttcgcagcttagtgagggagacacatgaatgaaataatgtccatatatgatgagaggtaaacacatatcctatagaagcatgccaaaataagctgggggcgttggtacctgcctgtaagcctgtagtcacaactaattggaaggctgaggcaggagggtcccttggcccaggatttgagagactgtagtgtgtgatgtgattatccactgcactccaggctgggcaacataatgagaccccatctttttttttttttttttttttgagacagtctcgctctgtttcccaggctggagt

SEQ ID NO: 74572 - DNA, 1060 bp, Homo sapiens
atcgcgacccctttcttaaggcttaaacatgtatattattacaggaacttaaaactaaagtttatcattgtgctgaactgttagaaatgaggttagggtaaaaatgggaaatcatgaagtaaaaatgttggcaaggagaaatgtcagaaattagtatttaagaactgttaatagtagttgaaattgattgacgggcacttttctttgaggttttcgaaaatgggttccttccggtcagtatgtatatcagcgcaccaaaaattctttgagttaatatccgaaactgtttgccacggtatttatatcacaattctaggtgtgttctcaactagataggcgtttagtaacattttcatattggctagggggaaaagttgaagaaggatggccaggttgcaggttttctgaccttttttttccccctcatgctagtgccactctcgggaatacttggtggttgatgttccttctgtagagaatttaaacagcttacgtttgtaattaaatctctagaggatttgacatggcattcgaccttgttttggatggaatggctgtgcgaaacaagcaaagaataaactccaaaatagctagttgctctaattttaaagactaaggggcaaattattaaatcttaataaagtgttgaatgtgagaggtgttggctggggagtaagtttgcctaggagttaggagaaatagattttaatcctccttaggcaaataaggggacttagacttttttttaaaacctatttgaatttttagtttctaattcaaattttttgttgccagaagcctaaaaactgtacagattgagttttattaaaagcagttttgttttttttttttttttttttttttttttttttgagacggagtctcgctctgtcgccctaggctggagtgcatgtcgtggcacaatctcggttcactgcaacctccgcctcccgggttcaagcgattctcctgcctcggcttcccgagtagctgggattacaggcgtgtgccaccgcaccgggctaatttttatatttttagtagagacggggtttcaccg

SEQ ID NO: 74573 - DNA, 1651 bp, Homo sapiens
ccggatgtgagacggtgcgcgatacaaaggcgagtttccacccagagggtcgtcccgtgcaatagccaataagcattctccaggcaataaatgacaggaaaactaaccagttataaactagtttctctcacgcatgtggaaattcgcctgcttagtctaacccactgctaattgtgattggatatcattgtgaggagcggttgaactgtctaattaggagcgggagcgaaaaaacgcacagccaataggaagattctcaggaatggggcggggactaggccttcgcctcggcggcagaggagactcgggggccattttgtgaagagacgaagactgagcggttgtggccgcgttgccgacctccagcagcagtcggcttctctacgcagaacccgggagtaggagactcagaatcgaatctcttctccctccccttcttggtaagtggagagggcggacgcagggaaggcgctgggtttttcgggaagcgagagggggtgtgggagagaagatgtgggaatccttccccctaactaaccgggccctcatttattctgcttgttttgggggattaggttgaagccgggggcagttttataggcctcagcctctgtataggtttaacctggtgtcctctaggccacgatcgccagggaaaatgtccttttttcgctcttcctgtgttaacggctgctttcctttcattttctacgaccgcgaggactacgggatcatgaaaatgaagatcgtgatgctcattaatatagtcgaagttaacgtagcgccgatgccttctattacctccgttcttcttacatgtaaaaagtgggggaggggaagggggaaggttaccaagtagatgtatcgcgagcctttaaatcctggatcgtgccgcgtggcctacgagaaaggtttaacaaaagattcagcattttactgataactttttattttatttctctctatgagcaaatgatggagctcgaagtagttattttcacttacatttgtaaaaggaaatattgtgatataactatattaatatttacagctgacttttcatctgcaggttacaaaacacttgaaatatataagttagtggaactttgcttgaggtaggtattaactctctttctcagacggaaactgaggcagaaaagtgttggttgctagggtcatattaagtcagtagcagcactagtaaggaatttgaccacgaggtcagtcgagtggtttttacctagttaatggaatacctagttaatatagttctaaaactactgtattgcaatctttgccaagaacctgatgacggaaaccacgaggtaactggaaattcccaaattgcgcttaagaaaaatactacgagacttgagaattttttaacgtaacttcctaagtgtaagatgacaaaatttgactttcgggatattctggcgttaattttcccgtccgcctaaatgtgggcaaaaattcacagctacgttatattaagcaaatattaacagtgcctattatttgctgggtgctgaaatttgataaaaaacttaaaagttaaaaaaaattgtttagatctttagtgtcacattgacttatctgggacatcgctttttttaatcctcacatgagatttggctaagtttatttttca

SEQ ID NO: 74574 - DNA, 2035 bp, Homo sapiens
atcgcttgagcgcaggagttcaagaccagacatgagcaacacggcaaaaccctatctctactacaaacacaaaaaattagccaggcatggtggcacatgcctataaccctagctacttgggaggcagaggcacaagaatcccttgagcctggggaggtggaggttgcagtgagccaagatcgcaccactgcactctagcctggacgacagagtgagaccctgtctcgaaaataaataaataaataaataaataaataacctataagattaggtaatggattaggtagtcacaaatataaattatactcaagtacataggaaattcattaagagtaaattaactcaaaaaagttattaaaatattcagcatcagcacaaaaccaaactcaaacttttgaatttctgtctcaatatctcctttgtttcaaagtggaaagcagatgcttactgtccttgatcaggatcttgtccattcagcatgtcgaacagaaaccgccttcggccttgctgctcctgtgggtccaggtctattactgtattaagggtaagagaaaaaagcaaagaatcatatactgttgcagtgtgagccccaagactttcattagtggtattcatggtagttttcataaaaagattagactccttgcctggatctagaataacatggaccaactgctttgaaaatcatttgtgtgtgtgtgtgtgtgacagattcttactgtgtcaggctagagtgcagtggcgtgatcttggttcaccgcagtctccatctcccaagttcaagcgattctcctgcctcagcctcccgagtagttgggattacaggtgcaccccaccatgcccggctaatttttgtatttttagtagagacagggttttgccacgttggccaggctggtctccaacttctgacctcaagtaatctgcccgccttggcttcccaaagtgctgggattacaggcatgagccactgcacccaggctccttcgaaattctgaatgaaaaagatttccacacttgaatcaaatatgagggtaggaaaaaaagatttcatgcacgactttctcaaattttcacttgtgatatgccctttctttaaaaactactgaaaatatgatccattaaaataagaaaataaattagaggataaccaggagataagaaatctggtataggagagaatttgatcgtattctccatgagcagcagtaataatgaaacagtgggctagagcagaacaagaggatggagagaggtcttcaggaaaaaaatagatgagtagataatttgacaggtttgattatttcaaaatttgggaagactgttgaaggacacgaaaataattacaatatgtataatgaaaataaggcgaatgaaaaattgctgcaaaaaatacgtgtaaagaaatataatcattgcatactacttggttctgcaagaattaatatttacatatccataataacagaaccaatttaaatggatttaaataaaaattatgatacaattacgatgggaaggaaagggacatgagtgtagtgcaaaagagctaacttttaaggtccgagataggaagtctaaagccggtgaatcaggagattgcaatagaaatgttactcagaagccaggtatggtggctcacgcctgtaattccagctactcaggaggctgaggcaggagaatcatttgagtccaggagtttgaaaccagcctgagcaacatgttcagactccatctcaaaaaaaaaaaaaaaaaaaaaaaaaaaaaaaaaaaaaaaaacaggaaaagaggaagaacaaaaatcaatactcagaaatatgatggaagtaaataacagaagaaatggctgagataggatgggcttggtggctcacgcctataatcccagcactttgggaggccaaggcaggcagatcacttgaggtcaggagtttgagaccagcctggccaaaatggtgaaaccccgcctctactaaaaacacaaaaaactagccaggcacggtggcgcacacctgcaatcccagctacttgggag

SEQ ID NO: 74575 - DNA, 3161 bp, Homo sapiens
ccatctgggagaagctctaaacaccacttgatattattgtttcttcaaattgataaattgattgggcagtggtaactaactcctgacaagatttcttggaaattacaaaaacttttcctcaatgagtttcttagcatttagggaaaaatccttcagggcattttgcaaaaattattttttaaaaaatgatccacttaacgtttgtgtgatacgtaaatacagaaagtctttctgttgttaatttccctgggtgaggaaggctaacgtgaatttttcagaaatgtaataatacataataatagtaaaataataattgcacctgaccactaattttaaacaagtcattttatctcttgatccctcagattattttgctcttgttttcttcatgtaaatactggtatactatgtgggctgaattaattcattaagttaataaggtaaatgtcaaaaaaaaatcagtattatgctctaactcaccaggggagtgatgctgaagaaggggattcagagtctgaaattgaagatgagacttttaatccttcagaagatgactatgaagaggaagaggaggacagtgatgaagattattcatcagaagcagaagagtcaggttagtcttacagagcaaagttcgtcctggcttcctaatctaatgtcatttctgaaaactactttttttagactaagaactctgtcgttccattctgttcccgcatgatgactaacgcttaattaattttcttccagactattctaaggagtcattgggtagtgaagaagagagtggaaaggattgggatgaactggaggaagaagcccgaaaaggtttttaaaaatgtgttgttttttattcatttgtctacgcacaaatttctaacacatttcaatattttgaggtgttagtattgatggcgtaatgaaagtaacaaaagaacactataaaagtgctttggagccacagatacaacttcattgactgaaggagaaaatgaggtgtggaatgtgtccatactctccagtgggcagtgctctgccaaactggatgctgttttcatctgcgcaagcccccatctttcctatagccatgatagccacatattcatgtaatactcaagaattagcctactcagtttccaaacctaaatcctataatactttaattttctaggcttcttccaggttaggcatgtctttataatgctaatctagttactctgaagccaaaccccaaacaaacgttttaaagcttaaaaggaaataaatattaactgctgtgttccaagcattgggaataggtagttttcataggttaccttatttaacccttaaataattctcccttttgtaaataaaccaaggttcagaaagtacttgcccaatattaaaacttgggtctgattccaaagtgtattctctgtactatctcatgctatccagtaatattaggtacctaaagcttacctattgctaactaataatgcctcttctatttagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttatatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgtaaattcacctgtgaccgttcattttcagttcttgaaagcaagcctgcttcctgcctggtaaagtgctaaggtactggagaaaaatgcctttagctagctagttttacaaatgaaactttcatcattctaaactttcatcattagattgagagacactagacatcacagtaaaccaaattcatgttatagcaagctaactttataagagactttttactatggttccctcagagacttttagattggaatagcacttgttccttcatgaaaacaaatcttcagtcatctccttgtaaatagcatggaggacagcagctgcttgaa

SEQ ID NO: 74576 - DNA, 1026 bp, Homo sapiens
gaggctgaggcgggagaatggcatgaacctgggaggcagaggttgtgggccaagatcgcgccaccgcactccagcctgggcgactagcaagactccatctccaaaaataaataaataaataaataaacaaccctgaatctgtttgtgcagagcaactcaagtatctgctgagatagggtattacaagagtttaggcttaggttgcagactcagcttgacaggtaatggcatggtgaccttaaatattaaaggtgtatgtacatgttagttttatagttacgagagaatgaagggcaacgaaagcacttcagggatgatctgtgcagcaaaccaccatggcacacgtttacctgtgtaacaaacctgcaaatcctgcccatgcactcctgaacttaaaagttggaatttttattttaaagcacaaaagcacttcagactttttgaggggaggtactgttaacaaatgtgatggctgtatttgatatttttttcttctacagatggaacgagaaatgaggcacaaactgaaaacagcctttaaaaatttcattgagaaagtagaggctctaactaaggaggaactggaatttgaagtgccttttagggacttggggtaacctatcttatttttggcttgaagtttgactggtctgtcttttggtacaataaattattcttcctttaataataatttaacatatcatatccttttttcctatgactaataatctttgagacatccattttttcttgaaaatgtttaagggtttaggtgagtggctaactcttaagaggcttcctctggatgagtctccagtgagtatgctggagctgtttggaatggggagagggaagaagtttgtctgttgtggtaggagcagtctctctcgtgatgagctcagtcttaaaagtttgtctcttccagatttaacggagctccctataggagtacctgcctccttcagcccactagtagtgcgctggtaaatgctacggaatgggtgagtgtttcttactttcttttag

SEQ ID NO: 74577 - DNA, 2676 bp, Homo sapiens
tggggatgttataccagatttgaaaaatgaaaaaagaaggaatgggcatgcatggtggctcacgcctgtaatcccagcacttcgggaggcagaggcaggcagattacatgaggccaggagttcaagaccagcctggtcaacatggcaaaaccctgtatctgctaaaaatacaaaaactagccgggcatggtggtgtgtacctgtaatcccaggtacttggaaggctgaggtgggaggatggcttgaacccaggaggcgaaggttgcagtgagctaagattgggccactgcactccagcctgggtgacagaggcacaccctgtctcaaaaaaaaaaaaaaaaaaaaaaagcaaagtagagattaagctgcttagaagataaagtaaatcagtacaatttccctggcctgaaaaagaaatgtctataaatgctgttgcttttctgcagtacataccgagcatcaaatattaaggcacccggagaacagacagtaccagccttgaaccttcagaatgctttccgaattattaaagaagtacagaaacgttataaaactcgagaagctgaagagaaagagaaggaggtgagcctgaacacaggcaaaacattcttacacaaagaaggacatgtattttttggagacttgtaaggatatgtgacaattcacattaattttcttcttgcttaggggattgtaaaacaagactcactggtgatcaatctaaaccggagtaatccgaaactgaaagatctatacattcgcccaaatattgcccaaaagaggatgcaaggctcactggaggcccatgtcaatggtatggatgatctctcctgtacctaggctttctcttcagggcacatttgttaggaatgacagatcagataataaaatatgacaaagagccatccgccggttagctcagttggttaaagcatggtgctaataaagtatgacaaggaaatgctgggaggaatctacttacactgctgtgtggccagaaggaaaggaaagctctatacagctgttggtgtttcctctgaccctgtgcaaatcagccagaagagttgcagtgccttttggcctaacttaattatactgcttgacatttcttcattcttttccccaggcttccgcttcacatctgttcgaggagacaaagtggatattttgtacaataatattaagcatgctttgttccagccctgtgatggagaaatgattattgtcttgcactttcacctcaaggtatacctttctacttaactagctgtcagctcttgggcaagacacttcatttcactcagcttctttcctataaaatagtgatgaaagggctgggcgcggtggctcatgcccacaatcccagcactttgggaggccgaggtgggtggatcacctgaggtcgggagttcgacaccagcctgaccaacatgatgaaaccccgtctctactaaaaatacaaaaattagccaggcgtagtggccagcgcctgtaatcccagctacttgagaggccgaggcaggaaaattgcttgaacctgggaggcggaagttgcagtgagccgagatcgcgccattgtactccagcctgggcgacagcgtgtgaaaaacaaaaaacaaaaaagtgatgaaaaaatcacctctcacttaagaacatttaagaggattaaataaaataatgcctctaaaggccacaaggcctggcatctagaaggggctcataagcatgtttgttcctttggtgtgttatatggtggccagcaaatgttttatacgagatctccagatttctctttctaaaatgaagttttgctttagataagatttgttaccaacatgatttccaaagttcctgtaataagtaggagcacagcactttttcaaatgtacactgtttccattcccaagcatcattatttatgatgacaccaggggtggtttaattatttttgcatgcatgctgtggaggcccaagtttggatcactgccatttccatcacagatacctttgtgtttctgacttctgtgttctttctgttttatgccgacagaatgccatcatgtttgggaagaagcggcacacggatgtgcagttctacacagaagtgggagagataaccacggacttggggaaacatcagcatatgcatgaccgagatgacctctatgctgagcaggtttgtgaaatttagtattgtatttgcaggatagtgagggaggatgaggccaaatccaagctcagggattgtattttataaacaaactgggctggcgtggtgactcgcgcctgtaatcccagcactttgggaggccaacatgggcagatcacctgagggtcaggagttcgagaccagcctggccaatgtggtgaaaccctgtctgtactaaaaatacataaattagctgggcgtggtgggtggtggtagtcccagctagtcgggaggctaaggcaggataatcacttgaacccaagaggcagaggttgcagtgagctgagatagcgccactgcactccagcctgggcgacagagtgagactccatctcaataaataaatagccaggtgcagtggctcacgcctataatcccagcactttgggaggccaacacaggcagatcacgaggtcaggagatcaagaccatcctggctaacacagtgaaacgctgtctctactaaa

SEQ ID NO: 74578 - DNA, 1808 bp, Homo sapiens
tgttgcctcccaaattgtagctcttggctgggcgcagtggctcacgcgtgtaatcctagcactttcggaggccaaggcaggtggatcacctgaggtcaggagtttgagaccagcctgaccaacatggtgaatccccggccctactaaaaatacaaaaattagccaggtgtggtggtgcgcgtctgtaattccagctactcgggaggctgaggcaggagaatcacttgaatccgggaggcggaggttgcagtgagctgaggtcacgccattgcactccagcctcgttgacaagagtgaaactctgtctcaaaaaaaagaaaaagaaaaaaaattgtagctcctgacgagaggttagaggttagaaggataaaaactatatttattcattgtcaaacattttagtgtccaaaagattcaaagcattgcccagccgtttactaggttagaaaatgaaattgcctcttttaaataatgtgtcttcattctccttttaattctaggatggcccagctactgttctcacttctgtgaagaagaaagtgaagaatgtggggattttcctaaaggtaggaagaagatagataagtagtataggaagtttaggatataaagaagttaaataatattggctaaaataattaaaatttcattttttgattatgactttttccatagaatgaagatgaggaagaagaggaggaggagaaagatgaggcagaggaccttttgggaagaggttctcgggcagcattacttacagaaagaacaagagtaagtttactattttaaattacattgatctcggctgtcatatggctcacgtgttgtgataaattggattttccattcaccagaatgaaatgactgcagaagagaagcgaagagcacatcagaaagaactagcggctcaactcaatgaagaagcaaagaggcgattgactgaacaaaagggagaacagcagattcagaagtaagagttttcactgagcagtgagatcatctgagggttctgtgggactgcagaaatttctcagttgtttttttatcccactccagagctcgcaagtctaatgtgtcctataaaaacccatctctgatgcctaaggaaccacatattcgggaaatgaagatctacatcgataagaaatatgagactgtaataatgcccgtgtttggcattgcaacaccgtttcacattgccacaatcaaggtactgacattcagtgcatcaggtttcatccaaactgttgcttaaaatagtaattgtatttgccataaataatctgcattcatcatgtctcccacttttgactccttcagactctgttcagttactgacatccctcttgtcttgtcattctccttcctctttcagtttttttcacttagtagaaagctaaactagtctagaaacataatttgcctatctttctttcaacttcgtttaatcattgtttaacttttagttgtattcatggtacaaggtactttgagaattcagagatttttttgggaaaaggatacttcgttattaaaaagataaattatgtaaatttattagatttagattaaggttaagagcggtcaatttgtaactcctaacttaattttaacatctctgtaactactaatctctaggaaagaaatctgtttactttttatgcttttcctttgaacagaatataagtatgtccgtggaaggagattatacttacttgcgaatcaacttttattgcccaggcagtgctctgggcaggaatgaaggcaacatctttcctaaccctgaagcgacttttgtcaaggaaatg

SEQ ID NO: 74579 - DNA, 1084 bp, Homo sapiens
cgccatgggattatacagcatgtttagaggccaaagactgtctttgaatcctcttttctaactgagcggtcagcaggggtaaatcatttcaaacatgtttgcctgtcttattgtgaaagttgaaatgaatatgttatgcttgatccatgttagagatctttagccttttgctgatgtttatctgtttcttttcaggtttgggatgggaattgaattccgtgaaggctccctagtaatcaatagcaaaaatcaatacaaactgaagaaaggtaagtttcacatacaataggaaaatgcttttgtgagttacttcctttagctttattttcttttaggcatatgtctcacacctctccacattgtcacagccacagactgatccttgttttgctgttttaggaatggttttcagcatcaatttaggattctcagacctgactaacaaggaggggaaaaagccagaagagaaaacctatgccctgttcattggtgacacagtgcttgtggatgaggtgtgtattgtgtctaaactttggagtcttcatgaactaacttctgaggcacgtttgtggaccctgtggtttttttcttgctttgttaaatgctagctaaggggaagaatccgtgtgacagcctaacctaatgcagctaggaatagagactgtagcccaggtatagggaatgatataaacctttaaatcatattgtcatattgtggcttgaaccttgataatgataatatcaggaactaatactaataatgaaaccggttattcttttttctttttaataacagctttattgagctacaattcacatactatacaattcacccacctgatatgtacaatttagtgatttttagtattttcacatttgtgtaaccatcactacaatctaatttgaaaatattttcatcacctcaggaaagaaccctgaacctattagcagtcactccccatcccccttcccttcccccactggttcttcaggcctaggcaatgactaaactgcgttctctctaaggatttgctaaatatctgagcagttgatgtaaattcagtcataccctatgtggtctttt

SEQ ID NO: 74580 - DNA, 1206 bp, Homo sapiens
cgggcgtggtggcaggcacctgtagtctcagctactcgggaagctgacgcaggagaaaggcgtgaatccgggaggtggagcttgcagtgaagtaggatcacgccactgcactccagcctgggcaacagagtgagactccatccaaaaaaaaaagaatggggccaggtggagtgatttacacctataattcctgcactttgggaagccaaggtgggaggattgcttgagtccagtttgagaccagcctgggcaacatggcagaccatgtctctacaaaaaataaaaaattagctgggcatagtggtgtgtgcctatagtcccagttacttgggaggctgaggtgggaggatcattgagtctgggaggtcagggctgcagtgatccgtaatcatgctactgcactccagcctgagtgacagagtgagaccttgtctcaaaaaaaaaaagtgagtggactgtttagttcacactttgagaaacactgctttaggggacataaattttgattttaaaatgttactgagtttttttcctaaaagatactttaatatctcctttgtgtcttgttattaggtgtgaagatatgtgacgtgtataacgctgtcatggacgtggttaaaaagcagaagccagaactgctgaacaaaattaccaaaaacctagggtatgccatgatgtctattgtcattcttgagtcagttttcagttagactgtcagtggtcagtcttatttctttaggctaattgattgattcagccaacatttatggactagcaaactatactatgtgccaggcacatgatgttatcagagaaggtgagacagatttaagttctcccaagtgtataagagagatttttctagaccagtgtggtgttccagcccataggttttccaggatataattacagatgttaggaaatattatcaatacatactatatctcctctctccgtgcacatttgcaacttaagtactctgagatgtcctaatattttatttagagacagggtctcactctgtccaggctggagtgcagtggtgcagtcgtgcctcactgcagtctagaccttctgggctccagcaatcctcccatctcagctcccccaataactgggaccaaggcacgtgccaccacacccagctcatttttttattttttgtagaaacagggtctcgctatgttgcccaggctggtcttgacc

SEQ ID NO: 74581 - DNA, 2109 bp, Homo sapiens
taaaaatataaaaaattagccgggcatgttgtcacacacctgtaatcccagctgctcgggaggctgaggcatgagaatcacttgaacccgggaggctgaggttgcagtgagtgtagattgcgccgctgcactccagcctggcaacagagcaagtctgtctcaaaaaaaaaaaaaaatttatccaggcatggtggtatgaacctgtagtcccagctacttgggaggccgaggcaggaggattgcttgaacttgggagttcgaggttgcagtaagctgtgatcacaccactgtgctctaccctgggggtagtagaacaagaccctgtctctttaaaagtaaaaagtaggtggggatgggaggagaattaattttttccgtagtttagaatattattctacctgttactggtaaaacgtgtctaatgaactggtaaaacatatgtgtcttttcttccctatgacactgacagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaagtaagaatactactggaaatagcaaatcaagagttgagaagacagaaatgtgatgggcttccataacagatagtgcaggacgtttgttttgggaaaactgtatgtttgtttacattttatcccctttggctgagcagtgtgccagttttattttttttccctgcctttcttctatctgcctttacaaaaaacgtctagagggcagtttacattttaagtggtacattagcttaacacctcttgtagtacacacaatgacctggcaaagagctatttcaaatgtttattcagttcaagaagagaatgtttgaatattctgcaaaccagtgatagtttgctaaataacagaaatatcactggtaatattcaaattggagagatgcatttattttgtaattctgtacttgcatgttagaaactcttgtcactttgactgcagatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgaggtaaatggagatgagagggtctttttactgttttaatgaagcagtaataagtctaccatgcaaatctgttggtgtgttcttcagcttcctttgaaattaagactgacacttaagttggtggtaattacatcatctccctttcaaaataatggtaagcctgcgttatgttttcttgaggtaacccattattttacttgagaatcataggaatagctgtaagtcctacatattgttctccaaatgtgttttgcctgcataccaatatattacctggcgcataaatcatttcctaagacttatacaaggatacattttgtcttcaaatcatagtgtccacacaccccgctttgctaccctctagtaagtgttactttatttctggatgctcttacagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgaggtaagtatatgaagacttcataatatagcattttgactttagcctattttttctttttgttaaatctgtacaaatttgtggggtacactgaaatttggctacaagtatataatgtatagtgttaccaagtcattatcttgggtgtccatcacccaggtgcaatacatttttgttaagtatagtcaccctactctgctgtcaaacattgaatttattccttctatcttactttatgtttgtaccttttaacccacttcttttcatcctcgcctgcccccctacacacttacccttaccagtctctgttatctattttttccctatctccatgtaatccaattttttagttcccaca

SEQ ID NO: 74582 - DNA, 1113 bp, Homo sapiens
tgaagctccacacactaccattttttacctattggccaaaatttgatcctaatgaccatacttacctgaaaggaaggtaaaatatcagttctttgagaaggagaaatgaataattggtagggaactggtaattgaggaggtaataacgcagggttctgtatcactctgtcccttgttttatgcatttctgtatcactaaacattgatatacttcctataaacacaaatcgtttaactgatttgatggttttaattatagaaagttcaagcatataaacgtagagaaaataatacattgaaccccattgtcctgttctaataaattgtcgactcttggccgatcttgcttaatttgtatccactccagactccccagcctgattaccttggagttaatttcagacatgttatttttgtctataagtatttctgtatatctatatgagtccattaatttttgtatctgtaaataccgttgtcactgttgtctttttccatagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaaggtcaggattaataaagaatgtgtcataaatgtggaagaatcttcaaaagggatgaacagaaatgccttataggagtttgaaagaatgcgcaggggaaattataggtggctgtggttgtaattacaaagttctgtcacgtcttcattgttaggaggaaaagaattcaataatcctatcagttctgctgtaaaacaaatgagctatgaaattctggtgaacactgattttatgtctccattcttgaggacactgttagtttgttttcatctgtatgccttgattagagcaaataaccttaaatatccttaaggaaacttagatatacatcatttccagtttttatcaaatgtgaattttttttgtcatactgcccacctaacatgggatgttttctcagaatattgttcacttatgtgtttgagtttcttaactgtttctgaag

SEQ ID NO: 74583 - DNA, 1090 bp, Homo sapiens
ctccaaacccacttttaattttaaatactcttgattataagcccttaaaagctgtagtggttgaacctggtagttccagcagtccaaatacaagtacacagggttgtagagaactgataggctactaagctttttcttcccttttttaaaaataagaataggaattaaccttacctatctgcaagttaattttcagttaggtacatattttgaggctattgcaaataaaatattttttaattataattttcataacttatgtcctaaaaacaattgtagttaccatgtacttttaactgaatagaaatttcaaaaatattaagccctgtatctaagtaaatcgtgtcattttagagatgggaaaatggagtcagtcaaaaatcaacaggagaccttagaacgtactattgttttatgactcctggaggtttgagtctagatccagtcttgcctcttatgttttaagtgagagctgctaagagcagaaaggatttgcagcaccttctctgtattattagaatatcgcaggtggtagtggtggttcctggaaatgggctgcatgtttctttgtcctcttatgcctactagatccttcttcagggattgccagccttttcatgattacgattatttttaaccaagtaatatgattagtgctggtcattgggagaaacaaaagaggttatctaccatcccagggttccagctgccttgagggctgagtggtacaatatccaggcatatctgtatatcatttgagacctacctgttgggacattctgatatgagtggaccttgacttcatctgccttttttcttgaagaattccataaaatgtcaaaaatatttgttttcagaaggaatactcacattcttgtgagcatacaccaactgtcaggattggggtagtggaagactgaccccaaagaaattttatgcctttgaagaaactaatgaattaaagtgtcagtgcttctcttgagtggagctttctggctctttgcagatttttatggtggcttagtttcttgttctgggttgttctattaagattcaacagctatgttctgtggctcaggaaggattttaa

SEQ ID NO: 74584 - DNA, 2071 bp, Homo sapiens
cccagttacactgtagtagtcccacttttatcccacgctagatcccgctctttccgctcccccttcctttgcagatggggtggagctataacacccgcgcgcggcagctcttgtgggcggggcaggcgccgcctccttcgcttcgtctagggactgccgcctcggcaaaaagtctgaggtcctggaaaccgccgctgggctgagagttaataagggcggaggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcgggtgaggaagatcctgtaatttttcctagggagcccccttagccatcccataataaccctgtttctcggcgcccttttttctctttcggtcaggaattcccgggttctgtgcctcacccttttcgttgctcccgaatcattcaccggaggcggccacgaacgctgccccttaacagggaatcccccgcattcaccctgtcctgcggccatcaccatcttccccgcgtgccagccttggtcatgcatagcagcacctctcgcagtctcttcccgccctagaagaggcaacatccttccctcctactccgtggtcacgtcttgctgccctcccctgccgtgttctcacgcactcgctctgtccctccagaaccacaatattccacccctggtcccgccaggattataaccgtcttcgtaaaggagagatggaagggcaaggaggatgtcaatcgggcttttagcgtttatcgtttgcggggcttttgctggagttaaaaaaagaaatactgctcacgcgcaaccgcctcatgttctaggccctgctgtgggttacagagagggacctaacgctgaaagcctgcaggcattagtaataacaaaacaaaacaaaacgatgcctaaaaccttattagttccttggtagcgtatccggggcacgtgttcattaaaagagctgtggcagttcccagttttttaaagattcggcagttttgctgctctaaaaacgtccacagttaaaacttatttttatgatgttaacttactaattgagcaaacatttggttgcattctgtgatgcagtctgagttggctagcttaagtcttgcccctgaaccctgtcatcaagggaagatacagctaataaagatttttttttaacctgaaaaacgttttgagaaaaatgatcagctctcatttcagcattgtaaattatctttcaaactggtcatctactaaaaccaagccattaaaattggtcgtttccttgccattcatattaaagctgtctgtgcatgtttcatcttttggggctaaatacattagataattgaaaataaaattgattctcttgcattttatgaaaaggaaaaataagaactaaatgctagatgaatactgaacattttattttttttaattttttgattaatttctaccaaatgattttttgcagcttctctcagtgtcatattattcaaacataatcgatgttagaaaaacattttaaaaccttgatactttctaatgatcagtaagtactaaaaatccgaagccctctcttgtacccataaaccctgaaactgtgaacctttggtatgaaaattgtttctagtcccagtgattcagattcatcaaataatttcattctctctataccattcatgaaaactaatctatagctctcacttcctctacatgacaaattaactgtggcctgaagacaggt

SEQ ID NO: 74585 - DNA, 1039 bp, Homo sapiens
agctgtctgtactggttccattcccaaacagttcaattctgccttattattttttttacatctttgccacttctgttttctgcgatcctccatatactgcaatagaaaaaatcagttatcctagaggaatagaaatcttctctggagtaattattaaagtactagtgtcttttgtttgataataaacacttattacatagataaaggattcatcctagtggaaaactgccattaagtgggatctctccaaaaaatattaggtggtttatataatagttcaatagtaaatatttgcctagcacttaaagtacttcaacattattttattttgggcatcacaacaattgtgaggttggaagactgggtattattaattattacccttatcttgcagatacagaaacgatgatacagtatgtcatgctttctctttctcatgcagcttaaataccaaaggaatgactttaaatcttgctggatgggactgccactcaccgctagaaatcggggatcaacagcaaactctggatgaccctgtaaccacatctccagttcagcccggcgaggggcatcctcacccaccagcaaagtaccatccaccttattgatgacagggatccgggtctccaggtccacatcaaggtgattaggctcttccatgcactccacctccagctgcaaacccagaatccacccccatgagcacatactcttctttgggggagggagggagggggagcagggccaatggtagtcatgaaatgactctagtattttccattcccccagtcccactgccttcatcaattattgggaataaaaagacaatctaatcgtcaggttaaagactttctctaccactcacctctactagcttctttctgttccccttcttcttatgaaacagtggatgtccatctcccattactccattcgccatcaacttgtgcttctggaatgttaacttcaatccttcctcctaggaagacaacccacccacccaagacatcatatggtacatgtttttcaaagtaaagat

SEQ ID NO: 74586 - DNA, 1017 bp, Homo sapiens
cacatccctcaaagcttaatctttactttgaaaaacatgtaccatatgatgtcttgggtgggtgggttgtcttcctaggaggaaggattgaagttaacattccagaagcacaagttgatggcgaatggagtaatgggagatggacatccactgtttcataagaagaaggggaacagaaagaagctagtagaggtgagtggtagagaaagtctttaacctgacgattagattgtctttttattcccaataattgatgaaggcagtgggactgggggaatggaaaatactagagtcatttcatgactaccattggccctgctccccctccctccctcccccaaagaagagtatgtgctcatgggggtggattctgggtttgcagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcggtgagtggcagtcccatccagcaagatttaaagtcattcctttggtatttaagctgcatgagaaagagaaagcatgacatactgtatcatcgtttctgtatctgcaagataagggtaataattaataatacccagtcttccaacctcacaattgttgtgatgcccaaaataaaataatgttgaagtactttaagtgctaggcaaatatttactattgaactattatataaaccacctaatattttttggagagatcccacttaatggcagttttccactaggatgaatcctttatctatgtaataagtgtttattatcaaacaaaagacactagtactttaataattactccagagaagatttctattcctctaggataactgattttttctattgcagtatatggaggatcgcagaaaacagaagtggcaaagatgtaaaaaaaataataaggc

SEQ ID NO: 74587 - DNA, 2683 bp, Homo sapiens
ggagaaacaacaacggtaaaatatagctgggaacttgtgctgatctgtgttttcagttatggtccctatactgaaagccatctcaggaaggatttatttggaattctctacagagggaccatcttttctgccttgggtagttaaacctgtagaaattaaaacctcacttgcatgcagtaatcattaactctcaggtaggtctcctgtgtagacattttcattgatatttgtctgtgtcttttcccccttggctctgtaattcttactcattacagagtacctctcactacctcttctgggcctttttttttttttttttttgcgtctactttcaatttttgtgttttcagatattctaaaacacattaaaaaataaccagttttcttgtgttcttctgatgtgttcttctgattattgttgccctacttttccttttgtagatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatggtaagcaagattgcagagtgggtgaggatggatgccaacagaagcaactctgttaatttcttctactcctgtctcttgcagaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaagtgagtgcatgtgacaggctgttggcccccttccctatttccccctctcttctctttcccttttctaaatgcatcctcttgagagagatttggattttgatttgataaaatgtcaaaagagtgccattctttgggcctttattcaaagcccatataataccattaccatatgacattattcttccatcttttctcacacattctatgggctctcttaccagctgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggtaacaaacagcctcatccctggacatgtagagtccagaaatacagtgtaacagtatatccggggaaaaaggaacatatggttctggatttttaaaattgtgtttattgctgcaagtttttttttttttttccaggaaacttcccagttgacttaggaatcttaatagtattaacttcctcttttctgccttatgatttttacccatcctggtagtgatggcactattgagtatcacaggatcacacagctagtactcagactcttaaaatggtatttctttctttccccattcaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgtaagctcagcatttgggcattgggaagtggggaaggaggctggaatccttgctgtaactaattttactaataggttactaaactcatttggttagctaattttaaaaatgagaaaacagagcttacaaagatccatttaggaagaatcatttttcctggttgttttccttattgaaccctattgattattaatcctattaatattcaacaaaagtttcttaaattagtatgcttaggaatagcaggattttgcccctgtgat

SEQ ID NO: 74588 - DNA, 1210 bp, Homo sapiens
aaaaggctggccgaccagatgacaaagcaattgcagcagaacatcgagtgttggataacttctctgacatagtagaagggtaagcattagtatttgttcttttaaaactctaacttgtgccgtgaaataactctagccttgactgaacccaatgggattcttaattgtaattatactcaaaagtgatagatccttagcaaaaataggaccagcagaaaggactccataaactgcataaaccacatgttgccataagatacatctgagggtgaaaatgaatgtcacttgtaaatggcttatttgatgttctatttggtttggtttacaacactcttctgtacagctacagtagctgagaggataactggtctcttgaaagataacagccagcagctctcatacgttgcttctgtggaagagccttaggcgctttcagccctggtttatcatctcccaatggtacctgacacataaaggtacttattttgcctgaaaacatgtcccaatgatgagttgccatgctaatactgagccaccaggtagggcagtgttgccctggtttgggtgccagtgagtttaacaaaacttctcacatgaagatctgaggggcatgtgaaacagttggcttaatgaatacctccccattccatcatgactgagaaatttctctttgacgatcacaccctcagtttgcctagtgtaggaccctcaaaggaaattgggttatttattcattgcaaatcgtttatgccacctgtctgctcagaagaacacagtaataaaaacaaaaaagcgtgaaccatacaaatgaaataataaaaagtaaatagttgggtaggaggaagaattacataataaaagtcaagaaaaaggaactgtgttgatcaaagtgtttcaaattcaagcaattacgaatggtacattgtcaatttcttataattatttgtattccattggatgctataccagactgacccaaagttttgcacctggcctgccattcctgtaaacacgaaattaaatactaggccaggcactgtggctcatgcctgtaatcccagccctttgggaggccacagtgggtggatcacaaggtcatcagttcgagaccagcatggcaaataaggtgaaaccccgtctgtactaaaaatacaaaaaaaattagccaggagtggtggcgcatgcctgtaatcccagctacttgggaggc

SEQ ID NO: 74589 - DNA, 1048 bp, Homo sapiens
aaaatggcaagacaaaagaattgcagaatcattcaggtaattatcaactctttactttatgtttttctataggttaatctaatccttttcaggtccaagggtttttctcaatccaagtctttgatgtctcccctttcccaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaagtaagcatagaattagcagacattttccacctcaaacttctacagtgttactgagccagctcttcctctgtcctttctagggtactgttgcgggtacgaatgctatactacctgaggcaggaggttattggagaccaagcagaaaaggtgttagggggtgcgattgccaggtaaaattctgctatatttttttgatttatgccctaccttatttgagggaagattggtttgcttatttcattttatgctatctttgggatacctgataatttaaatctatatatcaggtctttaatcttatacttgacactagtgggaggaaatagggtagatgcatgagtatttaaattaatggatacaggaagatacctataataacctttgcaaggattctcactttaatttcctgcatttctgtgctgactctgccctcttatacctttagtgagattgacatatggttcccagtagtggatcaactggaggttccaacaacttggtgggacagtgaggctgacaagtcgctgctcattggagtctttaaacatggtacgtatcttctcctattctactcctttccgactgaagatttatgttcacggatggaacatttagcaaaatgctcctgagaaataactcagttatctgattgatcttcaataaatttgagtaggaaagtagttcttaaatatccagagcagagcagttagttcctataaatagatgttcaagaagggccagatggatagg

SEQ ID NO: 74590 - DNA, 1858 bp, Homo sapiens
attccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtaagaaaagagtcatcctagcctgtggttactctgtcctcataaagcagcaaaaagtaggagggcctggatttaattagagttcaccaattgcaataagagaagtttttaagattctcactctcaacttgggtttttgaccagctttgatatgggagtactggtattgatcctagcctgctgttttggtctccacttctgcttagccacttacattttttttctgcgattcccatacaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggtaaaggaattcattgtcttagggactaactacctaacttgggagatttttcaacaagaataggatcttttagaaagacctttcacagagtttggaattgtttccttagttaagggtggcagttaggtcagggaatcagcaaacgttttctgtaaacgacaagacagtaaatgttttaggctttgtgagccatcgagtctttgttgcaactgcttatctccaagtcctgtagcgcaaaaacagccatagataatatgtaaatgagtgggtggtcccacctgtgtccccattgaactttatttttaaaaacagatgtccacacagactttagtttgctgacccctggtctacatgatggggtgataatttcatcttgaaattgactcttggttttgagttgatctcatggctgctctatagaggtgaaagaatcataaattggtattttgtatcctttcccttgctaattttatgatatctttctcctttcctttcgtttttattttaaaccaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggagtgagtcctcttagtttatagataagtttgtagtagatcattgtgatagagggaaacaaaagctatttgtacacagggatttgactaccttgtttggattctcaattattatttcttaaaatataatagctaaaatattatggcatggttagatattattctcttgatagtcttttcatctttctattggtttttacagatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcatgttctgtctatgccagaggctagaaaaacacagagaccggaatctctaggatttaattatgtttttatgctggggatggtggctcatgcctatattcccagcactttgggaggctgaggcgggcagatcacttgaggtcaggagttcgagacccagcctgcccaacatggtg

SEQ ID NO: 74591 - DNA, 1010 bp, Homo sapiens
cctccatttctaggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggtaggaaatctatctgatgaggtactaactcaggacaaagaaggtgaagtttgtacaaggcagacatctgttgtcatgggtatctcaagggcctttctgaactccttataaccttgtgcctacatcatttgtggcatcatccaaagtatacatttcttagatagtggaaaactctaatttttccatgtttctacataatgtgagaatgttcgccctcatcttattgatttatttttctctctgtaatggaccacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgagggaatgcttggtatatacctgaacttctgtagtacctgtgtttactttccggatgattctccttggggacaatggatgcattgactcaaccaacctaatttggggtgcggactgaggaatgggagggaaatggttctccttttaaaaaagagactctaagcctgggcaacatgatgaaatcccacctctacaaaaaatacaaaaattagccaggtgtgatggcaggcatctgtggttctagctactttggagactgagcttggaggattgcttgaacccagaaggcagaggttgcagtgagccgagatcacaccactgcactccagcctgggtgac

SEQ ID NO: 74592 - DNA, 1184 bp, Homo sapiens
tgcagcttttaattttgttaaaatgatttcattcttttgtcaatttttagacatcagccaatattatgttctgtattagctattttcatttttattatcttgtatggttcagcattgtccagcagttgtggatttcattgttaatcaacaaaagatctggggcagagatacatgagctaggcatacagcagagtaaaaaatgtctagcctctcattcagtgagtctgtcattttcccaagaagctgaatatgttgaggaagcaatgtatcttacattcagtgatatggcactatttttcaggaagataaacagcggtggaggtgggtggtggtgcagtttgtattgcctattaaacatgccttaatataggcaagtaattcagaaaagctcctcatttaggtacatttttggttttttctgactttactgccttcatgcttagggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggtgagttccacactgacttgtgagcagaaacacctggaataaaccgtaattccttgcggtattaaaataaccctagtttagcagagaagaaaagtctgaatcgtggtattgaacagtggggatgacctatgggaatggtaacctgaaagtcgtgtaaaagtcatacattttagaattgggaagtttagtgataaccagaagaggaggtgggaaactatattggttacctattattactgcataacaaaatactccaaaacttaatgtcctacaacaactatatttttcatgatcttctagctcaaccacttaggctgagttcagctagttggttcttatgatgatcttgcctggagtcagtattgctgcagctggcagttgatgctggtttttatctggagcacctgggttccacatggcctctcatcctccataggccagattgggctgctttgtgtggtagtctcagggcagtattccaagagggcaaaagtagaaacagtaacctttgagataggctctgaaactcacacagtgtcacttttgctacattcttgttcttgc

SEQ ID NO: 74593 - DNA, 1038 bp, Homo sapiens
tattgaaacaatttcttcctacatactctattttttttaaagatagtatcttttaacattttttttttcccatggtgaatctgcaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacgggtgagttgcatgtcttgggaatactatgagttagagaaagtcggccaaggtacctggtattttaagggctatatatgaatagaagacttttattgaaagtcttcaatatgcctatgcaaaaatgcctatggtttaaggcatttttgtatagcagtgtgcagggcatttttttgactttgctattttttttacctagtagacatttgatctggtagaagttctgattttatttatgaacatacacattttaagtagaattttgtcagcatcaatgaattttaatcacagtattttacaaaaattaaattcctttagccacttaatccatgcggtggtgagcttatttcttttcctctttttagtctacggaaattttcatcaagatcagtttctttttctaaatggtcgggcgtggtggctcatgcctgtaatcctagcactttgggaggccgaggtgggcttattacctgaggccgggagttctagaccagcctggccaacatggtgaaaccccatctctactaaagatataaaaattagccaggtgtggtggtgggcacctgtaatcccagctattcaggaggctgaggcaggagaatcgcttgaaaccaggaggcgaaggctgcagtgagccgagatcgtcacactgcactccatcctgggtgacagagtgagactgtgtctcaaaaaaagaaaaaaaaaggatca

SEQ ID NO: 74594 - DNA, 1793 bp, Homo sapiens
agcagatctacatttgaatctgtattttaattagtttatttttctcttttttctttttctttttttttggtttttttttgagaccatcttcactctgtcacccaggttggggtgcaatggtgtgatcttggctcattgcaacctccgcctcccagattcaagtaattctcatgcctcagcctcctgaatagctgggactgcaagcgtgtgccatcatgcccggctagtttttaaatttctagtacagacagggtttcaccatgttagccaggcttagtctcgaactcctgacctcaagtgatctccctgcctcggcctcccaaagtgctgggattacgggcgtgagccgcctacgcctggcacctttttcattttcaaatggtcatctaggtcttagccaccagtgaattcagctttcttttaaatttacttctaatttttttttaggctataaaccatcattttcttagaatttgtcactttatatttttccttccagtagcactttttggtttagcttagcaggatcataaagaaaatttctatcacatctgacactttatacagtgaccagtagagaacagcagagcctttttaagatgttaatgttcagtgggtgagctgggctttttcatgactttttcaagtgacttgatcctcccatacatcattctaacaggacctctgagttaaattctttcctctataaaattccgaagtttattctactttataagtcttcaggttcactcagagcctcagaatcttagatatccaggacacggtagaattcattgtctttaaatcctaacaagcatgcttcacataacgtattctgcttttgaagttggggtggtagtattgtgtgtttgtttgtgtgagttgaatggagaatgggccgggttttagggcaggttgttagctactcttaaattcttatcatttttcaggatctcagcctttccagccttgacagtcttatgcttttaatcatacctacccttctaaaagcaattggcctttagttaggcccctttggaatgtcttgcaaatgacgtgacagatgataatgttttcatactctaatactataatttatgctcccagtattggctaatactattctatatacccattttccccacctctgcaaaataagtttgtcatccattttatattacctaatggtggaaataaatagatattatgctggaaatatgtgacctggacaaatggctttatatagagagtgacctgagttactatgataaagaaaaaggtaaaagagcaagcagctggatcaattccagagattcgagatctgtgactaccttgaggcactttcacatattttgttggctattttaagttttctatgaattgataattagagattcttgttgattacactaggcccaatctaatccttgctttatacttcataagccaaaaatggagatgcagtaagtgcagtgatcatcttgaatagtgaaaataggagccatttaccattggtcactgccccttcactttcagtggaatacctacataaactagtacttactgtagttgaactttttagcattttctcttccttctttactcttagtacctctttttggtgataacctcttgttagctcctagcttcctggggctcacaaggacatttctttatcaccatgtaagtgctcttgaggtgcatctgcaatgagctctaggggcccagaagccagtataagctgatagtcctcatcctaaaggtagcctagctgccactgtgtcaaatttggc

SEQ ID NO: 74595 - DNA, 1902 bp, Homo sapiens
aataggtattgcctgtcatttctttcacagaagcacaaattactggggttgtcagccttggctgattcttcaaaatacttgtaattggtttctatatatgggtgtaaactttcaattttggtcattgacttcccttacttaactgcccttgcattgttttgttaggtttaaatatggttcatttattagttataggatattttgaaactgatttcctcaatgcacatgaagtattttcaaaactgatgatacactgactgctggtccacttgaggcattctttgtctttctttagctattgatggtttctgtagacctattattaagagagaacatttgttttctcaaatttctaatccagtgtgattagaaatagggataaaggagctttaatttccaatatccaggtttacccctaaacactggagcaagatgagtgaagaaatatgcctgttatatttgcggcgttcatccttgataagagtagttttggttgtatgttgcaagtagaagaaaaagtggaatggatggacaagtgaaagagatgaaggaatggaaatagcatgtgtttaaacccttgaaaaagtttaggtatggggccgggcgcagtggctcatgcttgtaatcccagcgcttcaggaggccaaggcaggcagatcacttgaagttaggagtttgagactagcatggccaacacggtgaaaccccgtctctactaaaaatacaaaaattagccggtcatagtggcgggcacctgtaatcccagctactcgggaggctgaagcaggagaatcacttgaacgtaggaggtggaggttgcagtgagccaagatcgctctactgcactccagcctggatgacagagcaaggctctacctcaaaaaaaaaaaaaaaaaggtttaggtataaagcagagtagaaaaatagttgcgggagttgtagaataaaaagaggtcttattttaaaatgtgaaatgtggaacatatacgtgtatttatggcaatgactcggtagagggattcctaagaatacaagaagcaatgaacagcagagcatatatggagagaaggacctctgttagaaagagacactcactggtagcaggtgagaagtcaggtatagaccctggtaaattcataggatttgctgttatgaaaaaggagaacacccatcggatagcttctaatttctttaaaaattttgaagtaggattctctgctaaaggtgaggtagaggagtgggtttactggacagtgatcttttggtcttattgtttggtttcctaactcatctaggatgaagagccctttaatccagactacgtagaggtggataggatattggatgagtctcacagtattgacaaggacaatggggaggtgagttgttgaggcatggagtaacgtgaacatcctcttagatttctgctggtgggtttgccaatcctttatttttcgggtatggatgcagaatcccttggactgaaaaggtatttctaaatttttctgtggaatcctttgaaagataatgggaggtaagagtgtagggagagatgctaaaaggaaagatttctgtaaagtcagacatgtagaggctaagtactgaaaagtcattcatcttggtctcatttttcctcatattttaaatgggagactcttgacatacagttggaggtggggtgttgggaaggggaaagggatacttcacaaattcctaaatttgtgaatataaaaatacttctacaggctcgctcctagctttctacaaatcatgttcttgagaatgggctacttcctgaactcaccattagttaaatgtctcttcatttgtcattaaaacagatctgctggccaggcgcggtggcccacacctgtaatcccagcactttgggaggctgaggtg

SEQ ID NO: 74596 - DNA, 1053 bp, Homo sapiens
aagaaggaggtgagggctttttattattattattatttttatttatttatttatttatttatttatttatttatttttgaaatagagtctaactgtgttacccaggctaaagtgcagtggctattcatagatatgatcgtagcacactatgaacttctgggcttgagctattcttctgcctcagcctcctgagtatctgggactaccattgtgcaccactgcgcctggcttttctctatcttaatattaacccgtaatgctatgttcacaggctttatttaatgagcacctttggatgtcagatatattgctaaggtgtagttgtgagagatgatggaggaaagttagctagaaaacaggaactgctttactggtgcttcttttacttacctgtttagagtggataaaggcttactttttccagctatcaggcctctattattgaagtaccagactagttccttaatctctgagttattaatatattcagagattattggtatgaagttctgcaatgtgtggttaaaattaaaaagttcattcttttacaaataagggactagtgactaatttatttcttttttcttagctcccttctggacaatatactgaagcagaagaattctttgtcaagtacaagaactagtacgtgatctgtgcaaaaagcttgtcaccccaaattccacagggtggtaaaaagttctcctgggtatcctgggtgggaatgtgtcccttttttatagtcttgtagcccaggttgctgtttttaatggggaaaaatggctattcagagagaaattcaggaattgacatgactcttattatttccttgtaggtaagtggggtgagggtggttcctgataaaatgtcatgtgattctctttaccttagtttagcactaagatcttgctactcaaaatatggcccatggatcagcagaattagcattacttgggtgctttttaaaaatgtgggctttcaagcacatcccataccaggtggtttgtatacaaattagagtttcagaagcactgacctaagagactgtctccc

SEQ ID NO: 74597 - DNA, 1104 bp, Homo sapiens
ccgttaggccagagaccaatattgggtatattagttgtaatttttctgaggtaatggagatgtatattaatggaagcatagcaaaaagatactaaagtttattttggcagaattcttggtttttctcacccctttcccaccaaaagaatacattttaaaaagtaggtgtaggttcaataagatttagtctgagcttgattcttgagggattaaagaactagtttctagcccccctgcttcagagctggattttatttaggccatttaactacaagcaagttgaaattgtagtatctttgtttctataggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaagtgagtactccttgctactgtgatgggacgtgcaagagtaagctcaagtgagtactccttgctattgggatggtacatttgagggcagagcaaacatctggtacctccaaaacaaagggcaagagcaagctcaagtgagtgctccttactactgtgatgggacgtgcaagagtaagctcaagtgagtactccttgctattgggatgggacatttgagggcagagcaaacatctggtacctccaaaacaaagggcaagagcaagctcaagtgagtgctccttgctactgtgatgggacgtgcaagagtaagctcaagtgagtgctccttgctattgtgatgggacgtgcaagagtaagctcgagtgctccttgctattgtgatgggacgtgcaagagtaagctcaagtgag

SEQ ID NO: 74598 - DNA, 1042 bp, Homo sapiens
taaagtttgtaggtgtaagtgcccaagaggaggttgttattgtttttctcttttagttttagttttgaagcagaaatatgagtgtctttctgctgtatgtccgtcctcagatttcctcacatttccctcttatattcatgctatttgatattaagaacagtacgtaagaagggaaaattttctctgagatcgccaactttgcctatttttcatttgtatttgtattcctacaacaggagttccaccatcttcctctgaagacgtagccatcttgctccatgaaggtcaggacaatctgacatgcacttgtttcttgcctctatacttgaagagtagtcctcttacattgtgtacatttttttcttaataggggaggggaggggagagccagtaccccccctccccttccctccctagaccttggagaagtaccctccattactttcccaagatggcagaccccatcatggatctgttcgatgacccaaatttatttggcctggactctctgactgatgacagctttaaccaggtcacacaagaccccattgaggaagcccttggactgccaagctctctggactccttggatcagatgaaccaggatggtggaggtggtgatgtggggaattcatcagcaagtgaactggtccctccaccagaggaaacagctcccacagaactttccaaagaatccacagctccagctccagaatccataaccttgcatgattataccactcagcctgccagccaggagcagccagcccaacctgtcttacagacatcgacgccaacatcaggacttttgcaagtctccaagagccaggagatcctgagccaagggaatcctttcatgggtgtctctgccacagctgtctcctccagtagtgctggagggcagccacctcagtcagcccctaagattgttatccttaaggccccaccaagctcctcagtcactggtgcccatgtggcacaaattcaggcccaaggtatcaccagcacagctcagcccctggtggcaggcacagccaatggt

SEQ ID NO: 74599 - DNA, 1056 bp, Homo sapiens
agtttcatgaacttaaaaccctagacatggattttgtgaacctactttcagccattcataagacatgttttcaagataggaagctttttaccatctcatgttagaatcaaaggataccatttagtttctgtgaggatcgaatggtttactccagataatgcgagcaagtataattcattaactgttttttgattagctactatatgtgctatgtcctgctggttcttaggggatccacagataaataaaacatagtccccaccatccaagaactttctcccagagaaagaggagctgggccatggtacagagttgtggagggtgtacattgcatacattcataacaaatttttatatatttagtatggcagttttccaggcatcttgagaagtgggcaactttttacaatttgcgcaaaggaaccatttgggccttcagaggatatattacagacttaggtcattataataaaatattaaatataagtgttttaaggtataaacaatggtgtgggtatttaaaggaggtggagggatcaagtcatcacaagttgctcagttgttaaagcgtcagaggttcagggctcacttaatggagtagaagacctttgagggttggtaggattttagctgcgagagattattggcattgggatggagaggacgtgttccaggcagaaagcacagcatcataagcaaagtcacacaggtaggaatcacattaagggaattgtgtagtctagttggactggaatgtaaaatatatgtaagagatggtaagaggaagttgggaatataaattggaaacaatgttgaatcccttgcaattgaccttttttatcttaaatatgagaaagttttcttgagaggggacttcagaacaaaaatcccattatagattaatatgttaactagaataaaggttgcaaaacttcctgggtaaaattgtatgatcactttggtgagattgtactataagccttggttaaaggtggttatttttgccaatagtaagtaaaaatatataaaacacaagaaaaatttatacaatagaat

SEQ ID NO: 74600 - DNA, 1013 bp, Homo sapiens
tgcttctacccatcttatgtttcagtaacatgtatttatgtctatctgcaactgatcttcttgaaaggatacagtttccaacaacaagatttgttctttgaagtaaataaaatagtttattcttttctgaacctttgagcagctagaggttaagtggtcatgagtggtactttctaaaagtgcacattacagaaagaggtcagcatggctcaatactgcattcgttcattgtcttctaagaggttgtcactacggagaaatctataagtgggcaatagatatctgtagctcattttacataattttatctattagacgacagaactaatctcttgcagtgtttctcatccatcataaacagtaaatgatgataaactccttttgagaggctataggaaatcttatcccatcccaaagatactggtaactctgccaagccaggaatgtttctttctctgccctctactcctcacgtgtcttttacagatcttcactggccaagaaggctttgtccagtgttaataaatataaatagcctaaacaatgagatgtagttttttcacttgataaatataaaattataatattgaatacacctttaagaactgcacatttatctccaccctcggttcccagaagcccttcttaagggccttagtctccatcccctggttgagaatcactgctttgttgaaaggtatggagagattgagatggaaaaatatagggtagaattaaaacaaaatactttatcataggacagacagtttattatagaaatgggcaagggtgaggaataatgtcaaataagaatgagagagttgggactctagatttccaaaaaaatcaagaactgtattaaaggtggtaaagctgcagaagaacatcagtttgtacttgtctcaaggggaagcagtagtttcacctttaagaaggagatgaagtgaagggctatactggcatatataataaagtatttttctacaggtaactgtattgttacttggcgatta

SEQ ID NO: 74601 - DNA, 1151 bp, Homo sapiens
ttgtctagtctcactgggaattagagtgatttcaagtgacatcgcaaagtggacactgattaaaaggtcaaatgggctgagtttcaagagatgggagaacaggaaaccgagtttagagggtgaggagtgtttgttttgagcgggctaagggtcgggaattgttagagggccccaggaattactgtctaaaaagccgtattggtattgaagggtcacagtgtcaaaaatgcacggcaaccttatgtgttgtggcagaaagagtgctttaaaaggccccatattccagctgggctgactcccacgatggagggaagaagatttggccccttttattaggtagtgggatacggtgtagtcactacaggagaggggttgacagggctgctagaaggccggggattcagagggaggcggagctggcctagcgcggaaccctccctcccaagtttatactcttcagggtgaagaattcagagtagatggtagggaatttaatctccaggactggtttcgcgtactatgagactgttcctctggccagcccccttttttcaagcaagctgcaggcttcgcctcggccctagaaaccggataggcctctccgtgcgctctcaacctaacctgcgggggagggggaagggagctccttatagtcccaccctttgcgctgttttgcgtcttttcgcctttggtgagtggcagtgcgcttcagccaatgatggcgcggggcgggcaggagcatcaggttaggttgcgcaggaggagggggaactggtgctggagagacagggagaggggcgaaccggccccccacagccactgcaggtaaagccacctctctcctccactggggtgaggcacagctcgttttctccttcagggcttgtcgggcctctcggcctgcagcttccgccctaacattgctcctatcccgggcatccacaccccccaccccccgcatcttcccgtcttggccatccccaccctggagggcacccccgctagctccttacctcaagtgcatgtacctcatttccattttggggtctccagttaccagaaatcttccgcctctgctgtatggaccttactggcaccaaccccggcagtatgagcaggtaatgtacccgggtcccccccacccccacccc

SEQ ID NO: 74602 - DNA, 1064 bp, Homo sapiens
gaagaaaatttattgcaaggatactgaatggctcaaaaaagtaatgggaatattagagaacctggtttagagaatggtgtgaaatcaaaggagggaagaccaaagagaaggtcaaggtcacactgctgaccagtctatataggatgctacagttggactctaatatctgccattgccaaatattgtctaactggttggtcctgggtctttgcattactcctgcaaagtcaagacttccccagcaggagtatccacttaaactagcctaggtcatgtgcatgcatacttcctctttgctaggaaggggaggaggcaattgaaccctatctccccaggctccatatggggagataagatccagctttccatggaaaatataggaaggggccttttggttgctgagcagaaaaaaactagcaaatgttcactatacaactcctttctggtctcagcagcctcctaactgcttctgtgtcctctgtcctctcaccccctagagccagagttagctaaccaaaatgtaattctgattacgttattccatgtttcagtggctcctcatccacctgtaagaaaatgttattcaaggctctccacgctctggcccttacctgtcccttcggcttcatctctatccagttccttcttcgcgatttacactttagcaaggctgaactacagaactagagtttcctctacatgtctcatgctgtttctcattgctatgctttgttttgccttccctcttcctgtccctgctgcctgaatatccctttcttacagcccacctttccctcccacctggtaacttttcctcattgtttaagaaactattttcttggctggatgcggtggctcacacctgtaatctcagcactttgggaggctgaggtgggtggaacacctgaggtcaggagttcgagaccagcctggccaacatggtgaaacctcatctctactaaaaatacaaaaattagccgggcatggtggtggacgcctgtaatcccagctacccgggaggctgaggcaggagaatcacttgaacccgggaggcagaggttgca

SEQ ID NO: 74603 - DNA, 1048 bp, Homo sapiens
ctcggctcactgcaacctccgcctcccaggttcaagtaattctcctgcctgagccttccgagtagctgggattacaggcgcccgccaccatgcttggctaatttttttttttatttttagtagagacggggtttcaccatattggctaggctggtcttgaacttctgacctcgtgatcctcccgcctcggcctcccgaagtgctgggattacaggcatgagccacttttctaagcaaaattaccacttaagattaagttgtgggtgtcaaaactgtgtttgcttactgaagaaataagatttgatattctcatatgtgaaaggactgtaacattcagatgaatgctaaatgctttagtgaactgtttgtctacagctctggaagagttaagctatcttctgagcttacattgagcctaatacttgggaggaaaacagaagacaaacatttctctcgagtctccactttcacctctagaatctctctacttctggagttggatttgagccagtccttgatctgcaggtcttcgcatgacctgtccttacattactgtgaccattgtggtataatatttactattttacctttagcatttgattcattgacagactatcatgtttcttatctcactttaactttttatatcccctcttacatgatctatgatcttttattcttttgtctcaccaagttggtgatcttttcatcttcctgtgattttgctcactttccttttcacttaattcactgacgttgtacacttttgcttctgtttagctgaaaccttttagggaatgtaatttctgtatttttagtagagacggggtttcaccatattggccaggctggtctttaactcctgacctcgtgaaaattgaaaccttttagggtatctaattttcaagatgtggtctttctttggtacctagcacccaaatgagagttgtctttctttctttcttaagagacggggtcttgccatcttgccccagctggtcttgaactcctcggctcaagtgatccacccaccttggcctcccgaagt

SEQ ID NO: 74604 - DNA, 1241 bp, Homo sapiens
cagcgaaaccccatctctactaaaaatacaaaaaattagccgggcgtggtggcgggtgcctatagtcccagctactcaggaggctgaagcaggagaatggcatgaacctgggaggcagagcttgcaatgagccaagatcacgccactgcactcgagcctgggcgagagagcacgactctgtctcaaaaaaaatttaaaaaaaataaaataaatgtagcaaaataaaataaatgtagctattcttgccagactcctgtcgattggttgtctttcagaggtatgctcagtggagtgagtctgccatggaggttgtcttgactgttagctttcagaattgaattcactgatagaggttgtcagtgattagactaagatgaattgtcattcattgataaataatacagaactatcagtctttcctaagagtatggggagttttgtttttttttttaaagtctcttttttgcaggtatataagaggaaaactgaggctgccaagaaagagtatctgaaggcactggctgcttacaaagacaaccaggagtgtcaggtaagagggataggatagaatgaatatttaaaccagtaagaagttttttggaagtgtttgttagcagttttaagaagtaaataccaccaagtgattgattaattgatagattgatttatgtcttcttttaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgggggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaattt

SEQ ID NO: 74605 - DNA, 1753 bp, Homo sapiens
cacaggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggtaaggtgaccagagaacaggctagtcctcaaggggctattatttatgattaaggacagaacttagtagagcttcacattgttttacactagtccataaatgagcttcacaggattcataagccacttaagcttgtatttaaactgttttatgagattctacaaatattcattagaaactcaacaggttctaggacccaaaagcactgctccctagggtttctactctcttcacaacccaaggatcttcctcagccattctgtgatgtattgaatctgccccctggtggttacgaagttatctatttaatctgtcaataattacatctttcaccccttaacagagcttaaaacacatgctgctagcattttgcttatccaaagaatactccctggtagcaactctgtgaagcaggcctggctaagcattagttactaaccctcagataatacagatccagtctattttaacaccagaatctatgccaattctgaactagtaattctaccatatactattctaatgttaagctctttttagaattggcatatttgatatgatgataggcagtcttcatttggtatgcattttttaacaatattaaaccctctaattccaggatttctggtttgcccctccttttacactgtttcaggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttgggattctgaagtccattctggctctgctacttaacagtgtataatcttgtgcaactcatctctcagtattatatgtgaaatgggagtattacctcattgggttgctgtgaaggttcaaactaaatgagtgcatgggaaacattaaaatgatcattataggctaggcacagtggctcacacctgtaatccgagcactttgggaagccgaggtaggagggtaactgtagcccaggagttcaagactagactgggcaacatagtgagaccccatctctactgctaccctcc

SEQ ID NO: 74606 - DNA, 1055 bp, Homo sapiens
ggtttgtgtaagtcctccagaccctgaaggtgtactttcagaagtgcattgtgtgggaagaatacaggctgtactcccaaataactgagtttttttttttaaaagctccctccctcttagaatagcaaagtatgtctgtctctgagccacagtgaaagttaaagtactctgaaaggaggataatcttaggagaaaaggaacctaaactcttaggtcagtgttttattctgttctacccaagtctcctgcactgcttgccttccagtggtaaaacaggaaaccaagtctttactcagagaggaattacaattgttctgtagtatgaattatggatttccatgctacctgcctcccttaaaactcttgaaggaagctctaatgatagaattaggggagggtaataaaatagacattttgaaatcatttggaatttgaactgttggatctacatctggagcaccatcttgattctccctttttattttcccagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcaggtacctgtctgctcagaaaactcgtctcaacttacggacttatgtttgatagggcagccatacacgttaagaaagcagagcataattcagcaatcttgtcttgcttattgggaatggagggggatagataagcttttaagggaataggaaaaatcaaatggaaaagagggactcgggccatgaatctcagagttaaagtagggaagatgaccaaataccactttatgcagtggatctgttgtgatatccgctacctggacgtcagtatcttgggcaagtttgcagttgtgatggctgacccaccctgggatattcacatggaactgccctatgggaccctgacagatg

SEQ ID NO: 74607 - DNA, 1002 bp, Homo sapiens
atgatggcaacccagcttgtgaagtaatagatgataataatatagtcaggaaatatcatttggtaaccaaggcttcagcaaagtattaagatttttgtgtttgtgagtgttataggtaacactgttggcccccaacattgtcattttgtacactttgttgatcagtggcctgaattcattaaaattcacactacatgcctcaaaaagaatattggatcccagcctaggttgttgagtatattcctgtcctttattaaaatgtaggttgatagaaaggtggtagggatatttaaatctatcatgctaatttactttctttgtatcacagcaaggatagggaattaggaaaagattactcactcaatagagaaaaggtagatagaaaatccagtattatcttgacaaagcagtgaatgttttagtatgattgaggataggtaatctagtgctaaagttggtcacagaatttcctgcacaaaatgaaagatctgtgtatgggaatgctagagaatttgacttctcagaaatatatagaccaacagtggttgccttttttcattttcacttctcttcattcttagatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacggtaatgacctgacagagttaggatttaccacttattttcagttcacggtcagtgtcttattgcccatacctcccctcgttctctagccagatgctcctgccactcaagatggggtagaaagcctcctgcagaagtttgcagctcaggagttgattgaggtaaagcgaggtctcctacaagatgatgcacatcctactcttgta

SEQ ID NO: 74608 - DNA, 1084 bp, Homo sapiens
actaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaaata

SEQ ID NO: 74609 - DNA, 1032 bp, Homo sapiens
atgggcttctcaggcactgccttgggtgcaggaggctgaaataggaggggggctgtcttctccttggcttccctggatcccattgttggaggcaccttcccagccacagttcctaggccaaacagcactggtggggccaggcttggagtggtagtggaggtggagctggaattccagggcttcatgggcaggccatttgacaggaatgccacatactggttctagaaagataggggacccatacccaccagctgagcagaaaggtcaccccagaggagtggcactgggccctccagagacagctgccagccctttttggctaggctgcaatgccaaatgtaggtgctcaggtgcacctaccaaagggaaagggagaggagagaggagggggaagaagggtcacaccagggaagctggagagggttccccttgagaaagctgcagagaatctatgttcctcaggtacaaagaatgaggagggaagaaaaattccttagggggccatccccttgtaagcacagtaatttccaagctcagggactacagaaaagccactagggacataacatgttaagaacttagagaaaaagacaaaatcagggctcataactctgggaggtccttttgtgaagctgtttctgctctgtgggacaaagagcagcaggtacagaaaaacaggctcatgggatcgtggggtcatcttttcggggaaagggggagagccctgtggaggtgatggaaggcgaacagccagggactagagaaagagcagcaatattctgagggccatggggggcaaagggctgtacctggtggtgtgccaggagcatatgcttcttgagggtagcccgctcaagaaagccctgcctgcagaaaacacaagtgaagagcggcccctccttggggtgggtcttctgatgctcctccagagctgcctgggagggaaaggcctggccacacacttcgcaggcctttctgctgctgctctctcctggctcctttctcattgcctcctgcaggctcagctcctct

SEQ ID NO: 74610 - DNA, 1041 bp, Homo sapiens
ttcaatccaatcaagttgacactcaatattgacactcaatattaaatatcaaatataatattgggaaatatcatattgaactctacgttttggtgtgggagaatttattactgagacattggaaaatacactattgcattctttcttctggattgtttaatgtggtttagtttgtgagaatttggtctcattctctactcttgcagtggctgagagttatcttgagaggatactaaggaactgttagaaagttagtattttaccttaaactgtgtttgatcatacagtatggctatataaaagagaaaaaacaagaagaaaagaaaaaagttaccgaagcctaaacattataataaattctaattgtggcagcttccctagtgggagaaagacactttcaaacctcactcggagttcttgggcttctgagcattcttttcagggccagcttcacctcttggttccgcagagtgtagataagggggttgaggaaaggagtgatggccgtggggactagggcagctgccccatccagggggctgttggtttcaggcctcaggtagatgaaggcacagggcacatagtacacggtgaccacggttacatgggctccacaagttgaaaaagcccggcgccgcccatcagctgtgtggattctcaggatggcctgaatgatctgtatgtaggagaggaggatcagggagaagcaactggcaaccaccaccccaatgtctacaaacgtcaccagctcgttgactgttgtgtcagcacaggccagtctcaacactgcagggatgtcacagaagaagtaatccacctgattgggcccacagtagggcaggcggaaggttaggatggcctggagagccccatggatggatcctgccatccaggctccagccacaagcaaggcgctcagcttagcagtcatgagcacagggtagcgcaggggctgacatattgccaggtacctgtcataggccattagggtgtagaggaagcactgggtgctgcccaggaagtgatagaaatagagttgag

SEQ ID NO: 74611 - DNA, 1041 bp, Homo sapiens
atggctctgttcttccacctttctcactttcatcaaatgagagaccttgctacaaataggtcaggctgtgcccttgagttcctgaaaacctcagtgtctcaggaagtttgtgttcagctcctcctgcagtcccaggcacagtcctcctgtcacccacagcacagaagtactcagcagcatcactcacatgggttgatggtttcctcaggtagaaggaggtttcgctcttcttaaattcagcctcaaaacctctgatgcctttaacctgggtggcctctgttaggtctttgaggagaagctggaggctttggctagagtattggacataccagaagagagaaggaactccactataggaatagttgcacttcagttccagaggggcttcttcagagacagtgatgtggccatcaagctgggtcaccgactgggttctggttcctcctgcaacatcaacactctgttagtgagaccagaacagatctacctgtaatgagacagagtctctatttagattccgattggaacaatgttccttgtatggagacgggagcagggaaacaatattattatacttactcagtgtgaagaacattccaagcagcagaatgaccactaagagcatggctaggcagtgaggaagctgagagctctattctagaagatctcctgagtgggaaggaatgtgccagaggatggtgagtccctataatgaggaaaatctgggattcaagagttccctgcttaggtaaggcctagagaccactagtaagagctgctctcttgacaacaaccactctggtgttgatcctactcagaatatggacctcagtgagctgtgagataaagccgctcaggaaggacagaactcttcttagcagagacatttccggtctgtgagacattgccccctggaggtcaaatgtggaaacacactgagtcttttgggtttgggctccatttccttggtttgaatttcttagcagaataatctgatgacagtgttttcaggggtctgcttatgaggaagctattttaatc

SEQ ID NO: 74612 - DNA, 2214 bp, Homo sapiens
ccgtaactactgtcaccaggaggacaggaccttccccaggctcctgtctgtaccattgtaagctggaaaaaacacttgaggagttgcagtacacagtgagattttctccctcttggatgcttagaaactgagggctctgctccagcagctgggtgctcacccctgtttagaaacagagcagaaggaaccagggaagggaattagggattgtttcccaacctgaaatgatttttcctccctccttactcctttctcctccctcccttgctttccccctttcttccttcttttataattcctcctttcatactttgccataaaacaacttgccatcagggattttctgttaatttaattgggaaccttttcaactcacatgccaactgaatccaaagaatggacacggagaatttcaggaccatcttgtctttctatcacatggtggacatggcccctgactttagctgctcctgaaagagcccgtcctggaacagacttctctgggctagaagagtgcttgctgccacccactttgagttccatagaaagccaggagcctcagtgtggcagccaatggaatcattcactctccacccgccccttcctccaacccaaaatgtatgttgccttttgaaatactaccctcctgtggagagatagaaaagtgatttatttccaataatgctctgtttctcccaattgcatttggtaggcataaatatcaagattaaagtagaaatgtaactggggacctcacccactttctttttcttccttcccttccctcccctctcatcccttcatttcttcccctctggacactccttgccagtaatgcatgcttgtctaattattctcttgcttaagaaatcccagagtcaaacctagaaacaaaccacgcagtccccattgaggcatcatcaagcttagggggacttgtgaacaatttgtccaccaccaccaggccgaagtcaagataacaacttccagacccccagaggcgcaattacccaatacagcctcgagaacaagacacacaaaccctgcaccctgcagaattcctgcatgtctcccatcctatgtttcatttttaaaatctcatggtgaatttaaaaatgtaaaatggtactttagaatgctagtttgccatcttctcagtttgctggctctcatattaaacctgcttttcccatctaccctcggctctctgtttggctttcaagtggagagcagctggactggggtccggttacagaaagagtattgtgaccttattaaaaaaaatggaaaatatatccttttaaacattgatcatttaaaagccagaataaaagaataatagaaaataatgaaagtaccatcttatcatttctgatatcctcaacaagcgtgctgagccatgtagtatctgagtaactgtaactgtagtagggggcatatgtggtgtgaaatgatgctacatttacagggccatagagcatgagtgtcataaacctatttttactaaattaaagatgaacaattctgttgtagattatttaatttagaatacttttttgatattctactgcattactctgttattagatccctggttcatgcttatcaaagccctcatcacactatctggtaattgcacttgttgggctcatctacaagttccttgtggaaaaggttgtgctttttttttcactcttgtaaccccagcagttactagacagaaagatgtgaacacataatcatgaattgatatgtaaactgtttgtgcattggtatagtgatttaaggatatagatgttgtggtgtgagtatagtatgtattcaaatatcacaaaatcttgtgtaccgagaggattgtttcagccattgcatacagtcattagtaaagatagtcagattggccatatgactatttgttaatatcttaaatgggaaaatacaatgcatatgcattttctttttaaaaattttacctgtaagtgggtatgtgggaatccagattccttgaggggcttaaaatagagggggtcagcctgtggggctcatgggaacaagaaaagagctgctcaaggattacaagctattgactgcttctttgaggaatcccataacccgagccctttagatataatatgcttttatctgaaaagtagaataacgatttagcttcaagatggaaatgagaagaaaatttccttgacactgggattaact

SEQ ID NO: 74613 - DNA, 1030 bp, Homo sapiens
accaacatggagtaaacagaaaataattgggacacaggggcaataaaactcatatattattttcccatgacactcagaggactcttcccaatgctgagacatacatagcgggtcacggctgggtgtttttggacaaaggcttaatgcactccaacctgtgtggtaggaaggcacaatgaaacacatcagtataaaaaccctcttcttcctttttccctttccttggcactttgccatcaccacccgctgccatccacaatacccctgaaactcctttcaccaatgctgtttttgtggttaaatgctgtaaaactcagacacaaaattattataattacacaaatcaataagtaaaacaccatcaacctaaaaaacaaatgggtgaaggacaaatgaagaaagttaatcattgattatcagacttgaaaaaggattttaaccctctagtaataaaactgtaaagtattaacaaaccattttttggatggatatttaattaaagcttttgctcaaaatgttgacactcccaatgtgggcaagatgttggtaaaaatataaattgtttgatttttattggaagccatttggttaatgtcaaaagagtaaaagtattcgtttgagtgactatttccactttggggaatttactgtgaaaaaatactatatctatttgaacatggagtaaggttcatgatcctcagagaagaagaaatcccttatatttgattccttacaataattatgaaaaacagtattaccatactttcacttaattatttggctttgaacagttaagtacagtttagtgaggacacattggaatgatctcaatcaatgctagctcatggatgcttatggcagtcagctgatagaattagttaaaaagatgactaagtagtttaacagaaacgtagtaactattttttgggtcttccagtgccttcaagactgcaagtgtttgatattgtttaaacaaatctatcaaagtaaatgttttgttgtggagatcatgaatattcacttacaggat

SEQ ID NO: 74614 - DNA, 1096 bp, Homo sapiens
aagctctttaggttaaactacaaccctctcacctcaaagaatttgtgggccagggaagtcagtgacttatgtgaagtcttgcggctaattaatggtagagctggagttaggacacatgtctcacagttcctagttcgttttgctttgatgtgcttgaaattcagttttgacattaatttttctggatactactcccataaaatgttctttgaaaaatacttgcttctttctagtttttctcgcctggtttaaatattgtcctgagtgtgggaaccccataactgtcttgtgggttagaatttagatggaaggatttggggccctgtctctagtatcataagacatttaaccttgctgcttttttcttctaggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctccatatgcctctggctctgtttttattctttgctggtatcagaatcctttttttctcttcagtcctctgtgctgaactctttatgagttggtaacttacagctgtgaacctgcctccttgttttcattaagtatatttgaagttaatggcaaaaggcagtgctgacaaccctgggaaatggcagtcctttgtcttcttcctggagcaggtaatcctttactaatccttcgattgttacaggtgcttccactcttatgacagtgcattcctggaactgcatcattatgcactctgctagaaattgaactaagtatgtgctaccacatttacatctgtttcaacatgttttagtggtaaaagtgaaatatatttctcttaggcagtgtagacagagtgaaaaatgggggttatgtatgtgttgacttataagatacaatattttccaaagcaccttcacaaatattctctcattttattcttgcaattatcttaggg

SEQ ID NO: 74615 - DNA, 1009 bp, Homo sapiens
atatttttgaatgaatccatgacagaaagaagctcagtggatttcagtatttaaaaatgtatatactttagttttttccatgtttgttcttctgtgtttctttgtgaaattctttttttttttttttttgagacagagtcttactgtcttgcccaggctagagtgcagtggtgcagtcttggctcactgcaaccctgcctcccgggttcaagcaattctcctgccgcagcctccccgagtagctgggactacaggcacttgcccggctagtttttgtatttttagtagagatggggtttcactctgttggctaggctggtgttgaactcctgtcctcgtgatccactcgccttggcctcccaaagtgctgggattacaggcgtgagccactgcacctggcctgtgaaactcttttttaaaaaaaaaaaaaaaaaatctcagtccatctcaggtgttctgaagggtaatgaggaaaagaaggacagaactgtattggatcacagtttgagaattaaagttcctgatgaattgggccctgggtcagaaggaagggtgaactgggcccaaagggacaaaaccttgcttgaaaatgtgctcagctcccagggagatagttgccaaatgcctgtgccttgttagcattgttttgtttttataatggagaccattctctcacaagtcttaaaaaattcagtgtttgatcctagctggaacaagggggctacagggttgggcagaacattttaaactctgactggcagcactgtttacaaacatgaaattatgttggcttttcgaattcagttaaagtatagtaatctagaaaattacctcgggaaggggaacttgatgttattctgtgggctttgctgccacctagtggatggtatgtttcatgtgttgagcggctactacaaaacatgaggagttgagtttgggggaagaagctactgatacctgtgttaaaaaacctagtttctttccagtcattggggggcagcagaggtcc

SEQ ID NO: 74616 - DNA, 1298 bp, Homo sapiens
ggttccagctggtttggccagccagtgtgtattttttaagttttgtccgggcacggtggctcatgcctgtaatcccagcactttgggaagccgaggcaggtggatcacaaggtcaggagttcgagaccagcctggtcagcatggtgaaaccccgtctctactaaaaatacaaaaaattagccgggcatggtggcgcatgcctgtagtcccggctacttgggaggctgaggcaggagaattgcttgaacccagcaggtggagattgcagtgagccgagatcatgccactgcattccagcctgggtgacggagcgagactctgtccccgactccccaaaaaataaagtttttgattgtgttgcccaacttacttgtgcaattcatccatttttgtgtatagcagaagttctttttcattgcagtataatattctattgtttgtatatgctataatttatccattttactgttgatagacattagattgtttccagtttggggctatctgggtatcatttctgtgtatgccctttgatgtatatatgcattcatttctgttagagtagaattgttgggtcctcgggtatgtctgtgttcattagcatatttattttatacttctatataatcatttttttgtgttttgcttcttgtgcagtttgcctgagaatacagatcaacccacagaacaaagcggatttccaaggcatctccccagagcgagcctttgctgattttctctttgccagcaccatcctgcaccttgttgtcatgaactttgttggctgactcattctcatttacttaattgaggagtaggagactaaaagaatgtaagtgatgatcatagtccttgtcctataatgttgattttaggaagagaaattggatgggactggttttgatcatggttggccaggctcccatactgctattgacatttgcagaattttccattggtctgcaaagtatgcattaatatcatcataattcatcagtgctactgctcttggtcattgccttgtctttctgttcttcaaatcattaaggtaatagaaaattaatgtttgtagctagtacaataatttctgtaccaataactccacgaaaataactcggagattttggaagagacataaatggtaggttttgcctttagatttgttagttaatttttttctgattttgatctcagatgacttttaatgctggaccattgttttcatagcacttaaatttgatagcatccagtgtatgttgaatgaatgactgtgggcatttgctaatatgtgccttaaa

SEQ ID NO: 74617 - DNA, 1154 bp, Homo sapiens
acagagaatttaccttattcttttgaataattgcatgggatttcattgcatgtcagttgtatagtttaatccccttgatgtttagactgttttaatttttttttcaactttacaaacatactttcagaatgtctttgttctgtaagataaattcctttgtcaaaaggtaaaatcattttaaatattaatggatattgctagttgctctcccaagtggatgaatgaatctgtactttctacagcaggggtttacactggttacccttgcttcagtcattgtctttaatatttttaagggtctggatacctgaaaggatcaatggtgcttccatggtgtttacatgtttaagcataatgaaaactgttgccatggtgacaggctctggagaactagtctgatagttttctggcctttggattagatttgtttgttgctttttcttagttaatgatgggatgatgctagcctgaagcgagtttaggttttcttaagcaatgtaataatttatcacaggcataaagatacttcggaagagtgtattcctggaactgcctgtttttttttttttgtcaatggtgactgttagaatcttcaaggggatggagtgtggcagtggagagttctcatgaattatctctcttaggtcttctgccttttttgagacaaataagcagctgctagaacttcgagatcaaagatagtttatcgagaactgtgaggttctcaagaatgagcgtgctatctttataaactctgctacccattaaatgaatattctattagaaaataattcacatttttataactttttatcattcagcccggaccctttgttgttgcctcaagtgcatccccatctaggtataattagaaacctttaaatcagcagataagagagctttgtgggttttttggttatatatttttttctctgagaaagcctctaggtttcagtgtaactctgagaagtaatattttttttcctttaacagagtgcgaaatttaattgtacaacttgataaatttttaaatgtacctgtctaaccactatccagatcaagatgcaggacattaccagcaccatagatgcctccttgcatcttcccagttatcctctccctgtgaaagataaaaaccactatcttgccataga

SEQ ID NO: 74618 - DNA, 1042 bp, Homo sapiens
caggttatccacccgcctcgacctcccaaagtgctgggattacgggtgtgagccaccatgcctggcgtctgtccttgtgtttataacatgtcaagattgttcttactgtctagaatgctctgcccccagatttttacatggttggttccttatctttcaaatattggtcttaaatagcaagctcttaaagagaccttctgttatgattgaatttaagaaaagcttcccagtcactctttattatcctgttttattttcttcatagtacatatctctacctagtagttcctggtttatttgttaacttattgattatatgtttctctccataggagtgtaagttccttgagagccagactgttttgttctgtgccatattcctagcacctgaaatgatgcttgtcatgtagtagatgtttagtaaatattttatggaataaatggacatttaaggggatagagtaaatcagaattgctaaaatggaacagactgcttgaagaggtagtaaatttccatctttggaagtgcccagggagagactgaaggatcattggtagtggagcattttgaacaggcttttttttttgccttttttgtttccaatgcatctgagagatgtgatatccttatcagtaacacaggctctggaaagttgataattctccatctggaggtggcttaccagattctgtaagtggtgagtatactttggaaagcttcccacgtgattagtacgcctccccaagcatggccaccccctaccacctcttgggcattgtatacatcaaatggggtgttggtgtttatgacctctgaggtcctttccaactttgtgggactctgattcatatgttttcattgaaataatctggttaccatgatcacaataataataacatcaatttattaccttatccaccttcatggataatttttctttttttccctcatatttcctcaaaactcaacaccgtgttctttactccaatgaccactattaatagttttctatttcttcagatttttttctagattctaact

SEQ ID NO: 74619 - DNA, 1022 bp, Homo sapiens
aattccaaattagtaaatccagttgccaacttgatgtcttcacttgatgtctgatatgtaccttgaacttaacatgtccaagatcaaacctgctcatccagccatctgcctcttcaccagttagtacgtggtgtcaatgttggttgtggttttttttttttttttttttgagacatagtctcactctgtcacccaggctggagtgcagtggcacaatctcggctcactgcaacctccatctcccgggtttaagcaattctcctgcctcagcctcctgagtagctgggattacaggcacgctcccccatgcccggctaatttttgtatttttagtagagacgaggtttcgccatgttggccaggctggtcacgaactcctgacctcaggtgattcacccacctcggcctcccaaagtgctgggattacaggcgtgagccgccatgcccggccggttgtgtttttaaatgaagaaatttaagtttccggggtcccttgatttctcttatctcctgcatctgtttcatcagcaagctctgtcttctccaaaatatagcctgtatgtctttatttctgtccatttttactaccattcccctgagctctttgggtcctaagtaattcttctgcttctttttattttttatatttttgagacggagtctcgctctgttgcccaggctggagtgcagtggcgcgatttcggctcactgcaagctccgcctcccgggttcacgccattctcctgcctcagcctcccgagtagctgggactacaggcacccgccacaatgaccggctaattttttttttttttttgtattttttagtggagatgggtctcaccatgttagccaggatggtctcgatctcctgaccttgtgatccgcccgccttggcttcccaaagtgctgggattacaggtgtgagccactgcgcctggcctatttttatttttatttttatttttttgagacgcagtctcactgtgtcgccaggctggagtgcagtggcgcgatctcagc

SEQ ID NO: 74620 - DNA, 1032 bp, Homo sapiens
agaaggaaccttgatgagaacttttgatttaattttgtttgatgtttttgtttccaggtctggaagagtaggagcaaggcagggtctgaaagctgattttaaaaaagatgccttctccatgtagaagtcaccctgccttcataagcctctagggtctagaatgatttttcatggatgctttgaagaatgtggtttgctgaagagtgggcatggactagagttatagattatcagtgtaataaagccagaaggtttttttgagcaaatgactttcacttatgccaagacctgtttttgagcccgttgtggctgaaattgaattggcagactggactgcctttctcctctccagtgggaactaggtggcttgtcattgaagaaaaacctagtaaaagggcatattagtaatggggccaataagggggattaggatttccagatctgttagataacagataatagagctatagaaatgaaagcaacttcaagaaaagaagggattcatgataattcttagttgccacagaagggtatgatttacccttcttttgacagcattgactttcctaaatcctgcctcttctgccatttgttagcctagatcatcaactggagactggttttaatgggaaatttggacgcttatcctttgttttgattgttggcaaaggtagccttgttcctttttatggtgctggggtttctaactttcctgtggaatttcctgttgcaagagaatggaggagtccagtgagctgggagagggaaatgtaggcgatactgttgaaggattaggtagtgctgggtgctagatgtttgaatgccaggccaaggaatttggactttttttgagatggagttttgctcttttttctcaggctggagtgcaatggcgatctcggttcactgcaacctctgtctcccaggtttaagcaattctcctgcctcagcctccgaagtagctgggattacaggcatgtgccaccacgcccggcgaattttgtatttttagtggagacggagtttctccat

SEQ ID NO: 74621 - DNA, 1609 bp, Homo sapiens
ttccaggactcagaaggaccagagagagccggatacctctggttagctacgcggtccccagtaaagcttattcccctcttcctcccagtgtgtcttgttgccagagcaactgtgggcgtcaccgagctgacgggcggaaacagaacagaaagagtacacgtccccagctcattgatagggccattgcgcagacgcattaacttttctgagttgtagttgagtctgttgatgcagtccgcgtctgcgcattagttgttacgcgccctggccggcctcagcgcctgcgcaaattggcacaccggggagggcggagttaggtcacgagggtgcgcatgcgcaaacagcacatccggtgtggtcgacgggtcctccaagagtttggggcgcggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggtaatggttctataagtgatcataataataatgtgttactttggtgtgctgcttttgttttcatagtactctatatcagaccaccgccccttgaagttatgagaagagcctgcattgcccttttgttgtgaatggggaaattgaggctcagaaagcttagattatatgcctaataccaaacggctccgtaggagttggacttaaaagtctaaagaaaccaccttcgtgccgctactccacttggtgatccacttcacttaatattggtccggggaaaaccctattccaactttaacttaggtttaacacaactctaaaattagtagacttttcaaatgaaaaacccaaccttgaatcatctctgtcatcttggcctaatcattaccaatctccggtgaaacgtttcaatgaaagtgcaaagaatataaatactggtgcttttcttgttgaatcatcctttacttgattttgccttttagctgctactactttttttcttgttgaggaagctgttatttcactgtcctgaacccaatttttgttcacataactctattttagccttatttttccttttgattccaggatttggtaaccttgtagactgctatatttagcgagaacagtctccatcaatttttgttaaaatctgacttttcttgcccaacggggattcagtgaatactgaaaacaggcgtggcctctatcactggtatcacctgctactttgactttgaaaacatgccagcattcatggtttcttttcagtgtgatcatcagtcaggtcatcagttgtattttcagtccaatatgaggcattatggtaaaagctttggcacatgttctttatccgtaaagagtttatggtctagttggggtacagacaaaatacagcattggaattgtctggaggcctggcacagtggctcatgcctgtaatcccagtactttgggaggccgaggtaggcagatcacttgaggtcagg

SEQ ID NO: 74622 - DNA, 1057 bp, Homo sapiens
ggaggaagaggggaataagctttactggggaccgcgtagctaaccagaggtatccggctctctctggtccttctgagtcctggaagatttaacggtttgcatctactttgaggcaatgcctggcgttcctggggtttgataccagcctgaccctaattctgttaagggcgctgtctgcagatgtctgtcacagatcattggaacaagtcaagttcatccgcagtgagacccggcgcggccaatcactgcacaggccccagtttagacttaattacttgggggagtgagtgggtgtggtgaggggcgggaggcagggaggaagcctgacctcagcagggttctgaactggaactcgggatctggccctgcaatgccaacatttattgggcgcctccttggggcctgacgttgtactaacttgtagggactctcacgtgaatcagatatatttgcagccttaaaagagctggtgaagggagggacagctgtcgaatgtcgtgcaaaaagcatatggtcaagtttagcagctctctttccgcaagctggtatcttgaacctggtgtaatatcccgggatgtcagcgtcgaaaggcccgaaagagcatgcctggttcaaccctactctctccaactcattttgcagaagaaactgaaatggtttcaggttttgtattttaacaagtgggattattttgagggttttaactgtttttttttttttttttttgagacggagccttgctctgtcggccaggctggagtgcagtgtcgcgatctcggcccactgcaacctccgcctccctagtagctgggactacaggcacgcgccaccacgcccggctaatttttgtattttcagtagagacggagtttcaccattgttagccaggctggtcccgaactcctgaccttgtgatccgccagcctcggcctcccaaagtgctgggattacaggcatgagccactgcacccggcctgttttaactttttttaagaaattaagttctggctttcgttgcccttttaatttcacgtgaatccgaccttctagacccagt

SEQ ID NO: 74623 - DNA, 1039 bp, Homo sapiens
gaccaggattactgtcccattctgagaccgtcagagacatctctgccgggacacatgccagtgattgaaaacacagcaagggccccactagctgaaaccaagttgcagagttttgagggtcccaccgccgaccgccggcccgccgcgagccctgccccctgcgcggccacgcccccttgctccccgcggcctcccgggtcagctggtgctggcgtcaggcgctgggcgggctcgccaggacctggcaaggcttgtttactatggccgatgatctggagcagcagtgagttaatcctgtccctttctctctttctctctctctctctgggccatgatcctgggactgtctgtggctgaggaacagttgtagacaccttcccgctcttccttttccaggtcggcctccggggagggcggggggtgggtgcgttgcttgctttgcatttgcccagaagaggcagcggctgagcctggggagccatgggagacgcgctcgcccgcagcccggggatcctggctttctaccttagtcctcgcgagtgcccctcattctcctctggcctctggagagattccatgttgatgtgtgagatccccgaaagcaagcttgtgggacgcgggtgcggaggtagcagccaggcgtgctcgtctcgacttgccccccagaacggcagtcgtggggatggagagagcctcctccctccgcccggcaaagagaagatgtggagagactggagaggtctccatcgcgctgaaattggtgtggaacaacgggcttgcaagtttctttagctgtcgcccaccgagacacgtagccgcatgtgatcctagttgataatgcttttaataatcgtaacaacatctttaatgcaatggtttcagatttagagctattgggatttgctaccactctttcaagggcatcaggtttgggataccacctgtaggtggtgtgactagcagttcgcaatctgacaggagtaagaaaaagttgctacgagaagaatgactcagctcccagccgagccttggtttcacc

SEQ ID NO: 74624 - DNA, 1067 bp, Homo sapiens
aaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgataggtaataaggagatggctccatccctcgtgacctaattcctggccttactgggaactttccagtattcatttccaaacttctctcattcccaggcgatttaaggggctatggcaactaccagagaatataatgtgtcttctcctctttccgcctttaacatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctggggtgagtagcctgtagtatctccttaaaggaaggctataacgttctagaaggcccacagtgtctttcccacttattcctaaaaagtggaaattggcctagccttgttatttaaagctgttaatctgaaccagatcactttgttcaaggtttgagaaggttttttgtttttttgttttgttttgtttttttgagacaaagtctcgctctgtcgcccaggctggagtgcagtggtgcgatctcggctcactgcaagctccgcctcccaggttcatgccattctcctgcctcagcctcccaagtaactgggactacaggcacctgccaccatgcccggctaattttttgtgtttttagtagagacggggtttcatcgtgttaacgaggctggtctcgatctgacctcgtgatccgcctgcctcggcctcccgaagtgctgggattacaggcgtgagccaccg

SEQ ID NO: 74625 - DNA, 1077 bp, Homo sapiens
gtggagcagaatagctaccagagtctcactctgtctcccaggctgatgtgcagtggtgtgatctcagctcactgcaacctccgcctcctgggttcaagccattcccctgcctgagcctcctgagtagctgggactgcaggtgtaccccaccacacctggctaatttttgtgttttcagtagagacggggtttcaccatgttggctaggctggtcttgaactcctagcctctagtgatccatccgcatcagcctcccaaagtgctgggattacaggcatgagccaccacacccaatctgtgtgaaattttatgaaaacctgctggtgattcatgcccagtaaccactggatcccatccctgtggttcacccaacacctgcagcagggagaggtcagaaccaaagcctccaacataacccacagtggcaggcaagcccctctgaaccatgcacttgtccaggcaagcaccacatcttcacctgctctgtgtcacctagcacttggtagctgtcagcaaattctgtgggtaaaagggagaaaaggaggtggaggaccatggggagctagccataatgaatagtatcaatatctccagccttctgacctcacactgccagcacccttctccgctggggagctttttactctgatgaagtgcaaagcagaaaagtgcaatcttttccaatggaaaagattggtgatgcctgtcttgtactgatgattgtgcttacagagtaatattcaatagccaattattatgagttaattgctgatggctaagtaagagttatctctctaggtccttcaagaaaaacagaatgattccagataaagaaaaaaagcatttgattagaagataggagtttaggagttctgagagagaggaaggataccaagacacgggtgccaaaggacagtaagtgggcagaggctcccagcaccgtggtctccaacagagtctatagtcctttgccaaaaagaaggtctgctcgagctactctcccctattctcacctctggccaggctcatgcaggagcatcagagctatcatagttggggaagttggccagcagccat

SEQ ID NO: 74626 - DNA, 1021 bp, Homo sapiens
aggcaggacatggctggaccatggtgatacagctctgtgtgattcaagttctggcagagcttgtaaggctagagcccaggtctgccgacaccctgtgcttgttgcacacttgatttgctaaggctggagacaggcaccattgccatggggctggtcctagtcactggccgaggataagcccgtccctgtcccacattctagccccactatgcgggggtgctgttgtcctgcctgtgtctcatccccagctgcctaagctagggacactcaagtgcttccttccttgccccatcttcctcccaactggaggcctctgagcctcccctgtgccttgggccctgaagccccatatgtagtatagagcaaaggtggctcctggtgaagagagggtggaaaggcccttcagccccagggccatgtctgggttctccatgcccatcagtctctgcagtttctctacctgcccccagagctgaggccatctgcaagcccctgcccatggcccaatggggagcctccagccacaagttccctgtccttatcagccactgggtggttcccactgcatgaccctctatccctgccatctgtccccatggtttccagctcaatccacccctgacccatctgtcagctttttcccagggagccgtttcaggggttctgggcagtaggctgggcctggcctcagaacctggtggctcctgcctgctccttcacttttgtaaaaccatccccttcaccagaatggtattaactcctggtgctttgtactactggtccagctgccttgggctccttttctatattaataaagaaacgagtaaaaattaccggtggggatgatgtttaaaattgctctgatcactggtggtgctgaattcgcaacagcctgtgtgatgcctgagagaagggagtcctgagggttgcctgcctacccacgactccttctccttttagtgtggcgtttgcccgctagacccagcccagagtccaggtcagcacaggccctctcagccaa

SEQ ID NO: 74627 - DNA, 2005 bp, Homo sapiens
ggtatcagcagacgctgacctgctcaccgggacctgaatgtcatgacctcgggtcatgtgaggacgcgctagggttagtccccgacactatgggcccagcagcccggtgtcagcttctggaattggcttggctcctggcgagagcacctcggcctcgttctcagggccctccgatgtgggtctgcgataactgagatgcggggaacccaggttcgagcttcgctctgcaggcaccacccgctgcatgccttcgggctagcggtctgcgcgcggtgatagcaatgtcctcccctgtagtggccgagctgcctgcttcttggggagttagcataatgaatcccgtttgcacccacgcgaggacttctgctcccggtaaaggggctccatcatccttttacacgctcaggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggtaagaggcctttcgttcctgcaatattaggagtggtgtttcctggttggtttcatattttgttttgtttgggagcagggggaatatggagcagagttcttgtccacgctccacacagctctccaaaatgatagcatctctgcttaggatggattttcaattcagtggggaaatgattgaaagtacaacaggagagatgttatatttggttttctgagctgttttaaagaaaagcaattgtttcatgttaatatatggcaaaaatcatgatagtgatattcaaatggctgaagtttggaaaacagtgataaaagaaataacttcccagcatgaagggaagtcatggattcttactcaaagtaacttctcttcctaactattgataaaaatgagatgtcctttttaagcttgaaatctgcagacactaggctaacctggaagaacaagaagtagagagaacagaacccagtactggttattataaaaagatctcacttgctttgtgttcgctactgaataaatataatacaaggctttctttcacacaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtaaggggaatataccctggacatgggttagggatttaacctcatagatggcaattctttgaatggattcaggaagtagttgcagaagctctggggtcagaagagcagatgatttcaaatgagcaatagaggttcatgatacctagatgcactctgcctatatttcttaaagagcattataaaaccaccagatcatctgggattcaagaagtgtagatatttgaatacaaacatggggttagagtcaggggaccttattaacagtcatgaagctatcctggtttagaacagaggttcaggtcaggcacttaaacccctaaattgggaagccactagcattgcttttgtaaaggctagaactctgctttgaattatgtgtctttctgccacgttgctccatcaattatcttttctcccctgtgtcttcagcatttccctcctcactgccctaccccgaacatgtaaacatgctcaggcacacccatgtgttacctgggggaaggtttcttcccttcatccttagttccccttcacttactatcctatcttcttcctttgatggctgttatttattttgttgttgttaatttttgtggatacctagtaggtgtatatatttatgggctacatgagatgttttgatagaggcatgcaaggtgtaataatcacattatg

SEQ ID NO: 74628 - DNA, 2783 bp, Homo sapiens
cccaggtcccccaaaaaacaggtggtggtggattatacatggctttcagtagtggggtgatgaaaatgttctctctggtaaagcatgctgacactgtttatcttgtgtaataggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgaggtaagcccagattggccaagtgccaggcctgcaaagtgaactggggttggagggtaaagtagttgtacagaatggtcatccttcacttgctggagaaagagttgatgggtaagagattagagacagattcactgaaactgacagctttcccgacttttccaccccacttcttttggcagctaggtgctgagacaggtgtgcaaagttctgaccttcagtggatgagaaatgtcatcagaatgatgcccctgataaccttgcccataaccatgcatttccccacggtatgtaatgccttatgggctggctccaaggccttctgcctagcctagccacctagcaagctgaccagggatacagcttctgagtcccttctctgtgttctcacccaggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggtaagggctcatcctctgtgaaaaaggactagggaaaggggtctaaaaataggaatgcaactgactctcttgcttctctttacacaggctggaaaaatgctgaaatgacgcgtcagctgcgagagcgtgaacaacgcatgcggaatcagttggagctagcagccaggggtaaatagtcctttcaggccaaattctgtcttttgtttcttcctttctgttcttcgttgaaatttgttttctcttctcccctcaggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacatgctgcttcctgatacttattgaacagggaaatcagtgtgcacttcagaaaactgaagaatacccagcattttgggaggccgaggtgggtggatcacctgagatcaggagtttgagaccagcctggccaacatggggaaacgccatctctgctgttttacaaaaatagccacacgtggtggtgcacacctgtagtcccagctactcgggaggctgaggcaggagaattgcttgaatccgagaggcggaggttgcagtgagccaagatcgcaccaccgcactccagcctgggcaatagagggagactgtctcaaaaaaaaaagaaaactgaagaatagagtgagtcatgattgcttttgctggcccatggccttggaaaatataatgttttaacctggcattaagggtttaaacttccacccaggcgcagtggctcacgccagtaatcccagcacttttgggaggccaaggcgggcggatcacgaagtcagcagatcgagaccatcctggccaacatggtgaaaccccgtctctactaaaaaaaaaaaaaaaaaaattagccgggcatggcggcgggtgcctgtattcccagctacttgggaggctgaggcaggagaatggcgtgaacccaggaggcagagcttgcagtgagccgagattgcgccactgcactccagcctgggcaagagagtgagactccttctcaaaaaaaaaaaaaaaaaaaaaaaaaaaaaaacagtttaaacttccaacccatgcatgtgttgttctatgcacatttggattgcagtctagaggtgtggctgataagttgaatgttgagattgtatctaaatatagtaaccgcacttcttgatcccaagattactttaaaaatttcaagaagtagatgtgtgcaaattcttagtgataattaagaatgaaagttccaggctgggcaaagtggctcacacctataatctcagcactttgggaggctgaggtgggtagatcacttgagtccaggaatttgagaccagcctgggcaacatggcgagaccttgtctctgctaaaaagttagctgagcatggtggtgcttgtccatagtcccagctacctgggaggctgaggtgggaggatagcttaagcccaggaggttgaggctgcagtgatccaagatcatgctgctatactccagccttggctacagagcaagatcctgtctcaaaaaggaagttcatgtcatttttatgtaacaatccaacatttgactagagcagtttaagtgttctgttgtctgcctttgtgtagagcctggtttatcagccttcagcagctagcttgagagagaaaagatggatatactt

SEQ ID NO: 74629 - DNA, 3909 bp, Homo sapiens
caggctggtcttgaactcctgacctcaggtgatccacccggctcggcctcccaaagtgctgggattacaggcgtgagccaccacgcccagctgcttggctagttttttgtagagacagggttttgccatgttgcccaggctggtctccaactcctagactcgagccatctccctgcctcagcctcccaaagtgttagtactacaggcatgagccactgctcccagctgcacagtcctgtctcctaatatgatattcctttcccctaatgttctttagttcttaagtgttcagagcttcagccactatccagggcaccgtcaaagacaaatgcattgaggaaatgtagcaacagtctccatccctggaaagaccggtgtggcagggagagtctaaggattaaaggagagatagggatatgactgtgggactaatgtgcattttattctatttggctgtaggaacctgcccctctccattggcatctccatgcccattgtcaccatcatctatatcttgaccaatgtggcctattatactgtgctagacatgagagacatcttggccagtgatgctgttgctgtggtaaaggattttcactagcagaaggttgagggtgtcttgtggggtactgggtatattctggctcttgaaagtcctggaaagggggtagacagccttgaaaggagttcatttagaataccgggcttgcaagaaggtcctgttaaccccactgtggaagaaaggttggaatacctaataaggggaatctgggggcatgcccatccatgtctttcatcccttttagatcctgctaatgactcttccattcttttcccttagacttttgcagatcagatatttggaatatttaactggataattccactgtcagttgcattatcctgttttggtggcctcaatgcctccattgtggctgcttctaggtaagagtggcaacttttgtgaggggtgtatcatcaaagggctatgcagtggacagaacttacaggacccagcctttgattacttgtgttctccaaccgataccacaacctctttcttcttgtttctagcagaagcctgcagttgtcattaatcttaatactgagctccagtccatattatccaaatacttttgaaggaagggatggcagagagggagggccatgtggcaggtgaaccaggctgcaccgtgtccaccaattttctcagcttctcctatcttacctaacataggcttttctttgtgggctcaagagaaggccatctccctgatgccatctgcatgatccatgttgagcggttcacaccagtgccttctctgctcttcaatgtaagtgaactcaaggatgagactgaaagccagattgcgggggaaactttagtaacagcagaagcgactgttctagcttcctgaaagctctgaaagattccaatagaaaaactattggtggatcagaatgttcaccacgggcaaggcactatgctaaccgctacaggggaaatccaaatgctctaaggaatggtacacctctgctctaagataaggcaaaaagtacatggaatacactgtaatgattgattgccatgacagatagtgagtgatacggtgtttaagagaagaaacgatcacttccatgggagtagagggtgaagaattacatctagaagtgtgtgtgtgtgtcttaaaatccaccaaagtgttctcagaaaaaaaaagtgcatcttgatggctagggttgcaaatggtagagatgggctttaggtaggagaaatagcatcagaaaatcctgtgataaagcagtatgggttttaatacaggttgagtatccctaatctgaatatccaaaatctgaaatgctctaaaaatctgaaactttttgagtgctgacttgacactcaaaggaaatgctcattggagcattttggattttcagaacagggatactcaacatgtaggaggagataagagcgggttattgtaggttggagccattatggaaagggtcctatgcaagacttttgagggattgtttcgagcttgctttatacagggttaacttgaagaatgggttgaaaagccagttgagactactgacttataagagaggggataaggtactgaaactagggtgttaaagggattaaaaccagaagaggaccaggagactttgaggattgacaggggatggatttctggggtataaagggagtgaaaagcctttggattaacaaaggccctgagaagagctgacttaggctcacgcttacagggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaaggtaaggcaactccatcctacctctgctccacctgaaacagctggagttgttgctacaagggactatgacaaagcactttatttagaaacctttgcctgggacttggtcgttagtaatgtgttgaaattaaaggtatggaaagaaggctcagtgcgctaatccttatgggaggtggggttattttagctgttaagaatcctgagttgtccactccagttatgtttcctgtgcccttagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtgggtaagccgtgcatccttaagtccgctcagctattgcagagcttggtttttgcctttttctgtaaatccagcctccaaagacatctttgccttagccccttcttatgaacccttcggcttagtggaatcactcccctcacactgagttccattcagtgacacttgaactcagcccagctgacctcttctcaattccaactcaaagttctctttgtagggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaagtctgagtggcttcattttatatagtatctatctctaggacagctcccattagcctagaaacacaaagactaaaatcaatcttatgcttgaaagtatatccatcttttctctctcaagctagctgctgaaggctgataaaccaggctctacacaaaggcagacaacagaacacttaaactgctctagtcaaatgttggattgttacataaaaatgacatgaacttcctttttgagacaggatcttgctctgtagccaaggctggagtatagcagcatgatcttggatcactgcagcctcaacctcctgggcttaagctatcctcccacctcagcctcccaggtagctgggact

SEQ ID NO: 74630 - DNA, 1026 bp, Homo sapiens
tctctatagacgtctctcttctgtttcctgttcccttactggtactcttgctgccaaaggtgttgtaggccacttacctgctattatattaccatattctgtcagtcctttacttgaccatcttgaagtgggagaatgagccactaatcccctgccttccaatgttcttgggttccaggagcctctactcattttgagaattcctttgagggttcatcatttgcagtgggtgacattgccctggcactgtactcagctctgttctcctactcaggctgggacaccctcaactatgtcactgaagagatcaagaatcctgagaggtaggtactgcaccaccaactttccatagcagtgatagccatcatttaatgagctcctactacgtgccagacagcataccacaaccactatgaggttaattttaccagcctcattttaatagatgggaggcctgaggctcagagaagtaacttgtctatgatcacagtaacagggctaaaatatgaacttactcatgtatgctttgtaaatttttaaaggcatttttacatttgttcattaatttctgcattaattaaagcaggttgtattatatgcttatgtatgtttttaaaacagattttccttgatagatattttatccacccttatccccacatacatagctttgggatatagacttccagaaaccttcctgtgtttccctctgataccttccttgtttcctaaattcatactgacattgtggtatagtttcagtcattcaattaagtcaccctaccattattgctctgtagtctatatatagagtgaaaagagaactggacaggaagtcaaggacctagagttgatctttccactgacttgttggctaaccttgagggagttgcccggccatctctttgcctgtttccttatctgtaattgagggggttaaattctgtgatctccatggcctttcctggctctaaaattctatgattctgggaactaagatttgccagggagtggagtttcggtaaa

SEQ ID NO: 74631 - DNA, 1312 bp, Homo sapiens
ttccagttgctgagctgggaaggagggagcaatgaagcgattcgctatgctaccagtgggaagatctgtatttttttttccaactttcttctcggccacattctggggctactggtcaacctcacagcatgcgtgagcctcccttgttgaacttcttcaagtaattcaaattcaagtcgtagattgtaacttttttgttgggggagggataatggacttgagattctgataaaagctatgatccctttctaagaaaagatatgaaactttttcttaggtatgtctgtattcatatggacataacactttgaaagagaatttcgagcctcatggaggccctagttaagaaccctgataaaaggtacttttaaaacctgtacttctgagtagaaggactgggggaatgtgtgtggctcttacttctctattgtcccatcaggaaaaatgccctgtccccattctacaggaaccactcttagctgcaagaatctttccaagcacaaaagcaggcagctgagctgccaggcagtgggcaggaagtctggccttcatcctaatccttggccacacagcctgacctgctggctcagcattggataagtcacagcagaactcctcaaggttaacagtaataccacagagtcagagtgctgtgtcctggagcccatggggaatgggaggtaggagggagagaccatgacttttcagagccaagagccggaacaatcactaatcctgtacagttcccagttgcctcccactgctgtgattggacatttggatgtattttttatgtaagcagatctgcagtcactttgttttgtgtctcccatataaggtgctgggggtggggagtatagaggcctttgtatgataatggtgaggacattctggggccccgagggttccagtgcagagcaggtcagagggtctgtctttggctgaagggtatatatatcttggtgactggtactggaaaaattgcttgggagtctaaggccctagggtggtaagggtaagtcaccaatcagtattatttttctttcaggtctcttaaccttcattaactgtgcctatgtcaaatggggaaccctggtacaagatattttcacctatgctaaagtattggcactgatcgcggtcatcgttgcaggcattgttagacttggccagggtaagaaataatattagtagcaactaatcttttttaagcattttctgtgagccgcactcctctaagtgctctttgtgcattatctcatttcttactataaccttattcggtgggcactattattattctcattttatg

SEQ ID NO: 74632 - DNA, 1086 bp, Homo sapiens
ggggttgcagtgagccaagatcatgccattgcacttcagcctgggtgacagagcaagactgtgtctcaaaaaataaataaaataaataaataaataaataaataagtcaataaataagtaaataaaaaaaaataataaaatataggccgggcgcggtggctcatgcttgtaatcccagcactttgggaggctgaggtgggtggatcacctcaggtcaggagtttgcgacaagcctggccaacatggtgaaacctcatctctactaaaaatataaaaattagctgggcatagtggcgcacacctgtaatcccagctacttgggaggttgaggcaggagaatggcttgaacccgggaggcagatgttgccatgagccgagaccacgccattgcactccagcctgggcaacaagggtgaaactctgtctcaaaaagaaaaagaaaaataaataaaataaaatataaacaagccatgtatttccatttcagaatctgctgtggtagcaggtggtgaattggttgcttatccctccttttccctgcctacatccctggacagaactgagaagaaccttgtggcacacagctcagactctgagtctgaactagagctagtcctgtaagcttattccagtttggtgttatgactcatggttaccctgcagggaatcataaatttgtatttggggatcccattttcctgacaatgtggcagcatcctttgtgtctggtgtttctacttggaaacctggctatgttgtggttatgagccagccgcagagcctaggataagggcagaggttacaagctggggagaaggggcactaagctgttgagtggctggaggctggagtccagtggggagtaaaggatgggtgactggctgaggaggagtgacagatttgaaagatttgtggagggcaagatacagccactttggtcattttgtggggtgctgcacacttgtgtcttaaattattaacttagcactggggtggcctggagctgtgggtacatttttgcccagccctgtgataaggtttgttgtttattaggcagaaaggcaagcatttatataggacaggaat

SEQ ID NO: 74633 - DNA, 1091 bp, Homo sapiens
gctctgtcaccaggctggagtgcagtggtgtgatcttggctcactgcatcctccgcctcctgggttcaagtgattctcctgcctcagcctcccaagtagatgggactacaggcacacaccaccatgcccagctaatttttgtatttttagtagagacagggtttcaccatgttggccaggatggtctcgatctcttgacctcgtgatctgtccacctcggcctcccaaagtgctgggattacaggcgtgagccactgcacccggccacgagtgacttctttgcagattctttttttctccccctggggtcaaagcaggagtgctgctgcaccgagtcaagggtcaaaggtgatttcaggttatcctcttatagacttggcccagtgttgggtggggattgaattgcccctagaggtagaaggggagggcatctctgcccttgaggttaacttgcagttgcctccatattatcctaaccccatggtcccctcctgtccttggccctgaagcaggaggttgggctccacttcaagagcagtgcacttagctgggctctggggccagtggtcagctgtatccgctgaggtggggacaaaaagccctgtcagcactgctgcctgccatacccatttcctgctcccacagtcaagaggccctggaggaagctaggctttgaggaagaggagggctagctctcttcaggcagttccctctgctccctggtttctttctgtaggattcccttcctcattcaaactgagccttctgtgctcagtacagagagcagatcagggctagaaggtgggtcagagaaatcaggctcaggagtgggggaggtgggatactggtggacaaagagagggatacaaatggatggatagagaagtagagaagagactgggcacgccacgccggtgactcacacctgtaatcccagcactttgggaggctgaggcaggcggatcacctgaggtcaggagtttgagactagtctggctaacatggcgaaaccctgtctctactaaaaatacaaaaattagctgggcatggtgttgaatgtctgtaattctagctactcgggaggctgaggc

SEQ ID NO: 74634 - DNA, 1340 bp, Homo sapiens
agtgacctggcacacagttgtcagttaaaaatagtatctattactgcaagttatattcatatcatatgcatcttattgatttctaaaagctttaccttccgcatgctgtctttggatgacttaaaagcagtttacattttacttcacaatagctcagggatcagaaaggagggctgagccttttctttctgttttgcaagagaggtggaactttcctctcagcaagaggataggtgtccagaagtccagctccacccgactgtcctttcctcagagccaaggtgttttggcccactgttcacaggtggacatgactgttcttgccttacctacacttgcccacactgagacctagttgttttgccattcaggacactaccaggacatttttaccatctatgccttcagtatgtcccctgtaccagtgagtcagcagtacctggcagttcagggctctttgtttacagagtactgttcttcagggatcaggcaaagattcttcgtgtcatacacatgtggccacagtgaattgcatgtagtgggttcttcaataaatgttggctggatgaatgaacagaagatatgattccaggttcaacttggctgagaagggtatttcgtgcttttgcctttcagggtgctggtgggggctgagggttgctgtgggaagggggcagacagcttaccctgagtctgccagagccgctgtgggctgtgaaggactttggatctctgtgtgtctgagagctttggccaggtgtcctcgtgcagcttctcctggtaccagaatgactgatctcatgtacttgtggctaatgaggtggaacagtcagatgctgggccccccaacggacttttgccctttgaaccttctacttggaagctagttgcctttttcagagggcttttcccaagagccatctgagggtggaggtgaagaaacttaccttttctggcccatattcacctcaagaaataggctttcatcagagccttgggttctagtgtgggtttgttgtgaactttggaacaaactcttgaccagcagtgaaggggtagacctttatgctgctttgatcatcaagtccctttgggggctcatccttgctctcttcctttctatgttctatgtttctatgttcctttctttttctctctgcctcagaagaagctgggcaggtagcctagaggaggttgcggaagatgctgggcagcagtgggtcctaactctggctgtggattggaatcatctggagaattaagaaaacaaggccgggcacggtggctcacgcctgtaatcccagcactttgggaggccgaggcgggcagatcacaaggtc

SEQ ID NO: 74635 - DNA, 1062 bp, Homo sapiens
tggaaacctggaagatggtgagtggaagggagtgaattgagaaggaatgaatgactacctgtgtccaatctgctaagaggtcaagctaggtaaagattgagtatagttgattggatttattgatatgaaggtcactggtggcttttcatgtgggctttctcctaaggcaatgaaatttcagggcagtgagggtgaaatcaggtttcagaaatatcatttattcacccagcaaaatgtattaagtgttactgtgtgtctagttcaggactatgcccatgggtacaaggataactgttatccactctctgccctcacacagctctcgtgggtgggagagacatatgtacactgttctaatgcagtgtagttaattggggaggtgagagcacagagcaagggcagcataccagaggtggcaggtttacactcaaaaatagcctttctggaggagctattaagtttaaaataaggaataaaatgtcatttggaattggcaactcagagggtcaaaggaaaacttttgcagggtgaaagaggaaggagttgcaacatctcagactgcattgtagagacccaggaacgggaaggaatgtagacatgctcttcagatgaatgattctgaaagcatggagggtgattgttagaggaaaggaccaaggttgagggacgattttatgaaaaagagttaagcctgccttaggttggttgaggtatgtttctggaaaagttggatgaaatatctctaccctacaatgatgccttctccatggctgtaatgattgggtgccctgagtcagacttctttttcttgaacagtgtaggggatacccttatccctttggaaggcactggtgcatggtggtgaacagcgtggaatcaggcaggattcaatcaatgctaggtcaaatttattagcctcagtttcctcttgttctccttctccttctccttttcctccttctccttcttcttcttctttttttttgacagagtttcactcttgttgcccagtctggagtgcagtggcgtaatctcagtttactgcaacctccgcctcctggg

SEQ ID NO: 74636 - DNA, 1109 bp, Homo sapiens
cagctactagggaggctgacacaggaggaacgcttgaacccgggaagcagaggttgcagtagccgagatcatgctactgcactccagcctgggccacagagcgagactctgtctcaaaagacaaaacaaaacaaaacaaaaagaatacatgcaaagtagccgcagttatggttcgtatgcagagctcttcagtgagtaaaatgcatagagttttgtacacacatgtgtgacacacatttgagatttctctgatagagtgaaaggtgcacagcacttgtgcacacacttgtgtttgaggttgggctcaatagctatgtgaccttgagccaggtgcactgactgtttaattccaggctgttgtgagaatggaatgagattcagtgaaaaccatgaattatgaattatgtttcaaattactgtctttcttggtcacttatagtcctgttcctcttcctgcttcttggcttcatctgagtagttatggttagataaatgaaatattactgcatagataatatctggactttgttctatctttgataacttcagaggagcatagagatctaaagaaggttcagaagggcaaccaagactaagaatttagtgacatatgattcatgggtttattccttcagccactgttttggttttgttttttaattttctttaatagagatggggtctcgctatgttgcccaggctggtctcaaactcctgggctcaagctatctgcctgccttggcctcccaaagtgctaggattacgggcgtgagccattgtgcctggtcttcaggcactgttgaataagcacctgacacaagtcagatgctgggacctatgaagacattctgattagcctaagtgagaacttaggcagaatcttcagatttagcaagagaagggctttaatttagagctttcatacattccctcccttagaaaaaatttaattagggcatgctatgtgtgtgctagatattttacttagtgctgaaaaacaaagaagaatgatgtctggcccttgccattcaataatttatagtccagaaaggagactgacatgttaacaaataattgtcatgcaatataatttgtacactgatagaggc

SEQ ID NO: 74637 - DNA, 1978 bp, Homo sapiens
aaatgcttcatattatttcatgtgaattttaaggatgcatagtagtttatttatctagctggtcctctgttaatggccatgtacgttggtttcagtttctcagtcttacagataatgctccagtgaatatctttttgcagctgcatgagtatttctgtaggctggattcttcctttttttttttttttttttttgagatagagtcactctgtcgcccaggcttgagtggtgcaatctcagctcactgcaacctccatcttctgggttcaagtgattctcctgcctcagcctccctagtagctgggattacaggcatgtgccaccatgcctagctaatttttttgtatttttggtggagacggggtttcactgtgttggccaggctggactcgaactcctgagctcaagtgatctacctgccttggcttcccaaagtgttgggatcacaggcgtgagccactgcacccggcctctgtgggctagatttttaatactgtcatttcagtccaccttggctttttctccatctcataaataaaacattatttaaatctgtacattcagtaaagccattggaggtgctgagatgatgattctccatagccccatccctcagatgccactattcttgaaaaatgcccttccaacctgggagagcctaggaccttagagatgccttccaccctgcaactgtgaagaagctcagacattctgtcaatttgaggggcagctgctctagcagttggggcacaggaattttgcaccaggtgcaattgctcattggctcaccgctctccaatcagtttgtgtccttttttctttcaatttctgtattgccccattcactcctcaacttcctttccagcttctctgattttactgttgtgtagagaactggctgtcttctgtggggtccttctgtgttttgtgtgtccttgtgtctggcctggactcatctctgcatatgggatgtttgtcatacatggcaacagtcagggaggggtggaaggcactgctttgtgttgcaagaagggggttttcactgaggttttttttttccgagacggagtttcactcttgttgcccaggctggagtgcaatggcacaatctcggctcaccacaacctctgcctcccgggttcaagtgattctcctgcctcagcctctcaagtagctgggattacaggcatgtgccaccacgcctggctaatttttgtatttttattagagacagggtttctccatgttggtcaggctggtcttgaactcccgacctcaggtgatccgcccgccttggcctcccaaagtgctgggattacaggcatgagccactgtgcccagccttcactgaggtcttaaatatgatctgtgatttctcttgcattacttgcagatgatctggtaggttgcttactggcaaaactaattttaggatctattggtcttggagcaccctcaaatgtgggcatatggttaattatatcatgtgcagagaaggatcatttcatctaagtaatatttctaagatggctgcattcctttaaaataccagaaatctatttttttttttttttttgagatggagtttcgctcttgttgcccaggctggaatgcaatggcgtgatcttggctcaccgcaacctctgcctcccaggttcaagtgattctcctgcctcagcctcccgagtagctgggattacagatgtgctaccatgcccggctaattttgtatttttagtagagatggggtttctccatgttggtcaggctagtctcgaactccggacctcaggtaatccgcctacctcggcctcccaaagtgctgggattacaggcatgggccaccttcccggccttagaattctattattttaactatctttgtctgtgtcatttctgacagctcttgttcctcgattctgaccttgtgcctacctctgccagtcaaccctttttaattttctgctgttgctgcttt

SEQ ID NO: 74638 - DNA, 1359 bp, Homo sapiens
cactgcactccagcctgggctacagagcgagactctgtcaataaataaataaatacatagatagatagacaaatattcaagttggggttgttttgatgagtgagctggagaaaaggttatttggaggtctccgcattggttggtgagctgcccgtattaccctgtgttggaggcgggtagaggttctatgtaattgccaaccacctaatctatagcatcatctttcttccttaaagggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtaagtggggctggggtaggaggtggtgggtggagggctggacagaggctgggatgtgagtgcagtctgggagtaagaaggagatagagaggaatgtctctgacaacatatatatatatatatatagttaaagtatgctttgtgtgaaaattcaaacagtaccacagtgtatcgcaaaaacactcaccttttccccagcttctcacagtaagcactattagcagtttgcatattcttcctgattttttttttttttttttaaagagacaggtattttgctctgtcacccagactggagtgcagtggtgtgattataccttacttcagcctcgaacttctaggctcaagctatcctcctgcctcagcctcctgagtagcagggaccacaggcacactgatttttttttcttgttccttcaagagatgtagttttggcagggtgtggtggcttatgcctgtaatcccagcactttgggaggctgaagtgggcagatcacctgaggtcaggagttcgagactagcctggccaacatggtgaaaccccatctctactaaaaatacaaaaattagctgggtgtggtg

SEQ ID NO: 74639 - DNA, 1120 bp, Homo sapiens
ctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggagtgagtgtgcgttccaccctcttctcatctccacttaccttgctaaccctcctctttgctgctgtgcagtgtctaatcgcttcttctcccgagtgcctctcaccctaacatctctccattgcttgactagcctctcccattttcctctcagctgtctcctgttcggtgttttccagcatgtgctgcctggctgcagctgtctccctgccttggctcggggtgatatctctccagcagcaactctggggtagggagtggccatcagctgcctccaatcatccctaggttttatggtacattggatcgcccttctctcattcatacttttttgggtgattcaacgatgctgatgtgagggatcgatagcaggaggcttagaataccagagaatgggaaaggaaaagcaaggaaaagataatagcctgtcttctttcagggtgaagtgggtctacttgggctttgccagggctgaagactccagctaagggttaagggatgctctttgggcaggaggatggttgtgggtttccagcaggtttctgaagcctttagttttggcagacgtagagtccttggggaaaagagcagtgtcatgagacgctcccacagattagctgctggtagggtcagttcctaatgttgtacctcagcacaggtgatccctgaagctgaaattggagggaagacgggttttggataaggctgaaaa

SEQ ID NO: 74640 - DNA, 1049 bp, Homo sapiens
aaaaaaaataaaaggaaggcctagagactaaggcaggccagggggatggggagatggagagatagtatacttgtgtgattaagagtatatgagctctggaggttccatgagataatgtgcttaagtccttagcagtgtgtctggcccagtaagtgctcaataagtgatagcaattattattacaggagcattttggagaaaaggagagtctcctccagaaggatttcagatcattgtgagcctgtcttgggagaagcatgatctctgggaacgctcacaccagaatcctcctcctagattaaattaaaagtttaaagagctagaatgggaggatgtatggtagagatgtctcccagagatatttagatctctattctctggttgtagaataaccaaagagggttagaacagataggagaagaaacagacagttggatttcagaatggatagggtctatttctgttggtaaaagagactcagaataccagatttaaagtaaataataaagatagcataaactatgtgatttccaaaaagtgctcagcttcctctgcctgttctgggcctgtctgtccaacagaattcagtgaaatctgatttcctcatattcttttttaattttttttttttgagatggagtcttgctgtgttgcccaggctggagtgcagtggcctaatgtgggttcactgcaagctccgcctcccgggttcatgccattctcctcattctcctgcctcagcctcccgaatagctgggactacaggtgcccgccaccacgcccggctaatttttatttttttgtgtttttagtagagacggggtttcaccgtgttagccaggatggtcttgatctcctgaccttgtgatccgcctgcctcagcctcccaaagtgctgggattacaggcgtgagccaccgcgtctggcctgatttcctcatattttttaggaaagtggagtcaacttatatttgaggaaggcgtttataggaatttatgcttatcccagagatcttggtatgttttgtcaagaatgaaaaggcacgtggg

SEQ ID NO: 74641 - DNA, 1030 bp, Homo sapiens
taggggtgttgctggtcccaggctgcctgaatggtggggctgcctgaatggtggaagcattaccctaagacccagggtctcagggagaaatgtgagctgccaaagatggtgccttcttgtccagggtgctaggtagtggttgagaaaagagggggtcttcatgttctcaatgcatggcagcctcccttgcctagtgcgcacgggcagactgaagtaggttagagtccactagcacttcctggtgctaccactagggcgtgctgtttgctggagtgtgggttttacccccagcagatttctgtctcaaaattccacggataggacttcacttttcagatgctaccagtcaggaatgaaaccctgtacacttctctctccattccccctcacagttttcccttcctttgtccctccttccttcctttcttttacgtcatattaggacacatgcccaccccttggtgccagtgaatttggtcttaaaagggcaggcgtgatgatgtgtttgtgtttttttttttgtttgctttagaagtgggcaccctagcaatagcagcactgccaagaggacttgtaatcacctcttatccctgcaaagaatgagaaaggggaggggcagccaggaaggagattaacaaactttgttggagcctttcgtctaggctatagactgaaggatgacagaggctttctttctttttaatctagtctgcttacatcttcccccaggtaattcatgtagataattcctgtccaaaagcaaggtctaaggtggcatcggtggctcacgcctgtaatcccatcactttgggaggcagaagcaggtggatcagttgaggccaggagttcaagaccggcctggccaacatggcaaaacctcgtctctactagaaatacaaaaattaggctgggcacaatggctcatgcctgtaatcctagcactttgggaggccgaggtgggcggattgcctgagtttaggagtttaagaccatcctggtcaatgtggtgaaaccccgactctactaaaaa

SEQ ID NO: 74642 - DNA, 1053 bp, Homo sapiens
cctcccaagtagctgggattacaggcgcccgccaccacgcctgctaatttttgtaaatttagtagagacggggtttcactatgttggccagactggtctcgaactcctgaccttgtgatctgcccgactcggcctcccaaagtgctgggattacaggcgtgagccaccgtgcccggctgatgtgtaataatttctaattttaaatataaagaggcttacacaatttgtattccaggaaaattgatatttcccccacctctgctaagtaaacgttcgacggatgtttaaataaaactggttcgaagggatgccaactcattagtctgcccagggtgccatggcccagttggctcttacctggcgacatatatcgatatcacctgaaccaattagagatctcagctgtgagtgagcttgcttggtgtttaaatgtgtgcttggctgtccccctataagtggtcttccttggcttgcattacctccccttggcttgctttaggggctgaaatggcactgacactcttgagatgggactgcagagtttccttcccctaaccatgggatcgtatcccctctgcagaactaaggatagtacatgagtgggagatgagtaggaaatgggatgagtggagttgcaagaggcatcagaggtcactgtcaatggaggggaaagcttaagtgctcagtaaatgtagggcaacaaggaaggggggggtgaggctgaggtagggaggagaaggagctgagactcaggtatttggtgccagtgtagtagagaaggtgcctggaggcgggcaggcactgaggtcctctgggtctgaccaggcagtcccagctccagcccgtcccctggcccctccccgctgccggccagagtcacacatgtgttttcctgttttccatttcagtccccgttaccctctgctttttctgctcctcagagtcaacagctgttgcagcatgagcgatacgcttggttctcctaactagcaccttcccctctcccctgactcagctggtagcccctcctccccgcacctgcccaaaggtcac

SEQ ID NO: 74643 - DNA, 1029 bp, Homo sapiens
gtctctaagggtatccgcggtcattttcatttccccgcagtaatccagctgtgcgggagcgaggagcggacagggagcggtttgcgaggtctcggtgcttggacctttgcgcgcccttcgcctacacccaccacaactccctcttctagcgcttcctagagtcgggggaagggcgggggctgcttggccaggtggagggaacgcaagggacgcctgttggggtgaggtcctggtcccccacagccagacctgggcctcggggccaccctgttcttcagaggggtaatgaaggcggacggtggctgggtccgagcttgggaaggcgttgtcctagggccgcagactgggggcccaaaggaaggagggaaataaaagggagacaaacgacagggaggggcccggagaaagcgagggtggtgggggggtggggatgggagaaagggacaaaggtgagtgaggccagcaggttgggcgggggcggagagggggatgggaacgaccaaggggtaggccagcaaggatcgcgggccaggggagagcttttcaggggtagagcagcgggccggcgcatggtggggagttgagtgtatgcttcgaagtccgctgtagagcccacttgcatatgtgtgaacctgagcgttcgcctcccctcggccttttcctcccctgcccttcaccctttcgcggccatagcacttagctctcgccatctccacgccgcacccagaccggtcacctgagcttgggtgtgaggtagagcagacaagaatttcctggatccagggaaagagtgttagatgataggctttttgttttgctttgcttttcccattaatgaaacaaaagtccgtttcaaatcattctaggcctcccagtaaaactgtgaaagccatactttcttctttgcctttaacgcattactgtcaaaaagagtacctccgggtactccttgcttaggagccagagcggcagccaaacaggagggcctggagagcaaattcaaggacatgcgcaggagcctagccacct

SEQ ID NO: 74644 - DNA, 1838 bp, Homo sapiens
gcactttgggaggccgaggcaggtggatcacgaggtcaagagatcgagactatcctggccaacttggtgaaatcccgtctctactaaaaatacaaaaattagccagggatggtggcacgtgtttgtagtcccagctactcgggagtctgaggcaggataatctcttgaacccgggaggcagaggttgcagtgagctgagattgcaccactgcactcctacctggcaacagagcgagactgtctcaaaaaataataaataaatgaaataaaatgaaatagagtagtaatatgtctaggagcttattctgggttatcgtacctcacccttgaagatgatggacatattttaggataattaagctacaatgtatatgaaatggaagagaggagctagagattggttcttcccttattcctatcacagtatttgcacaaggtgatgcagtccatctctaacacttgacttttctctcacttctacttgtagatggccgccctgctcccccaatgaaaggccagcttcgaagaaaagctgaaagggagacgtttgcagtgagtggttagagcaacagccagggctacctggaaggagaacatttaaatcataatttgtcttgagctgtgttgcacctaagcaaacatgtacccctcatacagaggttttattaataacagccaaaggttttttttgtttttgtttttgttttttgtgagacggagtttcgctcttgatgcccaggctggagtgcaatggcgctatctcagctcacttcaacctactcccgggttcaagcgattctccagcctcagcctcctgagtagctgggattacacacgtgtgccaccacacccagctaactttgtatttttagtagagacagggtttttctatgttggtcagactggtcttgaactccccacctcaggtgatccgcctgcctcagcctcccaaagtgctgggattacaggtgtgggccaccatgcctggccccagccaaaggttttaatagcactgtgagaagggaggaagagagtggggcactcccaggacaggaaccagtagtagacatcctgctgcacattttgctgtctccctctgcttcccaagccagaactcgctcccactggggagtcagcagcgtcattttccagatgaaacctctgaatttgtaagtggaaggatatatagtatagcgctgaagtcccagatgttatccacactgttttcctgtctgtttcagagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaa

SEQ ID NO: 74645 - DNA, 1063 bp, Homo sapiens
gggagggacatagacagttgtctacagggcccagaagataaccccctattagtaaactggccccttctccctctgcaggtctcatgggcatggaagaagaccccaccaccatcccacactctgagctcctcgttgcccctagccacatagcccccaataattcccaccctgaggtgagacaaatgctgaataccagaggaatcaagccactcagaatatgcttatagggacaaagtctcccacatcccgtcccctggatccccctacagccccctgctgtccatcgcggcctcaacccctgcagatggcagcctgcaccacaaaaaggcaacttagaggtgttttttttttttttccttccagttcttggttgtaattggattcaggctaaaacaaccacgtccccaaccaggaaaggagggcactggggcggggacggaggagaggctgtgggagaagggagggaccagaggagagagcgagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagtaagtgagcttcccggcccttcccggagtcgcgcccgccgggaggcgagcccgggggtctcctaggggacagcctctattcggagaggagggcttttgggatctccgctgctcaggcctgcaggattccccctccctttctttttcctcttcgtctccaaacttccagatcgatccaacttttgcccgcttccaaccagctgcccccaccccctgcgccgccgactct

SEQ ID NO: 74646 - DNA, 1088 bp, Homo sapiens
ctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggag

SEQ ID NO: 74647 - DNA, 1062 bp, Homo sapiens
tgccccttcccctccattggaagtcttcagggatcacttctttttttttttttttgagacggagtttcactcttgtcacccgggctggagtgcaatggcgcgatctcagctcactgcaaccaccacctcccgggttcaagtgattctcctgtcttggcctcccgagtagctgggattgcaggtgcccgccaccatgcccagctaacttttttgtatttttagtagagacagggtttcaccacgttggccaggctggtcttgaactcctcacctcaagtgatccacccgcctgggcctcccaaagtgctgggattaaaggcatgagccactgggcctggcccattcagggatcacttctctatggaatttccatccttgtcaacaggtaaagagtagaatttgatttggcctagtgtgccctaaaagtctgactttttctgggtcagactcagtgaattgaggtggagctgggctggagtggacatctagcttgagtcctgcgcatctccaaaggacagaggcccctctgcaaacggtcctcagctcagatagaactgttctgaagagtccttccattcattgcatgtcctgcctgagattcagaactactccttaatcagcttagaacatccctcagcctctctggatcttttaaacattccaagtcaccccaggctcccctgaccttggtcattgtttggggatcatattaagtacctggctgtttgcctcacatagttcattttccatgaatttacccagaaaggggtaggcaaagagagagggcaatctgtggagaggctggtggggcaaagggatcagaatgccatggagaaccaatccaggtctcacatctggcacagtggggtgggataagatggtgagttctggttaattgaactgtatggtaatcaccagttactgctggtaccatacttgggtgacagtgctacaacaactggaatgcagtgcacctcttcttaactcagtcccagaacacaagtcaatttttccaaagggctctaggatatattttatggtctcatggcgataccatgaggt

SEQ ID NO: 74648 - DNA, 1046 bp, Homo sapiens
tatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacaggtcagtgggagtggggctggcagtagaagagtagaccctgagggtgaggctgggctgtgcagctacaggagaccacgaaagtgcccaccttggggagaggctcccatgatcagcttgtcagttgtgtcctgtaagggacaggtccagatcctgaaagcagtttcaagggaggagggacctcagatgacctttgggaaagccatggcacagctccagctggcctggcccgggtgtggaagtgggaggactgtccaggctgaggtggtctactctggccgagaactaccagtgactgagcagtcctcattccttctagcatctttgcccccctctcccggatggaggctgagattgtgcagcagcaggcac

SEQ ID NO: 74649 - DNA, 1001 bp, Homo sapiens
ggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcc

SEQ ID NO: 74650 - DNA, 1054 bp, Homo sapiens
tcattctagcctttgattattctctttcctttggcttcccatttacctcttctttccacaggtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagct

SEQ ID NO: 74651 - DNA, 1029 bp, Homo sapiens
tatgaagagagtttcaaaacatgtaaatgtaattattttggaaacttacgtaagacaaggcagatatttacataaggatctatatataaggtacatgttcacttacaaaattacaaattgggaaaagcatataaagggattaacgaggtctggatgaagttttttttattgagggaaactttctggacccaatgagttcaaaagagagttctaaaagggtgactgttcatgtgcagttctggatgcgggtacccttggtggcaccagaggacctgagagatgatataattgagaatgcaccaactacacacacagaggagtacagtggggaggagaaaacgtggatgtggtatgtctccctttgctgctgtaccagggtgcaagggatagggtgaggggaagtacagggtgcaacctgtagggaggtctccttgagctgtggtgattggtcggccatatctagtttactgtacttttctgtatttgactgaacaggtggcacaacttccggactttgtgtgactatagtaagaggattgcagtgggtgagtccatgagaatcctgggatgggtgtggcttctcttacctcctgtgaataagaatcaggaatttcatatatagtatacaattttgctacttcccctctgtctcagactggctttctcttaaagaagtaaacagattttgcgcaaaggagcaaggaagggtttcttgcctggcagtggttgacagtttttcttttgcctcatgtagctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaaggtgagtggtaggagggttctaaaggtagtccagctatacatcttgccttatttacctgtgtatgatcgttttttcctgtgaggctgactctttttctttggtttctgggga

SEQ ID NO: 74652 - DNA, 1663 bp, Homo sapiens
tgacacactaggggctgtggccaagcaggggtgagggccggacctccacgagcggaatgcggggtccgaactcggggacggagaagggcagactagtcatcccggagaagcaggggtgagggggtcggctaggatgaggaggggagagactattactctttggaggggaggagcctcggacccagtaacgtgaggaaaataacttgtgggaggcctgtggtcactgagtcccaaagttgggagagttgttgggtaaactctaaagggccctggaggtcgcgattattgtctgggagtgggaggaggtgttagggggcaagggagagaagaggctaattttgacgggggaggcatgggcagaactggggcaaatctggatgtgatggtcttggaaacatactgacacctgaggagaaaaaaattctacttgtggatatccatcattttctccttactcatatgtcccatggctgtgttttagggagaaattgaggcacagtacagcagagttgatatcccccaaggtggtctgaactcagcagcctagtaggctgaactgatggcagctgaaagggctgtgcaaaatcaagatagcctaaatccagttgcttggctctctggcactgctgctgtctttacatgattctgggtctgtcgcggttgtaggtttgatttcctctgcatgcctgtcttccatccgcgtttcaagagggagttcattcaggaacctgctaagaatcggcccggtccccagacacgatcagacctactgctgtcaggaaggggtagggaccatcccatatgccccttaattattagaggcaataacaacttctgctttatcggggccctcattctcctccttttctgacttggatatatttgttagtccctgggatatagataacttgttttctccttgcttctctattctgcatcaggctatcccatgtctatgtagaaaaaacctttgtctctcatttctactcttgattcccaaaactaaaaattgaacaagtaaagtgctgaaccttattcagtatttgtctttcttgggtgggggagtgcagactggaatacgctaattgtgggaaagctttctccatggattcgtccagactcaaaagtggagaagattcgcaggaactccgaggcggtaagactgtttgacttctctgctggatttttctaaccaagctgggtggggagagtggtcccctcccatccccaataacttggtaaattaactgatagaatgaaattaaagctattaggctgggtgctgtggtgcacacctataatcctagcactttgggaggctgaggctgtaggatcactggagctcgggatttcgagaccagcctgggcagcgtagtgaaaccccatctctataaaatatacaaaaattagccaggcatggtggtgcatgcctgtggtcccagctactcaggaggctgaggagggaggatcagttgagcttgggaaggtcaaggctgcagtgagtggagactgtgccactgcactccagcctgggtgacagagtgagactttgtctcaaaaaaaaaaaaaaaaaagctgtttgcttgttagctcaaacttttcctcttcatctccgttccaggccatgttacaggagctgaattttggtgcatatttgggtctt

SEQ ID NO: 74653 - DNA, 2002 bp, Homo sapiens
ccaacagatcttagacaaaaaaagaagcacaaaaaaactattatggaatttgatagctgagttatttggggggaaaaagtagactttgatttttttcccttttcccccagttcactcataactgggaagctgcagctcagttttaactttggcataatggtggtggtggtggagaatcctcttgtttagactcagtgaattggaaagttctctttttaggatgctccttttggacagcttggagcaagtggaaacacatgtgtgcttagaatgtgacatgttttggcacttgtaaatctgtttgtccataaagcttgtgtaagagcttgggacccaggatgtgtggtataggccctctgtaaaagtcatccttgaggttcctttccagcttgtggacagcagaaatttgaacataaggtagtgtccttggagcagccagctgtttattcatctttttgttttctttcacttcttggttccacagattagaatcccaagaaaatcaaatggcatccggggatttctgctcacctggagaagggatggaaatacttcaacaaggtaagagtagccacttgcaaaaggtttgatgatttatccagagaggtcttatccaggttcttgccttttctagtaaaaagcatttattggctcacacctgtaatcccagcactttgggaggctgaggtgggtggatcacgaggtcaggagatcgagaccatcctggctaacacggtgaaaccctgtctctactaaaaatacgaaaaattagctgggcgtggtggtgggtacctgtagtcccagctactccagaggctgaggcaggagaatggtgtgaacctgggaggcggagcttgcagtgagctgagatcgtgccactgtactccagcctgggcaacagagcaagactccaaaaaaaaaaaaaaaaaaggatttataagtttccccagtatggttttcctcacagaagcatgtgtttctgaggaaactggaatacatgaagatccttgaacactctcttattggaaaacagactacactaattcctgttaatgttggttcaatatctgcttgtgtagtaggctaaaaactcaagatgctcccatgctgatgttagcaagcatattataaaaataagggtagccagcaaattccttgaaggtgtccttcctacctgtgtcttaaatattctcatatcttagtctccaaaatttcagatccttctatatcctgagttctttccatatctcagatcctttctatatcttgaatccttcaagagcttgcattttctatatcttgactatttccatattggatgcttcagtaccttagggaaaaagagagatttcttatttcccaaaaagactttgggtataatgttccaaagaatgaaaatttgggtgttttggcaagtagaggtaaaagaccccaacagagagcatatggaaaaagaaatggaaagaaagctccttgagcatatggaaaaaccagaggatctcaatttcttacacttttttctcatgcctgtgctgttttgtatctacatgggttactcaactctactgacaattataagtatttgggccagctggccaggtgtggtggctcatgcctgtaatcccagcactttgggaggccaaggcgggcggatcacctgaggttgggagtttgagaccagcctgaccaacatggagaaaccccgtccctactaaaaatacaaaaattagaggctgggcacggtggctcacacctgtaatcctagcactttgggaagccgaggcgggcagatcacgaggtcaggagattgagaccatcctggctaacaaggtgaaaccccgcctctactaaaaatacaaaaaaaaaaaaaaaaatagctgggcgtggtggcgggtgcctgtagtcccagctacttgggaggctaaggcaggagaatggcgtgaatctgggaggtggagcttgcagtgagccgagatcgtgccattgcactccagcctgggtg

SEQ ID NO: 74654 - DNA, 1048 bp, Homo sapiens
aataaatgttagcaattaccaccattttctcagcatctgcccttcactggggaggcactaatgagaaggggcaaaaaagcctttccgagaccatcctgtttcccagtccgggttccaccacccgagcatgcgaacccagggcgttgggaacccagcgcgcacccgtcgaggggcggggcctgccgttcccgcctcgagtgtggccccgcctccacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctgtaagggtcatatcttgtgaaaataacctgtaaaatcaatttaacgttcagtgcagcgtgtaaagacagctctaagaatttaaaagacgcctgagtcagaacatttaaatgcttgggtccctgtagcagcgttttaacacgtctgagtgcagagggtggagaatcgagcctgattgccgttcacgccctgtaacctttaagaagggtaaagaaaggcaccctaaaaaacgcaaggggacacttaccctagggggggacgaacagctagctttttggaatttgggttggtcttcatttccaagtgcgaaatttgcctgcaaaactttttatttgcagtcatagatcaacgataaacagaattgttaaaacactgaacttaactaagtagtggcttttgttgacaagtcgattgtgttattaattcttaatgtctcatc

SEQ ID NO: 74655 - DNA, 1057 bp, Homo sapiens
ggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaaatcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcagaggggtcccggattgcatccatcacaatcccaaaactagagttggggggaactggagggagcaaaacactgatttgatactagtcagtttgcttgaaactagttcacctaaagctagatctcttaaaaccaattta

SEQ ID NO: 74656 - DNA, 2343 bp, Homo sapiens
ctactggttagaatcacttgggactcagttttcttttctgtaaaaacaaaagataggattaaatcagtgattctcaatcatggtagcctagcagatcagctgggaagaactaaaaaacaaaacaaaacaaaaaacagtgtttggatcccatcaccacagattgtgataataggcctggaggagggccaaagcattgatgttttttaaaagctgcctaggtgatcctgatatgcagccagagtgaaacactgctggcctgaatgctctctcaggcacttttcagggtctccgcctccattttacgacttcttcaccgacattacatagcattgttctgggagtatagcagcgggttggatgaggttaatgggagtaataaggagcataatgggcagctggagagctgggactggagggagactgattctcttgctaccccatgagccagatcctacaagcaatggggaagtcctatcatccaggctgtttccgatgcattgtttgcaacaagtgcctggatggcatccccttcacagtggacttctccaaccaagtatactgtgtcaccgactaccacaagtgagtctgccccttgggatgcagtgtggaactgggtccagggattccccagcctcagctcatctcttccctctctctttcagaaattatgctcctaagtgtgcagcctgtggccaacccatcctcccctctgaggtcagtatgtctgggttctccttcagggcagccagtgccactgcctttggggaggggatagggacatgctgcctggcctcctgccagaagtggtagtgccaaggaatgtactctgtgaagattcccgtgtgactctgcctcttggggtcaccaccctgaccctaatatccgggcctggacatgtctgaaagcctaactgggcccaggctccatctcttctatcccagtccagaggaggagactttctttgaggtcgaggtcaccagactgcagatgtaggggctggaaaaaggtgggaagaatcctcagcactggtaggaaggggtcagaaatgatttaagctgagtgtaggggatgtgcctatggagagaaaccaaaagccagtgaggaccagatcttattggatccccttgttcccagcctagcctactttatttaggcctcctgtccccttcccttccctttgcttcctgcacaactgagagacgcaggtaaggccagggctgttgtacagagggagtgtgctccatgggtgcagcccagtgaaggagatgagagttctggtaggatttgcagaagcatcttaaaactacaggtgattgcagagagactctgggggcatttgtatgatcttcccatggggtgggaagggttgtatatgagggaaaggtggaggtgaggcaacatgctgctctcatctccatgggggtctgcatgtttcagggctgtgaggacatcgtgagggtgatatccatggaccgggattatcactttgagtgctaccactgtgaggtgagtgttggggttcagcggtgctggagaagaagtggaaatggggagaggggaggagtcaagtcctgcaacaaccagacatctatgggagaggtgtagggcatgggaaaccagaaagatattgtgacctatcttcagtctcttttttgtcctccagccactctctctggtccaagtagcttagtcctttctgaatctgactctcccagagtcaggactttctaagactagggactctggtcaaacttcttgaaagacaggcttgtgtcattatttctgctgcagcagtgacacctggtgtccagctgaggtattagtattttctcagattgctcttccatcccttccatccttcccttcccaccccatccctttcttccagttattaggagtcaggtgttgagcagggcagactcctaagataccctcagtgtccaaggtgcctaggctgaggtgaactaggtgccttcttccctaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtct

SEQ ID NO: 74657 - DNA, 1006 bp, Homo sapiens
gcagtgaccccagaagtcttgcacctgggctgtgggataggttccagccccttctctattgtttctagggcgaactttgcgttgcaaggctttctacagtgtcaatggctctgtgtactgtgaggaagattatctggtgagtaagggtcacctggacctggaattggtttccatactgacccccttcttggtggcccattggagtaccacccatcattctcagtttgataacagcctccgttcgtcttgtcttttactttagttttcagggtttcaggaggcagctgagaaatgctgtgtctgtggtcacttgattttggagaaggtaagtaaagtgctttcagctgagaagtctcactgtgaggctgaggagcgggatcagggactaaatggatattgagagaaggttggggaaagaagcctgtcaccagatgaatcactttcatcccattcctccccagagcaactgtttacagtggcttccctctgcctatgggatcaagtctgggctcaaaagcctgtcaacccaggcttctatgacctagcccctccctaactctgcaggcacagccaggccttccagcctgagctaggagtgtggggtcctgagtcttttttttttttttttttttgagacagagtctcgctctgacaaagtggaatgatctcggctcactgcaacctccgcctcccaggttcaagtgattctagtgcctcagcctcccaagtagctaggactacaggcatgcgccaccatgcctggctaatttttgtatgtttagtagataaaaggttttgccatgttggccaggctggtctcgaattcctggcctcaagtgatcctcctgcctcagcctcccaaagtgctagattataggcgtgagccaccatgcccagcctggggtcctgagtcgtcttcttttttttttttttgagatggagtctcactctgttgcccaggctggagtccagtggtgcgatctcggcttactgcaagctccgcctc

SEQ ID NO: 74658 - DNA, 1040 bp, Homo sapiens
ccagaaaggggacccaccaggcggagggagagccaagtagaggacagacagggaagcaagagaggcagagcagctgcggacctccagacacttggtggggatccaacagctgctctgtgagcaaatgaagaggcacaagctctcctcctgttccccatagcacttgtaagtgtgtatgtgggcaggggaggggagtgcttgagtattggggctacactcaccacaagagcagcaaacaaagcactgggtgtggtagaggctgtccagggcctggcaggcattgctctgcccatagatgcctttgttgcacttgatacaggtgcctgagaagagaaaagtgtcacactctactcccccaggtcaaaaccagggattcccaagctttcctgactgccctttcctgatgtgccaggggtcacagtctccctttgatgggctcccttctgagtagagaagataacgagtaatgagatgcagcaagatcttggctgagcagatccattcttgtttatttaattactcaacagatattttctgagcatctgttttgtgcttaacacagcaccactacctaaggaaacctggagaaagtcgaagatatggtccctggcattcagatgcttagtttctgttggggagaaaagactacacaggcaaggtatgatctctgttgcagtgtgtaggatgaacggtcaaagatgccagtccacaggtgctcagcagcagacttgaaaatactttctagagaaagcaggctaggcccagaaatcgtctctgggacttcagtttcccatcagtcaaacgagctgttcagttatagaatgatttctctccactgcagacttccaaggatggagaaaaggatctggcttggcagagggctccgtgcagaggggaccatgtgagcatgattcctgtggggaggtggctgctgagaatgcagggtgtgttccaggaaccagggttgaacaggaaagcagggagagtagcagagcccctgatgcctcctagtcaccttctatcatgggaagaatacagaa

SEQ ID NO: 74659 - DNA, 1178 bp, Homo sapiens
aacctctcagaattcaggccagaagtagcgccttacttcctgacactgttaaggaaacctggtcgctgtctccctcccctactctgttcaggaagtattgattgattatatgtctcagctatgaggaacattagggtcttgaaagatcttttagtcaaaattcacaggcactgctacacacataaaaaacttcgaatctgattgtgattggaaagaagtggcaggcttaccgcctaagggctgtgggcctctttcacttttctaagcatctcttcttaccactcatgccccactcctggaccccatgctgtagaactctatggctagaaaagtgaataggaagaggaacgcggccagggagggatggttgggtaggaggttcagaggtagcagggcggcaggctataagggcataactcaacccccagcctccacccccattcttttccccacctccaaatccaccgagaggaaagcccagaggagatgatgccaaaccgctttgatcaaggaagactgaatgacagggcccatttagcagtttcattttgaggcccaggagaggtggctagtaaagaagtctttttggctgaaccatcagagccaaaaggaagaaaggaactcagagaaactgcaataaaatggcaggaagaacataggtatagatatgctgggttagaggaggtgaggccaacgtgcctgagcagtttcgtttgcttttcccataacgtccaaggtttcctaaagaatggctccgacaggaccccctggcatggcaatcttggggcagatcttcacttccatgaggaagccacattttgaattcagagatgggggccccttctccttgggagtcaggttgcctcctttgacagaacccctacataccccttgtgccgctagccccagcttgactgtaccctcctcctgcccctagtaggggccctcttccttggcttcagccttgcccagctgccagagggtgggagcaggacaggcctgggcccatcagttgctgcagctgctgcacaggctcccaagcccctgggcaaagactgggatgggccccaacaggcagggagtgtggcagcgtgccgagggggagaggtggggcaggcccgttgggatctgctccccaaagacaggccctagccctcactcatgggcctggaattggg

SEQ ID NO: 74660 - DNA, 2033 bp, Homo sapiens
tgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggtgagtgagagaagtggttagggacgggaagggacccgtcacggtattcggttctccactgccccgacggcccaaagtgccggtgccccggggtccgaggtgaagacgcgggactaggaaagaagcaagagggatggatgggggcggccccagagcactgtccccttcctgctagttttcagatgaaccagggctccttatttctgctaaattcaacccccctggtatctcgtgagtccgtttctcaagcatttgaacctcggttttttgcggcaggaggcctcgtagggaagggaccaagtggggcagtgaaggcgcatcccccccaacttgctcccccctttcacggcggtgcccctggaggtttgtgcgcgccgcgcccccacccgggcccaggctccgcccgcaggaattcggagaatgcgcgggtgggggggcggggcaggctggccgcgtgcgtgccgactcctgcccgggcgctccaggtgcccgcgggcggggcggctgccgccgcgcggcggaggggtggggttcggggatcgggggacgctccctagcatacgcggagtagtggcggctgtcggggaaatggagcctgggagacaggatggagcgccctgggacccaactgctgtccctccccagtcctgttggctaggtgcgtgcgtgggcatttaatcagagacccagtagt

SEQ ID NO: 74661 - DNA, 1017 bp, Homo sapiens
gctagcaccgtgactttgttcccagcgtggggactgtgggagagatggagagagactggtacagaaatggtgagacaaggagagagccataaagaggaagacagagagaaagaagacaaatgcataaagaggttcagagacgtgtacgtaaagatagccctgaaaggcgacgaagcccacagagagaggtggaagagggaagaggtagcgaaagaaagggagagctgaggagcaaagaggagtgtggacgatgcagagaccgaagggtgcgcagacaaaggaaaggacaagcttgtccagagagaatgagagacaaacagataaactgcaataaaaaggcaccaccttctggacccaaaagttttgtgatttgtaaaagcagtgaaaaggagtcaggaaaatgggactaatctctactttgagagggagggaaagagatatagtgtgtatgtagaagcagtgaaaaggagtgaggaaaaggtttgggactaatctctaccttaagggtaggacagttagagggatagacaccccctggtgttgggaaatgagatttttctcatttcaggtgactgtggagatcgaaggcctggttttagggctagcgaacaccttctccctttggttttggtccacagaagactggtgatacagagtaagtattaagaggaagaaaagaaatgccgtgtagaggaaattgcaaatgaaaatgatcaggatggaaaagaggctgatattgactattttaaaaggatcaagaataaggaaaagaaaccctggctgaagcagccgggcgcggtggctcacgcctgtaatcccaccactttgggaggctgaggcgggcggatcacttgaagtcaagagttcagaccagcctggccaacatggtgaagccctatctctactaaaaatacaaaaattagccaggcgtggtggcgcacgcctatagtcccagccactcgagaggctgaggcgggagaatcgcttgaacccgggagacagaggttgcagtgagcc

SEQ ID NO: 74662 - DNA, 1040 bp, Homo sapiens
aataacaaaagagagcaaggaaagagaaagcctgggaaataatatttagggaccaaggggcaggcctggcttctgaacataacacctcctcataacaccttagattcctcctcctcgtaacaccttaggtgcaagacctgcataaacagaatgcatgatgctgttctagccctttccttctctcattttcgtttcagactgagagggaaataaacaggcaatttgagataattctatgaatatattgaaggtgagaatagccaaaaaatgtttcaaatccactattttcaaaaccacctaatcatctctattattcctcttctcctctgaccaagaaagaggagtgggaggagagggggagaaaggatggcataggagttaaaccagtttttctcaccttttagctccttatcagtgtaattgtggggactggtcaccagctcttgcttgagcttttccagaagaaacttcactactgaaatattccaagaggacttgatgctgccacaaagagaagagaatgaataaagttgtcggctttgtaagagccagacaaacagagatacccagcactaatcaactttgtggcaaatccctccacagcctaagaaggtatggtgagatcaaagccttagtctcattgctgtattggagcatccccctctacttccctgtccttagcaaagtaccttctaattctttttcctcaaggagaccatacctttcagacccattgaatctcttgtcattggtgatgtggttatgcacattgtggaccagtttctaggaggaaaaaaagaaaacacaatcaagccaagagtggatgttatgaaaactctcctctggtccctagggtaaaaaggtattgtccctaaggggctctctgcctgaatcctttctaagccaagagcctatccaagttactatttctagtgtggtcttccctgacttttcatttcatgtgtgtcaggattccaggatcatccctggccttacttctgctcctgagtagtgtgatcactggagcagagggtctcaaa

SEQ ID NO: 74663 - DNA, 1050 bp, Homo sapiens
aaagcctaaaagcttgatgtttagcaggggacttcctatccctagtgttacagaataacctctctccttatccctcccactctggtaggattcagtacagcattcattcaatatgggaggcctaaaatcaacccacccatcactcttcacttatctctccagactgaagaaaaatttatagaaactgagctcactcacagagagtacaagatcccgcttgcgcctggagttcttctgcccacttcctctggtcctgcatggggaaacggtcagccctagagagtgtctcagctccccagtgctcccagggcctgactcttccaaggcactgtccagcgcagcagcggcattgagcatgtcctcagggcggggtggtggcagcttggttccattttctggtcctgtctctggggttgcccgctggattgccagttgtgtggctggtgagagttgcttggcataagcagggaccagaactcgctgtactgcaccctcagaggccacgtaatcatccaccagctaagaacataaaaaataatagcctattagccagccaggcttaggggaacctggttaaccatcattctttggctaagaatagtgaacagaaagtggaaagaaggggaactctagcacagtctttaatggtcaatggcttgtttctctgggactcctatgagtgttgggcaaatatttcttgtgtgtacagggcctctcatgttgggttgttaccatagggctgctcacaaggagaaagcatgtttctgacactgttggtgaatagtcatttatggatagctcttggatataagaaatggagctagataagtgttttgtctgaaaggactgggtgaagaagtgatgacaagaaagaaaccaagcaagagaaggagtaagaaaataaaacagtaacagcaataaagaggagacataaaagacaaatgagcaaaggaggaagacataaagtcagaaatccctagagagactggcagcaacagctcccctcacctatcctccattcccagagtcagtccatgccctcaccttgat

SEQ ID NO: 74664 - DNA, 1039 bp, Homo sapiens
agttataacttggggttatttgtgtatatgtacaatatgtgtgtatatgtgccatatcagattttattttcaaaagtgataaatatatctggttttatgtgtgcaaagtatcccctaggatgtgaatttttttccgttgtcttcccaaatgtgatcaaaatattttgtgtgcaaagcagagcttagaagaaatcctatgcttagcatacttaggcactttctatgtgcatttactatatttttctgctcctaaaggatcagaataatgaataattaaataattgccaaggagtatatagtccatgtggcaaatgagagtaggcaatttattgaatctgtggttcaaagccttcagtgactgttttgcctaagtggttttgctttttattgtctcacgttcttaagtgtacagctgtgtatattttggcctttatgtgtggtttggttggtgtgttcagaagggaagttctttcttggctttttgacaaaatggtcgtttattggttggaatattcgaaaagctccacagctggcaaagtatcaggaaaaaaatccagtcaagtgtaattctcaaaaactgttcatggtgatggtgatggggagccaagaggatgcaaaggcaaataatagaagggataagaaatgccttttggttatcatgttgcatttttagaatggaaagcttctcatttctaagagtcacagaaaaaagtatatgaattagagaaaaacaggctcgcagagcagaacctcctgttataggagccctattttcacttcattctgttacagaatcactatctcctcattagaagttgtatggaaaatatctgtatccaaatttgtattcgcagattggagtgaaagcataggaggtatatgaggtgctgagggagaaactggaatgtcacaaatgcagtgacaaccaggagacaaaaaaaaaaatctactgtagaatttaaatttcattacaacaaaacttctgtataataatgcatttctattacacagctagcatcctactctatttcaagcagta

SEQ ID NO: 74665 - DNA, 1039 bp, Homo sapiens
aggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggcccttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaaggtgtggagccagcccccttgccaggctgagtactgaacgcccgcgacttgcctggcctcccagcctgaccggagtttgcggtggccttggccaccaacccaggcggaggctgggtcctctcgttcggaccgcagcagttttgctgtctcattggcccaggaggcccctgtctttgctctggttggaaagggtggcggtggggccgggggtaagtcgggggaggaaggtgaggcctcttgggttgattcctaggcgaccccaggttgctgctgttcaggatcttctagctgggaaaggccgcaacaacaatgaatcttggccgagggaaggctattgtaaacgtttaccaaagttttggaaactgggcggcccctcaaggcaggggtaactgaaactggcatgaaggggaagcgtggtgagggtaagcattgt

SEQ ID NO: 74666 - DNA, 1021 bp, Homo sapiens
gtcagctgcccagtgtggccagtgctgccaagctcttgtcagccatgatgtctcaataccggggactggatctctgtgtggccactgccctctgcggctgggaccgctctggccctgagctcttctacgtctatagcgacggcacccgcctgcagggggacatcttctctgtgggctctggatctccctatgcctacggcgtgctagaccgtggctatcgctacgacatgagcacccaggaagcctacgccctggctcgctgcgccgtggcccacgccacccaccgtgatgcctattcagggggctctgtagaccttttccacgtgcgggagagtggatgggagcatgtgtcacgcagtgatgcctgtgtgctgtacgtggagttacagaagctcctggagccggagccagaggaggatgccagccatgcccatcctgagcctgccactgcccacagagctgcagaagatagagagctctctgtggggccaggggaggtgacaccaggagactccaggatgccagcagggactgagacggtgtgagaagcaggacttggttggggatggtgtaggcctggggagtgggtgggaggatgggcagcagggggagggtcccgctggcagcagcctcacagcgtctggctctagcctgtatgggttgctggcttcatttattgcaagtctccatcctttcatgactcccagagctattatggctctgcccaacaagttcctattgactcccagtggattggtccagcctccttcttggcaccaagtccgtctttcattcaacacttgcagtgtgcctactgcatgccagacgcatgctaggtgctagaccctcttttcttgccatcttctctgcttttttccatcatctcatccccagtttctcttagtttcggtcctttatgtgtctcagcttcagcgtctttgtctttttctcctgatcactttgtcagcatggtaagatggggcacccgggaagggagcagcccctctcagaacgaggcgta

SEQ ID NO: 74667 - DNA, 1061 bp, Homo sapiens
actcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccaggtcagtgcccctagactgtggggcagggcggtggatgaaggctcccactccccactgcctctaacgtggctcccctgtccttacagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaat

SEQ ID NO: 74668 - DNA, 3066 bp, Homo sapiens
gaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaaggtaggtacttagctatggggtacgcatacccactagtaggtgggaaagggacccagatgggatgggacagagggtcagatgcatcatatctggttcacttttttccacctcagagaaagcccaggaggaaccacctgccaagctgctggatgaccttttccgaaagaccaaggcagctccctgcatctattggctcccactgactgacagccaggtgagtgctcttcttcgtgccctgctccctagtggcactgaggcttgaggtcagggtgaggggagattcatgtgactgcgagagtgagtcggcccaagtacttcctaggtttaggataaactaagcatcacaaaaaggcagttttcagttaattggtataacatagagaaaccagactcaggagggtaaagatagacacgcagatagcagctgaagtttgtggatgtctgggaagctggctgtgccgaccaggcttcttagaacttgattttaggccgtgcgtggtggctcacgcctctaatgccagcactttgggaggccgagtcgggtggatcacctcaggtcaggagttgcagaccagtctggccaacatggaaaccctgtctctactaaaaataacaaaaattagccgggtgcagtggcaagcgcccgtaatcccagctacttgggaggctgaggaggagaattgcttgaacccgggaggcggaggttgcagtgagcagagaccgtgccattgcactccagcctgggcaacaagaacaaaactctgtctcagacaattaaaaaaaaaaaaagaacttgattgtatttagctgagaaatcgtgttttataaattcatttccctgctttttaagagtttttgcatctttaacttagtttcttagtaatgggccttttgggaattttaggcttatgctactcaaaaaagagatttgttcacatctacgctgacggtagggagctagggaaataccaagggccaggcatggatggtgccagtacctgtcaatgtgtgtaaaagttgaaacttggtggctaggcatggtggctcatgcctgtaatcccagcactttgggaggctgaggtgggcggatcatctaagcctccatctaagccaggagtttgataccatcctggccaacatggtgaaaccccatctctactaaaaatacaaaacttagtggggcatggtggcagacacctgtaatcccagctactagggaggctgaggcaggagaatcacttgaacctgcgagtcggagaccacagtgagccaagatagcaccactgcactccagcctgggcgacagagtgagactgtctcaaaaaaaaaaaaaaaaaaaaactggcggggcgcggtggctcacgcctgtaatcccagcactttgggagcctgaggcgggcggatcacgaggtcaggagatcaagaccatcctggctaacaacggtgaagccccgtctctactgaaaatacaaaaaaattagccgggcgtggtcgcgggcgcctgtggtcccagctgctcagcaggctgaggcaggagaatggtgtgaacccgggaggtggagcttgcagtgagccgagatcgtgccactgcactcccagcctgggcgacggagcgagactccgtctcagaaaaaaaaaaaaaaaggctgaaactaggagggagagaggtgctctaagaaagacaggatgcagttgttgagcccccaaccccttcctgtttaactgaaaagctgaccctgagctaggaggcagggtccaggcacaaatggaggctgtgaccaggactgagctgcctattctctgcctttcctacctggctacagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaactgtgtgagtggctttctttgggcaggttaagaagccactgtggatatctgagcgtggacatctgaggatatctggagtaggagttgctctcattccatgtgttcctttaggctgactgcttcctgcttattgaacttcccacgtcttttatcccctgccttggccctgaccaacccaaag

SEQ ID NO: 74669 - DNA, 1100 bp, Homo sapiens
caggtgccctccccaccccggggcaagattagcaacattgtccatatctccaatttggtaagtcattgtttctcaccatcccagcttgcttagtggttaagtttgagctttaggcttatgcctcctaggttccactcatagttgaactggtctaccaatagattaagttactcactgatcttgagtgagttacttaacatatttacccatctaaaaatgagggggaaaagctgttgccctgcagggttgttttgaggacttgcagaaggcctcacatacaacgtctcaattagtgctgggaagcaccaccactcttctcacattcttactgcaaggttcctaaactctctgccctcccccaaaccttgaaactatactcctgtgacagcagctcgggaaatctaaagattgggtggtggtcttgccttctgctagaccctgaaagtctattttcattggcaggtccgtcctttcactttaggccagctaaaggagttgttggggcgcacaggaaccttggtggaagaggccttctggattgacaagatcaaatctcattgctttgtaacggtgaggggaagaagctgattctataggtcatggcatatatttccttttgtgaccagtgtgggcaggtttaagggtgttgcagcacgtgggaagggttgcagacacactgtgaccctccatcttctcccttcctccaccagtactcaacagtagaggaagctgttgccacccgcacagctctgcacggggtcaaatggccccagtccaatcccaaattcctttgtgctgactatgccgagcaagatgaggtaagaaacctagggagaggaaagagaggaggggcaggggaagccattatctgctagatttcagctgagatccttgccagacctgcagtctctgagcttctgttcttttctcttcttccctggctttggttcctttaattgtaccatggggcttcaaagtggtacctgggctccttttttttttttttttttttttgagacagagtctcgctgtctcccaggctggagtgcagtggcgcgatctcagctcactgcaagctccgccttccgggttcacgccat

SEQ ID NO: 74670 - DNA, 1634 bp, Homo sapiens
ttggtcaggctagtctcaaactcctgacctcgtgatccacccgccttggcctcccaaagtgctgggattacaggtgtgagccaccacactcagcctccaaatatgatttctttaagttaaccttttaccaaaactccagccagaggtaacctgtaggtattacggtttgaactagcagaggtcctgagaccatctaactgttgggtctatttcttggggacagcagctaccaagggggtgccagctggaaacagtgacacagaggggggccagcctggtcggaaacgacgctggggagccagcacagccaccacacagaagaaaccttccatcagtatcaccactgaatcactaaaggtgaggtgggaggagccagggaagggaggatgagacctgttaaggtgggagtagacatgggcccagtgtaacggggtggggggtatctgtgtcccagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtaaggcttctgcaccccagtgtcaggggaaaggtgggagcagtagatgcagagcagctagctgaggagctgagataaagtctttggagggaacttccctgtctgtgcagagggttgggttgactgacactttcaggggtcagactaccaaatccagctggctacctgttacaaataaagtttgattggaacacaaccacacgagttcattcacttttgtctgtggctgtttgttcactacaacatcaccagagttgagtagttgcaacaaactatgtggcctgcaaaacctgaagtactgctttgctctacagaaaaaatttactaactcctgtcttagttttcctcaaggcaaagttgaggcactaacaatcccaggatctggtagaagtgagccgataacgaaatacccctagcggaaggaacatgctagattgactgctactcttaccggggaaccagaggctgaaaagaatatgccagtttggtgtttaacagacctgctgtgttctctgacaccttgataggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaaggtgagtgacatattgtgagagaaatgtaatgcggctccctgaattctcagagcacctcatttggatcgctgaaagctttgaatgtttcctgcctttcattatattttttcgtatatcatatctttctcctacatattaagtaagctacttgagggccagatttgactctgtttaatctttgaatctccatgatgaggaggttagcctagcacagtactttgcagattataggtgctctgcacgtttagattaaggagtggctgcttggtataaaagaaagggaaccgtgagagttacattgagggtgaaaagagccagtattgcttcctaccaaaagctgttcttgtggtcttcttga

SEQ ID NO: 74671 - DNA, 1259 bp, Homo sapiens
aaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctgtaagtccagccccaaatccctgataaaagtcaggaataccataaaaaccagcattcattgagaaccagaatttcattctcaatggcattcttgggtcactccctcctgccccaccccttgtgcctagcaaatctgaatcctttcctatgtagggtttcattttggaattcaaaacttgagacaatccccatcatattgctccagtcacattttaatgagatacagtgtgaggtgtctgagaccatgtcccatttagccttagaggcatttattctttcagatacctgaatactcaacaaggaatgagtttcagggactcctatgtgatgcttagcagtttatgaattattctgggtattttgttgttgtttttttgagacggagtctccctctgtagtaccctaggctggagtgcagtggtgcgattttggctcactgcaacctccgcctccgggtcccagttcaagcaatcctcctccgcctcctgagtagctgggattagaggcatgcgccaccatgcccagctaatttttg

SEQ ID NO: 74672 - DNA, 1218 bp, Homo sapiens
tcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtacacagtgaggtgcgattggctgaactgaagatcccaggtgtgagatggtacctggaacatttgtcatattcctagtttattttcttctttattttcttcttctttttttaatattttattttatttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggtt

SEQ ID NO: 74673 - DNA, 3003 bp, Homo sapiens
cctagctcccttcgtcttccttctcttcctcatggctttcattccgtctttcgttttggtttgttttcagtcattctgccttccccctttgtcctgcctgcccagtttctaattggccccacatgccctttctgtatgggaaatagatattttttttgtataagccttttctctagatgtaagcagctaaatctcgtgtttctctgggggcctgtttagctgggggcacagttccgattttcccctccccctaacccccctagtgcatcccttcttgactgctctagggaggttcttctgacctctgagtgtcagtcagtcagcctgttgggaatgctgacttttctggtggtggttatcggcctgggaggcttggtttcccctctcctgagccttaggcctctgatcatcttgatttgattttttttgcttggtgtttgggtggtagagggggtgagatttgagatagaagttggggacgaagacagaaatcaaaggtggaaagatagtttatctgaagtgaatctctgggattctttgcctgaaatgggagctaacttgtgagattaagagtgggagagtgggtttggtgttcttgggggaagctgcctgtgtgggggagggtgtgtcctgactaggaggcctgctctctttatctcttggaagttggaatgagggagtgggagaaactgggtgaaagccgaatgtaggaacagtttctacacctctgagcaggtaaaagtggccctaatctctgagctctcatactcaattcagcagttttaatttttccttttgaatgagagagggtccttgaagcttgaaccttcaccaggcctgcttcttccctgcagctcccaccccccgccccgcaccccccaccccccaccattttctccatgctggtgtctccagatcctgaggatcagcaggcctttacttattaagcagttgattaaacacaggtcaggcttttttgccaaagccttggccattctttcttgtctttttaagggaatcgggcttcccttcgtttctcgtgcaattttgccatataaaggtgcctttggccagggagactgaggccacagggttgtgggcaaatcacagtcacttttgtgggactattttcagaggagggtttttctcctttcatataggagtactctggtgagttattacctgagaatagttggagtcctaaccccacaaatgacaacttttaactcatctgggcaataggtggatgtggttgctgtgatccacgctctttccccaaggaaaatctatttcccacttttcccattgggacaaggtctctaaccttgatcagaaaagcagccctcctaatcccacccaagtgatgaggcaggagggtttcctgacccagtaactaacatcttgctctctcttccccttggttcttttctgcccgcccccccaccaccactcccccctcctgtcagtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggact

SEQ ID NO: 74674 - DNA, 1016 bp, Homo sapiens
gcttaactcatttccagctccctggttcgtagaagttctacatgaggctgagcagcagggttatctccagggcccccagggtcaattcttcctcataactcctccttttatctgccaaaaggaagtcagccttttctcagttctctcaaaaaagaattctgtcagaacaaggatcactgaggaaaaggaaaaaaattaaaaattctgataaaatgattactggcataaatattcttgaagtacctatttttaagccatgttcctttccttattctaaaatgaaataacagatacagagggccgtgtgtggagctggtactgtgtatgtcctgccctgcctttttcaggctccaggtagaagaaaaggaaccaagcagatctaaatgttttgctctgttcgtttttgctatctcctgacaggggagcccaaagaagtgtgaagctgaagaggcagagccaccagctgccacacagccccaaacctcagagactcagacctctcatctgccagaatcagaaagaattcatcacactgtgtaagtgatatatctcgaccggggtataacagggaactatgagtgtgcgatagttcttcgctccctagggttctttgactaagcagtcctagtttccttttaaaacataaaggcagagctttatctggacaaaggctagacttcagttactatgttgggagctgccacctttaaggtaacctgaaaagtggtcgtcagggcacaaggaaaactcacctgggatcatccagccaaaatagtcaactcctttaagatttaggcaatagaagcttctgcttccacactcaaaaccatgtaagggaattgactccgggcatcttaatctttaactcatgtttacctaggaacccagtttaataaaggatattgagggtcttaataaaggcacagctgggtgctattttttagtttgtgcattttccctagttccctagttactacctgtcattaagctatcctagttctgctaggatatcctag

SEQ ID NO: 74675 - DNA, 1026 bp, Homo sapiens
tcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaagtgagtatgagagaatcccgggtgtattaatgttctgtcatattccagtggttttcatttcagcccctggagagcctgtcatgatttctgaaaggaataggaaaagcctcctttactctccttcactgattactttctcctcatttcagaatcgtattttcaattaactgattcccgaaatggggttctttttcattttgagtcccttgatagaatgttgaatttatgtactcatctcctccactagatggaaacttcttgaggatgtgggcatgcccttttacgtgtgtgtcccaggatctagcatctagttaaaacttaataatttgttaaataagtggtcaaggagaccactaaatgggaataaacacagacaaaatgggagtaaacacagacaaaaaggtccagagtataaaatttggtccatggaaactggaaaactcagcaatctactgaatatataccatatacaataattttccttgttatgtgtttcattttgtt

SEQ ID NO: 74676 - DNA, 1048 bp, Homo sapiens
ataacactaagtgggcagaatacaaaaatgttatgtgtagtgtaattatgactgtacaaaggaaatgattagaggaaagaacaaaaagaaatataccaaaatgataaaaagataatcgtattaattgatagtaggttagttcctttcagccccctatccacccttttactttccagatgttctgctaatattttactgaaaaaaaaaaaaagggggtgcttgaagctaaaatttaaactacatacaagtagcttcattgtgatatttcttttggtcactttgttttgattcccctaagggctacgttagtcatgattgtctcctgtcactcctgtttctgttgctgaaagtatatatcattgaatttctccttcctaggggtgtcttcattagatactttctctcctctgttgactgtgagcaaatacatttggagccattgtgtatctgttctttcaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatc

SEQ ID NO: 74677 - DNA, 1441 bp, Homo sapiens
ttagctgggtatggtggcaggcacctgtaatcccagtgactcgggaggctaaggcaggagaatcgcttgaacccgggaggcagaggttgcagtgagccaagattgcaccattgcacttcagcctggacaatagagcgagactgtgtctcaaaaaatacataaaatcataataggcacccaattttgcataatatctcaagcaaaagtctataaatatagcctttgtcttttgggaactacctgtctaagtcagtatactttgaggaaaatatgtgcaggttgagcatgcctaatccaaagacccaaaactttttgagtattcacatgacactcaaaggaaatgctcatcagagcatttcagattttgggttttcagattagggatgctgaatcagaaagtataatgcaaatattcaaaaatccaaaatctaaaacacttgtgatcccaagcattttggaaaagggatacttaatatgtatataagacatgtggattgttagtacatatgttaaaccaatgtgtaacttaacaagtattttgaataattagtgttgagggggatgcggaatccaccataatcagtgtttttaggatgtatggaggtttccagctcttctgattaatacagaattccttcatggactacacttgattttagttaaaaggctgagcagcgatagactcttcatggaaatagattttttaggagacatttaatggtgggaaagaaattttccaaaaggctagagaaaatagagagcctttgagtctagttttaaggtcctgttttactcagtccctgtttttcttgatcctagtcttagacccagaaagacatttctagaaatcttttagtaagaaaatactggccaatactttggaattattaagttccttagggacctcttttctcctgaaatacgagagtagtagaccctcagctgatccactttgctccctgcgccctttcccccttgattttaaagccgagaggaaagagaaagctcttctaaaattgtcggtatttcttctcacataaaacaaaaaaaaatttattgaattcctactgcatacatatctctgtgagagtatattgggagttagcacagcataaagtctgttaggaagagagaacaattacacataaatcgaacaacagaagatagtatgtgacaatgatacagacatagggaaccaaaagagtggaagagctctgaggactacagtgattagagaaagcctcataaggagatacaggatttgagctgagccttagaaatggtttggcagagaggatacaagaagatatttttaggaaggaacaaagtcagagagataggaatgaaaatggtatttttaaaggagaggtagtagactaatctagccagagtagagtatttcacattcaagaatagtcagcaaaacaatttaaaaggtaga

SEQ ID NO: 74678 - DNA, 1050 bp, Homo sapiens
tcttcaatatagaactaacttagaaaaaagccttccaacattttagttatctttcttgggcgcaactataaggagtggacctttgctccatggaatgttcttctttgcattctcctggtttgttttcctagaccctctgttttcatttcctctacacagattggtgaggaaatgagccagaacagtttcataaaacagtatctggaaaagcagcaggagctacttaggcagcgtctggaacgtgaagctcgagaagctgcagaacttgaaggtaagcccagattgtcacttttaacaaggagttcgtcattcttatccctgtcaccaagtagataggcctgtctaactagacaatttcagaaataagtgaggctgagactgctacttacttgctttcatagcccatgaagccaagtggtttactatttacttttgtcagggaagaggacacttaatttgactgtcttgttagaagaggattcctgccaacaggaagagttataagtaaattaagctaccatttagatgaagtagagctgaatcccagggagttttttctttttatacggtgctctttttggtatgtatctctgtatctgtgactttgcctgacctccttcactcctctacatattcctacatgctgagtccttcactccctccctgccccgacccgatctgtactttgcagaagcttcagctgagtcggaggacgagatgatccatcctgagggagtggcttccctgctgcctcctgactttcagagcagcctggagagaccagagctggagctcagcagacattcgcccagtacgtatctccctccccactgcgctgttttgtcaatcctgcgtagttggtggggggaggtagttacacctcctttcatgctaagcctccatgaaagtcccagggaaattctgtgacattgatatttgacatctgtttctcatggaaagtataccctttttgaagtctgctttcacctatatattgtgttaccttctcagtgttttacgaagcagtgtgatttttcttctcatctgtac

SEQ ID NO: 74679 - DNA, 1026 bp, Homo sapiens
cttcctaggggaaatacctttttcccaagtaagcaaggctcatactcctctcttaaactagattagatctactttttaactattgagtttctgcataaaatttttaaattattccacagttaaaatccaaaaattattaggctgcacagtctcttaaagtttctttcagcttttaaaaatcccctcattataatgtgtcatatacttaaaggaaaaatccaagtctttgttaaagcaatagtgtgcagcctcagtactagatgaagtctcaggatactgtggaaaacaagagagccctcctcctcctttgttatcacctcattaagctgtaagtatcataatctagccagcattcagaggttcaattaagtactttaacaagcataagaaactgcataagttaatcagcttaattgtattccttttgcccattgcatgttagtctttgaagctttgcttttattaacaccgggtttgtgcagcaaacatgcctattctgtaatacacatgcaacccacccttcaacaatgtccattgagtgccaagagactcatttctactttaggtgaaaataaacctttactatgtttaggaaacatgactaataacatagaaagtattcaggtttttttgctttttcagttctaaataggacttgctaagcaagaaggttctagggaggagaacttgtgaagagaaagctggaggtcagaagggcaacttgggaatctgtattacaaaaaaaaaaaaataggaaaaggcataagctcctgttaccaaggatttcctttcacccagacaaaatggagttataactttgtctaaatgctgaatggatatcccttttcttagtctcttgatttcatacttttaaatactatacttgaattttggagttgtttgataaaatgtttcctggatatgaggccgggcattgtggctcacgcctgtaatgctagcactttgggaggccaaggcgggtagatcacctgaggtcaggagtttgagaccagcctggccaacatg

SEQ ID NO: 74680 - DNA, 1043 bp, Homo sapiens
atgggagggtgtgcactactctccaggagtgtcttaagctccttcctccttcccccaccccctccttgtttgtatctgtggtttcggcgcatgcgctgcagaaggagttaaatcccactacaacctacggcgttgctggcctgaggggggcgagttgggctgggtcggagttaggggtatagttgcgcgaaggggtggatggggttggtatcggtatctgcacgaataggactggggtagggtaaaatgtctgctcgattagatgaggaggtgagatgaagagagacctttatttgaagggacttgatgagagagaggtctctaatttagtggcatctagtggcaatttgggtggttaagagtttggtgaatattggtgagagaggcgaggcaggttgatatatattggggattttgaatcggtttgagtagattaaggtgggattgtcatgaggtaggtgtagctcgattcaagtgtataggtttggtttaaagaagggaagatgaggatgtcttggttttaattagagttcaacaggatacgtggcaggtagtgcagattaggtctgggttggctccagggttgagttggcagaccgttgcttatacagaagctgatagttttgtgtgtgtgtgtttgtgtgtgtgtgtttgtgtggatagactaggttagaccacagtttacagggtctgtggtcattttcttctgtagcttcctctttgaaaattttataaatttgataaatctaggtgccacagtactggaaattatacaaattgaccctggtactgggtaaccctttgaccaagtaattccgtcaggcaaaaaccaggagccccatggctggtttgagtattttaagtaattttacatgcatgatcagatttagaaggggcacttggcgaaagtgcagaagataatagggattttagtactggttctattactgatattatgacatagccaggtcactgattctgtgtgcctgcattttatatctgtacatttagtaacagtaaccatggctacctttatgggtctt

SEQ ID NO: 74681 - DNA, 1431 bp, Homo sapiens
ggaaatgtaaggaggtaacggatgttatggagttgttggcatatttcagaggcttatatgcacattgaaggctctttcatcataaataatgttttttctttcttcccccactgttgatagctgcaaaacaattagcatcagccttgaccagctgcacgtactagattttaaaatgtgtgcattttcattttggagaagatgtaatggaccaacattaatcattgtttttttctttacccaacctggcacatagaagtaagaggaagagaatgaacaagaaatatattggttatttttaggttctttataagaaagatggaggaagacagtgggtggggaagaatgggtttgaaaaaggcaggcaaataggaaatgaagttatttttggtgatttttctaaggtagttggataataatctaaataaaggactcttattattttgggtctttgaattcataaaaagtaattttctctgtagatgctaattgagtgtggtaagatgtcttgttgcttgaaagttgtattttcgttgctctacctggagagcatataacagtgcttttatgtttcaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttacc

SEQ ID NO: 74682 - DNA, 1040 bp, Homo sapiens
agatgggagtctcactatgttgcccaggctggtctcaaacttctggcctcaagcattccttctgccttgacctcccagattgtttggattacaggcctgagccactgtgcccaaccctggatgcttcttcatgaaaatgtagaaacttagagaaagtggtcaggagattaccaatgactccaatcctgtatttccaaagcccaatttaccatgtcctttccttttaaataactttgccttttacaaaaggagcattcagaacggcacttaaaccctcatttggactcgtagtttccggggtctcggaagccctggacctgaaattccctgctccctttatcccaatttatccaatatgttgggttcactggagacaagacagagttggtgtcattgccacagggaggggtgagaggtgggccagggcaggccaggggctgctgggcccctgacttgtctcactgagcggcctcctgttgcttgtgtccacaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagtgagttgaaagagcctggctattccctctcccttgaagggccacagcacctgctgctggaaagagggagcaggtgtccattgcccacctcgccttccaaagccccattctaactgtgatttgatctatcctgaagtcgtagttcatttcccaggcacttaaaccatttgccgttcaccccaccaggaggaggaaaggatccagtgactttcccagagcagattagaagctgaaaactgtcctgcagtaacactactgccttagagaatgaattgtgccctgagaggcttctgggaatcttgcttgtttcaggacaggccggtcttggtgtcttgaggcagggggaaaaggtgcattgtggagattcaggtcaagatcaacaggtgtggagcgt

SEQ ID NO: 74683 - DNA, 1038 bp, Homo sapiens
aaaccctgtctctactaaaaatacaaaattagccgggcgtggtgacatatgcctgtaatcccagctactcgggaggctgaggcaggagaatcgcttgaacccgggaggcagaggttgcggtgagccgagatcgtgccattgcactccagcctgggcaacaagagcgaaactccatctcaaaaaaaaaaaagaaaagaaaagaaaaaagagttcagcaagtttaagtacaagctacccttggaattgggttataactgaaccgttttgggggaattttgcagcctgggtccaggtttatagaatttagtgaacaccaacagagcctacaagccttctggtccaagaaccaactaaacctcacaggatccacaccctgtcttccaagactgaaatatgatggagggtcaggctagccctcctgggctcagtgcagactcaacagaacccattctcatccaccttgctccatgtctcgggggacatcagccctgagaattggtgtgtgagatagcaatttttcaggcccaggctgaaaaagtaatgagtaggattaaaatagggttccccagggtggcatggcaggccaccctggatttcttggtgtccagtttttcgcttctccccgatccaggccagctgaggagccatgtttagctcatgctgaagagagaactactcagctcttggaaaatgctgagctgggtattcctgcctcttggctgagctaaatactgggtggtgattcagcagaaaccccagctccagcagctggcgcaggagctaacaggataagaaggaaggggaagagagagccaggaagggaggaggggaggggatggggcagtatgggcaggagcttagctggaagtgtttggtaaaagctgtgtgcctccaggagcactcacagccctcacagcttctctgcaccctcctcctctgctggtgtgtccttggaagagagaggcccttccggaaggctcagagcacctcctctcctttggagggggttccgagatttctaaaacgttgtaagtgctt

SEQ ID NO: 74684 - DNA, 1059 bp, Homo sapiens
ggaggctgaggcagaagaatcacttgaacccaaaaggcgagggttgcaatgagcctagatcacaccactgcactccagcctgggtgacaacagcaaaactctgtctcaaagaaaaaaaaaaagtataaacaacagatggaagcattatttgtgaccactgttacagaagcacaaggtaaggagaattggacatataatgtacatctagaagagtggagatctcccttttacacacagtggagataatgtcaggtacattagaaaaggtggtacatcttttgtcatgttagtcagtattttattttattcaattgtggatattctcacagtgtgtattgctctcttcgtagctgaagcctcaggagaagatgtttttcaaaagtcctgtggagacagctttgcagtattttagtcacatctctcaggtatgagaaacaaaagtgaagaaaatctgactctccaggcaaattctaattgcatcttattcctttatcaaaggttttctttaaactgcatttgtacacaatggagggaaattgactgctttctttgctttcttccttgatgatacaaatttcaatcagttaactttttattgacccagaatctgtgataggctgtaaaagtcactaagtagctaacatcttgccttgtatttcctagttgtattaattaatttctacgactaaaggttgttttagggagctttatcatttttctcagcagatagatgcaccttctaaaaattgctttgagtatataggcctggccctgcaaacaataggtttgatggtttaacttgcaaccagtagtttatagcactaagtttacgagagtatttcttgtttcccattctcacttttcaataacctttttagtaatacttacctcttcatttagtgttcataactggttgcttgaattttaggaaatatcttttcttgatgtgtcatatgttggcatacaattgacttgatcaggagcaacaggaatgtagaagaaggtagagagaaggcaggacaaccatttgagagagttcccaagttgtaaaaactttgg

SEQ ID NO: 74685 - DNA, 1059 bp, Homo sapiens; identical to SEQ ID NO: 74684

SEQ ID NO: 74686 - DNA, 1028 bp, Homo sapiens
caccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaagctttgtgttcttcagggtgggtggcagggggatatagtgagggtggaccagggagaatgaccatagggcactaagtaaggctgggattggatcagcagaaatccaaccctctaaccttagggtagggagtgctaaggatctggggaaaccatgggctgggaagctgctcttgctctcctcgtgtctgctgtttttttcccttggtgtactatacagaggccagatgttggcaccacctctccaggaggattggaaaggaggagtaaaggattctgatttgattgatgattccagtgcatccccaatcccaccatcttacctggaatataaggctgccttgtaccccttttctgagcacaagtctgtgcgtaatgcaactgactctcttacttttttcttagtaactgatcatttcctagacaaccaagattctcaataagtcccagtctcatcacaaatattaatatttccttttcctcataccaacttgactatgtttcacccgcttcatgactaaatcacaggtggcagaatttttcagttcttttttttttttttgaggtggagtcttgctctgtcgcccaggctgtagtgcaatggcgcaatctcagctcactgcaagctccgcctcccaggttcatgccattctcctgcctcagcctcccgagtagctgggacta

SEQ ID NO: 74687 - DNA, 1055 bp, Homo sapiens
ccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgacctt

SEQ ID NO: 74688 - DNA, 1083 bp, Homo sapiens
gtttcgccatgttggccaggctggtctgaaactcctgggctcaggtgatcctcccgccacagcctcccaaagagctgggataacaggtgtgagccaccacgcccagccagccctgcacacttctaattagtccaatgacttaggcaagtttcttcatttcattaagcctttttctttttccctaaaaaaggttatggttttggaaatactttccccgtggggttgttgtgagagtccagtgaaataataaggagtggtgcttattacaaaatcaaacgctcaacaaaaataggattcaaagccatttttaaaaatcacatttccttttgttggcttgattaaattgggtaccaataagattaacaaatcttgattaggttaagattagtataaaagacctttcttccagggtattcaatcatttagagcttgtcttcggtgctcaactttagttatcccagatcactgaagctgagatggctgatgaagtaatttgcagtgaaattttaagcgactgtgactctgctgcaagttccccagatcttgaggtaaggaattgtgagaaaaagtgggggtgaggggaatagtggggtataatgagtcacttgattttttggtttgctaatgaggatcttctcttgtccaaatccctcggccaaccatgtttgtttaactttttggttgggctatatgtatctttcgaactgtaggttagtgtgcccacaaaaatttctcttgcaaacgtacactgccattcctttctttttaataaatgtgtaggactgctaccaaaatatggcagtcctgccttccagggctaggtctcattggtacttggggtgcaggggtgtagtgggaacctgccaggagaaattcctctgggatcttgggggcttgagggcttaaatgaagggtggcacccaaatccccaatcaatgcctgttcaatcaacaaacatctaacaggacattatgtggtaggcatattgccaggccgtggagatgcgaatataaataggaaccggcccctcatctgcaggcgctcacaacctagttaggaaacagtaaaacaattaagcgcgcc

SEQ ID NO: 74689 - DNA, 1041 bp, Homo sapiens
ccctgggcctggttcgggagcccccggcagccaagaggaggaggaggagccgggactggtcgagggtgacccgggggacggcgccattgaggacccggtgagggaaggagggcgagcgagcaggccggcggctggccggccgggtcactggaggcccagagctcgggcgagcgggtggcaggcggggggtggggttgggcggggaataacgtggctggggccgggtcgggccggggatgggtcagcgatcactacaaggggcccgactggcttgattcgggcgtcacggttgcctagtgttgttctagagagggtagcttttcttttatcacgaccctcgcatggggcgagggaaatggccgagcatggctgaggccgcgctctggccgagagcagggcacagcccctgcgttggttcctcttaagctgtcctccataccctccccacttatattaggagctggaagctatcaaagctcgagtcagggagatggaggaagaagctgagaagctaaaggagctacagaacgaggtagagaagcagatgaatatgagtccacctccaggcaatggtgagtaactggcggttgcacgcggagcccgggttctcgggttggaagggttgtggggaggatggggaatgtggggttagatactcggcaccctggagctgcttgtctgagctattatgactgtgccgcggtcatagtccgttgtgtgttcctctgacctttgtgaggcagaacgtatattttggtggtggtagccttgtgcctccctttgtgcctgttataattgtgttgctctttgttcttagtctacgtctatctttctttgtagaggttgcgtgctcgcatttgaccttcaaatctaatagtttttcctccaattggagacgctttaggattctaagagaaagcaagctgcaaggggtttcccctttaatctagaaatgtggagtctcagcccacttaattttgctcactcttaaaagcatttcaaccaaagccattcattagggatttgatttggaggcaggag

SEQ ID NO: 74690 - DNA, 3435 bp, Homo sapiens
aacatctccgggatagatgtggttttgggtgtggagggagtgtgggaaggaggttaaaggtaatggaatgatcagtaatcagcaaaggctctgggtttggaaggaaaagagattaattcctcaaattaccagatttcatgtgctttggtgtatgatggcccagaccaaaggctcgggagggttccttttgagacaggaatttgcctggtgcctgtgaaatttttctcctctcatcaggtggactatggtgcaacagcagaagagctggaagctcactttcatggctgtggttcagtcaaccgtgttaccatactgtgtgacaaatttagtggccatcccaaagggtaagtaaaggggagtaagttgagataatttaaattacagtgtacaaatagataaattatgttttatattgagcagtaagttatttggtgttaacacaggtgatctgtgtcatttaagatcatggcattaatgttgatatatcaggagttgcacctaaatgtcttcagaggccagataacaaaaatgaaggctagatgtgggtgggattacgaactagaaggggaggggcagcttctacttggcctattatggccatatggaaattcaggccctgtgtgtcttatttttacaaatttcaaagagtagctggaaattttaaaatttaaatgatttcgaatgattgaaattttccatttagaagaattttgacaaataaaaaatataactgcattgtagcccaaaacgaagcatgcctgcaggttgaatttgacctgtgaggtatttgtaacctcagagagatacaatgacaattcttttcaggtttgcgtatatagagttctcagacaaagagtcagtgaggacttccttggccttagatgagtccctatttagaggaaggcaaatcaaggtaagcctatgtccattgctgttctagttgtgtataaactctccaggttgcctttaaggctatcatttgttcatctctgactcaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggtttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgttttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataaaaattgtttggccttttgggtgtaaggattatttatcttcctattctctcttagatcgcagatggctattaattctgccttgtggtagaagtactggtgttgtggaagggaggttgccacttgtgaattaaggagtaggaattacattacaactagcaggaacattatgtgtttagttgagaatgataggttttctggataacatgtaaccctgattggcatttgagagagaaataagcctgggaaagtaaaagaatagctgaattgggccgggcatggtggctcactgctacaatcccaggactttgggaggctgaggtgggcagatcacgaggtcaggagatcaagaccatcttggctaacatggcgaaaccccacctctactaaaaatacagaaaattagcctgacgaggt

SEQ ID NO: 74691 - DNA, 1050 bp, Homo sapiens
tttttttcttttttctttctttttgagatggagtctcgctctgttgcccaggctggagtgcagtggcataatctcagctcactgcaacctctgcctcccaggttcaagcgattctcctgcctcagcctcccgagtagctgagactacaggcacctgccaccacacctggctaatttttgtatttttagtaaggatggggtttcaccatatttgtcaggctggtcttgaactcctgacctcgtgatctgccagcctcggcctcccaaagtgctgggattacaggtgtgagccactgcgcccagcctgaccattcttaatgtattaatagaccaatgtcccacctccatggaacaatggcctcatctccaaaaatcaattactcagtcccctaatatcattggctttaccttcactgaccagtagtatcctcatgcacaagtggccaatggcctcccctccacaggttaatagttccaactccgtatatcaatgaacccccctcccacatctcctctgaacagtctgagcaagataagctccaggcccactgaccattagctctgttcctaaggatgaatggtcccaaatcccctaagcaatatcccatcccctctgttgagtgatgtcacatccattgacaagtgccctaatctctgaccaatagcccaagagtcaatgttcccacctcttaaagaaccacaaccacaccccagtgcccagtagccaggcatcacccacccatggtccccatccctccccatcttctcaagcctctgtccaactcttgctcccagaacttcattctcatacctctagctctgaagtgtgcagctgggtcttacccagcaactttcccaccaccagagagtctgggtgaccagaagcccttcccactttctagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacc

SEQ ID NO: 74692 - DNA, 1032 bp, Homo sapiens
tctcctgccaccccctgccccccaacagcaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccaggtgaggcggccaggcgggccgcgggtctgggggcgggcagagagcggcgagggcggggcctcacgcccgctgcacccttctcacatccccagtgggatctggtgtgtgacctgggctggcaggtgatcctggagcagatcctcttcatcttgggctttgcctccggctacctgttcctgggttaccccgcagacaggtgagggctgtcgtgggggcagggctggtagaaaggagggggtgctagggaagctaacccaagcagcgggcgtttacaggaggtcgaagacgattcgctggactctgcagtcttctctggacttctattcaatggtctatccatgtctcaacttcactctccatcaagaaataccccttccctacctcttccgcgcaagggaatgactcgacctctatggactattagtcccattcccactaattagtggccccctatccgtgaatcaatggcctcatctccaaagagaatagtctcatcccca

SEQ ID NO: 74693 - DNA, 1058 bp, Homo sapiens
gcaaaaccgagcctggcctgaggcaggctgcgcgggaggccaaagccatggccattgccacgtcggtgagtccaccagggagtggaggctgccggggagagacctccacggcctgccctgcgctcctgtcactttatttctgccctctctttgtctctctccttggtccctttcttctccaggaggctgtgtccccctcctctcacttttgtttcccttctccctctcactcctcatcccctgctcctcctggctccgggctcgcccctcttccccgccccctccccattctcctttttcttcctagaggctgcgcctgaatggaggggaaggggcaagcgtagcccgagtcctatctgctccttttgggcgggaacagatggccactggtggttggcagaggcttgtggttgggaggcaagtaaaaggtttggagggggctgaaaggacctagtggctcacggaaaacggaaaacgagaggctgaacgaccccaggaggcccatctcgagacgagggataaggaaaaaagggagatagagcaaaggagggagatcaagaaagagaagacagagggaggaggggaggtgatgtcagccagagcctcaggccactttccagggatcgggacaaagggaggagacagctggcatgatgggacagtgggaggaggcctcccagagagcacagaggctctctgccacctacattaggctggccattccctcaccagtcagctgggctgctgggggatagagcaggagtggtcacacccatcatcaatcagtccatcaacaactctgtcctgcaatggcagggcccagaggcttggctccattggacagaactcagtcctaacaccgggaggagcgctctacagccccacctctgctttctgttctacagtctatgcagtctgaatccaggcagctttgttccctttccaccctcttctaggtcctgcctaagattcccagggaagcgaggccgtcacctgctttctgttcccttctcagtggggactctcggagagagactggaaagagaagcacagagcca

SEQ ID NO: 74694 - DNA, 1033 bp, Homo sapiens
actctgggtgctgcggcagacgggagccaatacgcgctaagttcgctctgctaattccttttttctattggtccttccaactgtcaatcaattatttgactgtctcttattggcttgccgtcaatcattttactcagtctaccaatcacacgctctttgccaagtgctttttttcgtcctgacgactctttctgagtctgacgaatttagccagttcctttattccattggccagatcagactcctcctctcgtttatcctgttgggggcggaagtgagaaagcccttattcgtattggcttagatttgcaagcggcagttgtctatcaaatctatcaagtcgcccttagcgctcaggaagtacgacaccggaaggggtgggctttgcgaagatggcggcgctggtgagtttggtgtggtttcttcctcgcgtagctattgtggagttgtcctttgccttcagcggctggaggcaaactgttggtaccagggaagggtggtgatgaaagttgcttcagggaggcggcctccctagagttaccgttcctgtccggtaacccaaggggctggctttaaggcgagtctgtgaacccgagtgtgaaggccccgagtctgggtgtctgacggagagagggcagtttcccaccctagacgttccactttcctataatcctgaggaaagaatgacttttctttacgcctcctctcccttctgtagggggtgctggagtccgacctgccaagtgccgtgacacttctgaaaaatctccaggagcaagtgagtagtgtcgcctctggaataaattagtcacggattggctttgagtttgtgtacttcacctcaaaactttggtgattgagatacgtgaatgcttccaaaaaccttagagtaaaatgatgtaatcaaaaccttttcacgccagaattctaagtaattgattctgcacccaagggaatacaagaaactccaaaaagaaattatatgaatagttttcctttattcatatagctaaggaaaccagtgcttggaatg

SEQ ID NO: 74695 - DNA, 1043 bp, Homo sapiens
tgaggtgaatggatcggttgagcccaggaggtcgaggctgccatgagccacggtcgcaccatcgcactgcagcctgggcaacagagtgagactgtcttaaaaaaaaaaaaaaaaaaaaaaggccaggctaagaagaaaaggtggctcacacctataattccagcactttgggagattgtggcggatggatcacctgaggtcaggagttcgagaccagcctggtcaacatggcaaaaccccatctttactaaaaatacaaaaattagccgggcatggtggcgtgtgcctgtctgtaatcccggttactcgggaggctgaggcaggagaattgtttgaactcaggaggcagaggttgcagtgagccgtgatcatgccactgtgctgcagcctgggcagcagagcaagactccatctgaaaaaaacaaaacaacaacaattaaaatattgtagttttcaaatgaaggtctggtagaaccttctcagggattactggttgggggcaatgtggaagaacaactctggatctctcatccctacttaactggaaaactctggtattatctgtttttatatattgagcttttgtcctaagatatttaggccaaatattctatgggtaaatacaagtatgaaaatcattgtaataagagtcactgaaggagttttaagcacaggagttacagcagatttgtgcttacagaaagataactaaaaacagcattcaaaatatattcccttcttgtctttatcattcacttatgttcttattgtccatttttatttaaaaaaaatttaaatctttgtttttctctcatatgcttgtagctcagtttgaatttgacaatgcccaagcacgtcggaagagcctgcttctcaaattcttacctgtttttgtcctgggtaccatgcttttttgttttgttttgtttcgttgagatggagtctccctctgtcgccccggctggagtgcagtggcacgatcctggctcactgcggcctctgcctcctgggttcaagtgattctcctgcctcagccttccgag

SEQ ID NO: 74696 - DNA, 1944 bp, Homo sapiens
ccactctctcttctccttcctaaccctttgtctagagcaccacaccgctcacaaactctttccaaatgctcagttggctcccaaagttggagcctggcatgggcagggagcccacaaaactctaaccaaactggaggctggcatgggagaagtgcttctggttcactcttcctaccctctccctcctaaccctctccttgcctgacaggggagcccctgtggcctggactctaggggatgccgccaccagaaacccctctgccaatccctaccttgcaccctgggaactgcagtaacttattctcaaaggctttaaacacagagatcctctcagcggccgtgggcctgccccttgtcctagccctgccacgtgagggtccagcctccagggacaggcactgcccaccaacggcaaatccaaagttctttcaaaaaaaaaaactgaaacacaaccaaaaaagcaagagcgagagagagtacgtgcacacgcgcacaaaagagagaaacggacaccagaggaatgaactaaagaaaaacgtaaacttggaaaatacagaaaaaaaaaaaaaggaagaaaactcccatcagacaagtgttttttttcctatttgtgtcactccctgctccctgtcccacccccacccccccggtttaagggtttctttaaaccacctcatctttggaagaccaaacagctttagctccttgctatgggtctggtggtcctcgaagggccgatgccggtgcagccctcccctgctatgcgcagcctccaaggtgggagctggcgatacagggagaagagcctgaactctggggagggacatgtccccgctccctgagttgggtatttatcaggacaggtaatagcccctcatttccagctatgagttagaaaagtcagtgtcaccaaaagtatcttggcagtcccaggaagaagggggtgagtggggtatttaacttctgaatctgagatctgcttctctttcatctcctgccttctccttgcatttacctttctcacaaactcctaaccctgctgcccccctggaggcccacctttgctgggtcccttgttcccttccccccagtctccttttcttcccccttgtcctctgcccttgctcctgctccctccagtccagcccagcccagcttctccgttaagcagcagctgctggaggcatccccaagggagtcgggacccgtccatgagactcatggggttctagagctgacacgaattgaggggatggggtgggcaaggagatgactgaagcacaggtcaatctttgatagggtgttatcaccaagggaaccaacagaacctagaagaatgttctgtacccctaggcaaatggtttctgtagccatcaggtgaaaattctggcaaccctaaagcccagctaaagtagtgtggggtagagaagtccatgttttcttttagcaaagaaaagtctgcaaaattcctcgtcctccaggtagtttttcctactactcttgtccctaagaccacttctctttcaaggtgttctccttccatcctctctcccctccaggctgttgctctatcattatccatttcatattctcatacaaattcagccagccctgggatttaggttttctgctctatcagtcacatcactctgtgaacatgttaatactgaagcagtgtcttacatgcagacagaatgggaggggacagaaaattcagctcagtcagtagcccccatatattccatgagtctcacttcctgtcccattcacttctgaataactccaactctaacaaattaggggtggggtggagttagttttctaactaacagcaaattaggcggagttagttttgtaattccaccccaatttctgataccaaaaatgccagtcacagatctaggcaacaggagagaaactggccaccgggtcttgtgctcactg

SEQ ID NO: 74697 - DNA, 1063 bp, Homo sapiens
ggggaagaggaggaagaggtggaagaagaagaagtagaggaggaacagggccttgaacctccagcagggcctgagggcccattaccagagcctccagatggggaggagctgagccaagcagaggcaacaaaggcaggaggcaaagagcctgaagagaaggctactccatcaccttccccagcccatacctgtgaccagtgtgccatttctttctccagccaggacctcctgaccagtcaccgccgactacatttcctgccatctctgcagcccagtgctcccccccaactcctagatctgcccttgctggtgtttggggagagaaaccccctggtggcagccacctcaccaatgccaggtccacctctcaaacggaagcatgaggacggcagcttgtctcccacaggcagtgaagcagggggaggaggggagggcgagccccccagggacaagcgcctgcgcaccaccatcttgcctgagcagctagagatcctgtaccgttggtacatgcaggattccaacccaacacgcaagatgctcgactgcatctccgaggaggtggggctcaaaaagcgagtggtacaggtctggttccagaataccagggcccgggagaggaaaggccagtttcgaagcacccctgggggggtgcctagtccagcagtgaaaccgcctgccacagccacccctgcatccttgcccaagttcaacctcttattaggcaaggtagatgatggcactgggagggaagccccaaagagggaagcacctgcttttccctaccccactgccacgcttgcttctgggccccagcctttcctaccacctgggaaagaggccaccaccccaacaccagagccacctctacctctcctacctccccctccacccagtgaggaagagggcccagaggaaccacctaaagcttctccagagagtgaggcttgcagtctctctgcaggagatctgagtgattcatctgcttccagcctagctgaaccagaatcccctggggctggagggaccagtgggggacctggaggtgggactggggttccagatg

SEQ ID NO: 74698 - DNA, 1037 bp, Homo sapiens
aggggcagtggggggtggtggtgaagccactaggctttttctcattgcaggctacaactgtagaaatgacatttacaaccaaagtgctgtctgcacccacattaagccctctggacaatggccaagaaccccccactcatgggccagagcctacaccgagcagagaccaggcagcaggtaaggaatggaacagcaaacctcccaaggtaccaggaaaggggactccatgggccaacaaggtctgaagatgactgaggccaaggtcaactgccttggtattgagtgggtggggtctggcttaaacgaagttccctcctcattgtactttcttctctctcccctagaaggccctaacctgaccccagaagccagtccagatcctcttcctgagcctcccctggcctcagttgaggtcccagacaaaccctcaggaagccctggccaacccccttctccagccccatctccagtccctgaacctgatgcccaagctgaagacgtagctcctccgcccaccatggctgaggaggaagaggggaccactggggagctccgctctgcagagccagctccagctgactctcgccaccctctgacctatcggaaaaccaccaactttgccctggacaagtttctcgaccctgcccggccctataagtgcactgtgtgtaaggagtccttcacccagaagaatattctgttggttcattataattctgtctcccaccttcacaagatgaagaaggctgccattgacccctctgcccctgcacggggagaggccggtgccccacccaccaccactgctgccacagacaagccctttaagtgcacagtctgcagagtctcctacaaccagagctccaccctggagatccacatgcggtcagttctgcatcagactcgctctcggggaaccaagactgattccaagattgaagggccagaacgcagccaagaagagcccaaggaaggcgagacagagggggaggtgggcactgagaagaagggccctgacaccagtggcttcatatctg

SEQ ID NO: 74699 - DNA, 1369 bp, Homo sapiens
attttcctgggccactgggggagctgtggtgtttattcacattaggaaaaagaagaaggaaaaagaaagatggaaaataaggtgggagctgctgagcctgagggaggatgagctggcttctgagcagacaggtagggcccctttccaggtgatggttcacagaggcagagtgggcagggacaagggagcctctgggtccagaaaatgcccagaggaaatggaaccatttcacagagaagacacgacaggataggataggtaagagaagaaaactaaatccaaggtgggggcagtaggtacagagccatctgttagctggagagttgaggcaggcagcaaagactgggaaagacacaccaagaaaaggcagagaggccaggatggtggaagagggccagacaaagaaggagtgcaaggtagcggcctaagctaggcctttgtcccaatccaagggaaagtggggaggagccagctctcaggactgtggctggaggctgggtctgctataatgccttcctatctggctagttcctcttcaattaggagtgagaggccaagcgtggtggctcacgcctgtaatcccagcactttgggaagccaagatgagtagatcacctggcatcaggagttcaagaccaacctggccaatgtggcaaaaccctgtctccactaaaaaatacaaaaattagctgggcgtggttgcacacgcctgtaatcccagctgcttgggaggctgagggcaggagaattgcttgaacctggaaggcggaggttgcagtgagccgagatcacgtcactgcactccggcctgggtgacagagccagactccatctaaaaaaaaaaaaaaaaaaaaaaaaggagtgggggcgggccagtgctgcatccaaaggactatgtgatggtgggtcccatccttccctgacacttcgtccactgcccatatgttccctccaggtatactgctgtccatactgcagcttcctgagcccagagtccagccaggtgagggctcatacactctcccagcatgcagtgcagcccaagtacagatgcccactgtgccaggaacagctggtgggccggcctgccctgcacttccaccttagccaccttcacaacgtggtgcccgagtgcgttgagaagctgctgcttgtagtgagtacaggctgggtgaggacggtacaacaagaccttattagggctgtgcaggaggggaggaagaggcaggggtattcaggcaggtgcatgtgttgggggcagggggcattcaggcaagtgcgtgtgttggctgggtgaggacggtccgacaaggccttgttagggccatccaggaggggaggaagaggcaggagtattcaggcaagtgca

SEQ ID NO: 74700 - DNA, 2408 bp, Homo sapiens
cctgaactcttccagtactttgggccccaggccctagggcagcctcagactcccttggctggcccggggctgaggccagacaagcccctggaagcccagctacttctcaatggtttccaccacgtaggagcacctgcccgcaagttccccacatccggtaagcttctgtgcttcttccctcttctctcctccccagggccaaactctattccgtgctttctcccaaggaccaactccccacttaggtaaccataagtccctctgagcactatcctactcattaacccacctccccacatagagaaccaaccgtgccccatttctttcttgggccactaatctgtctctgtcctctagcccctggaagcctatcccctgatgcccacctgcctccaagtcagctcctgggttcctcatctgacagcctgcccacctcaccacccccagacgacagcctgtccctgaaggtgttccgctgcctagtgtgccaggccttcagcacagacagcctggagctgctgctctaccactgcagcataggccggagcctcccggaagctgaatggaaggaggtggctggtgacacccaccgctgcaagctttgctgctatggcacccagctcaaggccaacttccaactccacctcaagactgacaaacatgctcagaagtaccagctggcagcccacctgcgggaggggggtggagccatgggcaccccttccccagcatccctgggagatggggctccttatgggtctgtctccccactacacctgcgctgcaacatctgtgactttgagtccaacagcaaggagaagatgcagctgcatgccaggggtgcagcccacgaagaaaacagccaaatctataaggtgaggctgggtcaggaagggccatcggaagaggagaagggaatggggacagagggaggagatgcagaataagaaagtgataggaaaaccctgggtgacaaatggagaaaaaggaaagtatgcaccaggtaatgacatatgtaccagggtaacaaagtgacagacatggagaaagagaccaaaggatagtaaactctgacaagtgaaacagactttattcagctcttctggtgtttggccctggagggaggggtggtatcagctcagtttgtcatgtcaccagaggttcaagaggatggaaccagactccatttgcatgctgggagggagtccaggagtggtaggagaaagagaaagggttggggagagcaagcaataatacttaggtggccataggagggaaagggggggtttcaggagcaggaagcgaggggtggggagggggctgctgctagtcagtctcccttagggaaggcaaagaagtcccctgaggctaggtgcggtggctcacgcctgtagtcccggcactttgggaggccgaggcgggaggatcacttgaagtcaggagttcgagaccagcctggccaacatggtgaaaccccatctgtactaaaaatacaaaaattagccaggtgtggtgcgcatgcctgtaatcccagctactcgggaggctgaggcatgagaatcactgaacccaggaggtagaggcttcagtgagtagagatcatgccactgcactccagcctgggcaacagggcaagactctctctagaaaaaaaaaaaaagtcccctgaggtctggcatgtcccttctgggcctgagccagcctcttcccatggttctagtttctgctggacatggagggagcggaggcaggggcagagctggggctataccactgcctgttgtgtgcgtgggagacaccctcccgcttggctgtgctgcaacacctgcgcacacctgcccaccgcgatgcccaggcccagaggcgtctgcagctgctacagaatggcccaaccactgaggaaggactcgcagctcttcagagcatcctgagcttcagccacgggcagctccggactcccggtgaggaagaagggactggagaataagagctgggcagggagggcagcaggatgtggggagcaggggggctgcggagttagagatacaaggaaggcgaagagggcctgtaggccacctatactaaatgggaagaagctgcgaagggataagacagaatgagcgtgtcaggcactgtggaggctaccttgagtggaggggcaaagaagggcaggggctttgctgggtggatgacatagaacaggaagagggtgaagaggaaccacccagtgattctgagtagtgactagtgtcctggtaatgctggagggtggcaggctggagctgggtaggaaggagagagaacctgttttgtgctgggccagggcttcttggaaggagataggagctgtgggcatgatccaaaggcagcagggatgggaagaggcccctgacaagcttcccagcctc

SEQ ID NO: 74701 - DNA, 1027 bp, Homo sapiens
gtctccagttcaaggtaggaagggcaaagaaagggacctagcgattctgagagggaaggaaggaaagatggaggagtgaaaatgcaatgaggggaaaaaaagcaaaaaaataatcgctgcagctaaaggtttgtaataaatagtgggtgatgggagaagctccgagaagaaagggggatggggagttggggttgggggaggatgtactgaggcagagatatatttgcaattgaaattctttcctaaagaggaggagggttaggttgggaggtggggaagagatttgcaattttaaatagctgccaacctaccctcggccgatcagagtctcacctacaagctagccgaaagctaagctcctttggtttctagctaggaatcagctatgtctttttccagttctaggaaatagatgtttttgagagaggatctgggagttactgtaggatttggggcttaggtctgcctagccctactctgagctgtgatcgagcgtggtgagtcaggagccaggaagcagctggtaggcttagggagggtgagctgtagcacttgggccggctgggagagagcacgcacctgtgtacagcccttggcggcagggcccaggacagggcctcttgcccagtcagttattcccaccaggtggggtagtggaagggcggtgtggcccaccctgtgggtgacgatggaataacagaccctcacaaaccagcacccttacccctctcccccaccatggattctgtaggaggaatacctttctccctcaacttgagggcttctgctttctggttatcgagaaatcggctcccctcagtccagttccttcacttcccttttggttctccaactcccccgacctccccatcccttccacccctttcccaggtgctgatttgcattttcattaccatgctaatcccactccactcagcattccttaatggctctgacttcatgcctggctagaaccccaggaggagggaagctacaatggggccttcaggttgggtggggccagact

SEQ ID NO: 74702 - DNA, 1049 bp, Homo sapiens
cgaggggcagattctctcctttctcagacttcaattttttggtccttcctttgcccatgccctttgtctcttgtaattctccggtccttaagtctcactatttcccccatcttgctcggtcagggcctggcttttcagctttccacctgtgtttctgcaactttacatctgagcctcttatctctgtctcatcacatttctctctcggcagctttctgggtcctaatgtgtatcttcccacctccatggaagaacatttgcagctcagtaattacgactgtatatatttttttgtttgtagggcattaactccctggctgagccttgaaagtagcacttccatccttcctttctcatcctgagaagtaaacagagacctgggtctggacagaggaagagggcaataccaaaaggaaaaaatgtcttctatttctccacacctttctctccatcttcatcttcctcccctcctcagccttgtgacgaaacagtgcattaggggaggaggataggctgaaggggcagcagggaactctggagactaagggccattttggagctgcaagattcatctcaggggatgactacaccctcagaactctccgccctcccttggctccaggcctccctcctcccatccccctcagtggcagcagccttgtaatttaaagctctctctgtcgcctctaatgtgatcctctcgttttattgactctttctgccgtctgtggcgccccttcacatcaatctcctctctaatcacagcaccgccactgcctgctctgtctcccctaacccctctccttcacagaggcccccagcccttgcctctacccaggtcttccctgaccgtccccaacctccaccctacaccagatccaccctcttcctccttcctcctcttgcctccttcagaggaagcaatgtcagggcctttcaggggtcgccttgtctctttacccacatctgagatgtgtccgcagggataggggatgcccttaaggaaagccaggaactaaagggaagaatggcgatgggtctgaggatga

SEQ ID NO: 74703 - DNA, 1943 bp, Homo sapiens
tgggctctcagtggcttcctcatgtaggaactagtccagagaccagggtcctcatgtgcagttgttaaggggtgacagggctgaggtccacccacagtcctgtcaccaagctgtaccactggcatgggggctgcatacacctggaggaagatatatttttctaatttctactgagatgctcagcacccctcagcattttttaccccaaagtctaatgagagaacaggagccctctttctgtatttggcaggaacacaggattacatcaaagctaaagttcaggccttggaattcccagcaggaccatcaactggaatgtcgcatgcacaggggcctgtgcaatcagaaagacatgaatgttccagggtgtgcaagacctctctgcagagcagtttatgcatggagagtctggtcctgtggagcacgttgatgtgcaaagtcagtggggcagaatgggtgtaggcaggaatttaacttcatgtatgcacatttccctagtgcctcctccagtcatagctaactgccctggacctctccctttggggctgggcttgggctagaggtcaagagtcaattaccagtcatttggcttctcagtgaaggagggcagagggtgggccaagagtgttagattgtgtttccccgaggacctgatggggtaaacgccatttccatcctcagatttttcattccttgttttgtgatgcccttttctttccctaatctcaagcctctgtcttctttattcctgggccatgggcatgggtctagattttgctgcttctcttgcctccatcacagttgtctgcatttccccccagccatctctgtgttctgtatcagtggtctgcttgggccacagatgcctttcttctcatctccagcttcttcaggctatgtggtttccacaaacctacagataaatcctgctgctttagggaaagaagtgcacttgaaattagagagaaggccagggaaggatgagaaagaggttctggaaagattaggcagggagaagttgggagagagtatgacagagataggagtcaaaggtgaaaaacccatgacttggagatgggagagagcacagagagatggccacaatttaaatgagaaaggaaggagtgcagtaggctgtgaggactaagaaattggagagcaaacaggaagcctgacccctccgcagggaaatgaagacagctgaggagggcggacgagtggttgtgtaagaagtagggctgaaaagccaggccatggtctcggcctgcgtgtcagtcctgagttcaagcagtgctggctttgacccttatgggaggaactgaagtggcaaattaacgacgataatgaagtcactgctccttgtttgtctttgctggtttccccttgagatttgtcctttggccagacagggcaatgtgggggaggggaggaactggagccgtgaagggcgggggagagggaaggaaaagaggatggagaaatggcaatgtggaggacaaattgactagaggagaaaaaagggagggtgatgagtgaagagaagaggagcccagaatcgaagagagaagcgggaagggagacatgaaaggagaatgaaagaggagaggggtgcagaaaaacggccagggaaaagaacaatgggggacaggaaagggaaacctggtaggaggagcagaaaaaaaaggtgggagaaggagaagtggaatggagaaatggcgagccggagggaaagaacgtggccagggctgcaaaagctgcagctggcagggccagtgggcggggcctcatctccatctctaatggctgtgaaatgaggttagcgccattagaggcagcgagagtgtaacgagatcacactcattagggctgggccatcccagtaattaccaccaccctaaacacgcccgcgccagccgggccaaccacatacgggctcacagcaa

SEQ ID NO: 74704 - DNA, 1032 bp, Homo sapiens
tttgtatttcattcccaagccagaacacaagcaaagagatgaaaaagtagaattcccataaacttcagctgagaggaacttgaatcttcccagcccctgagaaccaaagacctcaagcctctgatgtcataaattgctggtattgccttggcaacctgacagggttcctccctccatgatgtcagaggcagctggtgttaccttgagacccatacaggaatcacttgctgctttgccggggtgctgtatcacctacgggccagggcctgggtcgaattggtaggatttctgactctggtagcttgaccttgcctccctggagctcttcccagctcagaacaacagttgtcacaaataactcctgtttgtgagcacctgaggtttgctagagcctgacagtagcaagaggaaggaacctaagacagggcattgaggtcaggatggttggatcaaaaggcaggcagagacggaagaggaggactagaaatggcagttacagaatgtgaaaggagaagggctttgtgagtggggaggagagttgttgaaagtgtaatggctttgggtttaggaatggagactaaagctagaatgcagagggaagggatcggggctgtgtgagtgtaaactcattcagggattgagaaaagggaagggttgtgaaatgccagagggcacagtggaatttggctgtacagaaaggggggaaatgggacagagtcccctagtctgagagacttagctgtctggtgagagactcagggttagtcacatggtcatctgaggagtggctacatctgtctagtttccaattgttttccagcacctagcacagtgtctgtcacacagaaaaggcttaataaatatctactgatcaaacgttgaattagtagggagaggctgggggaaagagttgcccacctaattttcacccactccccccacctaagtctacattaatgggcaaactgggaaatcagaaaccggagggaatggctggagggtagttaaccagtgacagtgagatctgaggca

SEQ ID NO: 74705 - DNA, 1282 bp, Homo sapiens
tttttccatctgtttcccatgagctctgagtttccacctttgttcccataatctgccctcttcctaccttttcttcttgatcaccctaagtttctagtttcttttatcccttttcctcttatccagcattttaaccccagcagcagaaagtaccagcaagcaaagggctgggagaggtgtggggtatggtttgtgaaggcacataaacaggccaagaaataaatttaatgagcttccaggggcatataacccctccatcagtcagtgccattatgtcagttaactgtcaactttgattttgtaaggggacattccctaggactctaagctccaccctgcctggttgccccccatccttcagttcattctagatatcagttgctttttcttcactttttagttcatcttcttcctaggcccctgctactatcatatttagatccagcaccatttttttttaatgaggcagtgtttattagtgtaataaaagctatcgtatgtaaggagccaagttcatttagcctgaagaacagtaagggtggataaaggatctggagagtttaccttagtttttagcccatcattgtttttccaaacctcaggagcttggaaaggtaaaaggagcaggcagacatgggcagaagatggacgatttcagaggtgaacagaattaaagaaagaaaggggtggtcggtgcaataaacacatggggtagagaaatgtatgacgtgagggatgtgcaaaggaagggaggaaaatctatgcggactcgggggcaggggaggaaccaaggggtgattaataagaaattggaagaatgaaacaaaacgtgttgatagcaatacagaaggtaaaaggaagagaaatgatagaatattcctaaagtggaggtcaacagaaaaagcactatgaaattaatacagtagtaaagagggggaagggaggaattgctgaacaagatgagatgggaagagagtatggtacaaagaaggtaaatggatggcaaacgaaggagtgctgaggcagatcagagctgcacagagcttggtaggaggaaaagaggagaggatgaggtatcaaaggaaacaaatgcctctggtgtgaggaggacacagcgtgactgatgcgaagagagcgagagcactgcgggggcgccggggggttggaaaaaaagcatagcacaaatagcaggaataccactgggcgaagccccagaagagagaaatgcccaagagagggagagaaagcagaaatatccagggaagagacagagagagagaga

SEQ ID NO: 74706 - DNA, 1088 bp, Homo sapiens
cgtctccgtccctgacgccccggagcgagcgctggagggagggaggaggaggggaaaaaagaggaatcaacacatcggagaagtcccttccaagagccgccccctcccctccccgcctcgcgctgctcggtggccgcggttcgactcccgtccctgcttccagctgaggtgtaagtgcatcgatttccgatgctgctgggttggtttttttctcctctccctctctctcttcttcccttccttgctctttggaagctcgagacgggagaggaggcgcttggagactgccgctggaggggacggagagggacgggaaggggctgggggaggggacaaggacggacggacagacagaccgagagccctgggagatagcagacaggggtgtgggaggaagagggcgtgcgcgaggatgggggaagagagatgcgggggtggagggagaaacgggaacgggaaaggcagaggcccgccggacagacgaagggtatggaaagcctagacggaccgcgccgagttgggcagggagcggggatcccggggggaaggggaggcccggtgagtgtgagggctcagagctgtcagcctggagggtcctgggtctcggcggccccccgccggctgtgggatgggagaaccgcggccggcgggctgatggatgggctagcgcgctggggcgtggagtgggaggggacgtggatactctcagtcttcgttcgtttttggctgaagttgggctttccattcctttttttgaaagtgttgagtaggtgaggggaggccataagcccattcaaggtgaagcgtgtctgtcctgcacgcccatcctaccacccccatccgctcgtctgcccctctgagcagccctatcattttcaagcacaggaccacgcttcctcgctgtgcctgtagccccgctgatctctgtccatgtgtccctgacttttggttttgctgttcttcatcttgtctcttccatcccatccatctctggatctgtatgtcactgtctccacttgtgacccttcccatctgagtgatcctctccttgtgtgtctctatcactatgtgtcacgccttggctgcct

SEQ ID NO: 74707 - DNA, 1040 bp, Homo sapiens
gcggggcaggggcgaagctgcttggaggggaggatcaaggtacaggaccctgtgctagaccccacagagaggcctgtgactccaggggggtgagaggggttagtaacaacaggaggtgctaactgcaaagaaggtggtagtatagctcataagcaccaagcaggactgcaggggatgtgctaaaagagtgaggtctcgactgtcactgggaagggggcaggataggaatggaattacacagttccaggagggcctggcccttgcaactggaagaagtgttactacaggacgtagcagtagaagggtgtgagaggagcaggagggtgtgatggtggcaaacacagcccaggtcagggggaggaaaccaaacgggagctgccctggcctgccaggaagggaagcagctggcagagtgtggcgaagggtgacgactccagaggagaggaggatgtgatgtagaggggacaggggctagggggctggagcatctgagcagggactaacttgaagtgggggaagttctgctaaatccctgtctctggacccgacagggcagcagacgccctcctaaaggcagtggcagccagcagtgtcgctgagaaggccgtggaggcagctcgaatggccaaactgatagcccaggacctgcagcccatgctagaggccccaggtgaggcatggacagctggggggagggcagtgaggcccctagggagctagagaggctcaggtgtggggaaacagatgagaagccctgcaagggaagtggggatgggaaaaaacaaggaatgagggtgcaaggaacacagggtgggggccagacctggtagtctggggagtgggacttgggaatgtatgcagtaggataatggggggtttggggtctggcggtgagaggctatgagcctgggaattccaaagtcctgggaagtgcccagtcaggaataaagctgcagccactccagcccaaggccagttaggcccctctgattctcagctatccctacccaggccgcagacccaggcaggactcagaaggt

SEQ ID NO: 74708 - DNA, 1782 bp, Homo sapiens
tctatacccacgcctgcccttccctctgcagagctttctccctcccttcaggagccttatttcgctctctcagtctccatatctatttctttcccccttcttccctcctcccctgcttttctcctccttgccatccctcccgagccccagtatgggtctcccctccttcccctctctcaggctgcatctcccccctccttagtgctcacccctgcacctctttctttgtattcttctcaccctctcccagcctcgccagcatctctcctcccccgcccggcttcggcctccccctgcctccccatcttcagctcagtctcctccccctcgctcctcttccctcccctccgcctcgccccactcccagcccgcatgccaggatttctctcctccctgggggtctcagtgcatctccttctcctctctgcctgcctcctccctcaccgaagggttagcggacacccatccttttctgcttggggaccccaccaccacccgcaacactgccgctgtctcttcttcaccgtatccttctctacccaccctcttctctcttctcttctccctgcccctttaaatctgcctggcccagcctcccccgtgatgctgggatggagcaaacattgatttgtgctgggatggaatcggaattttgatttatttttcctctcccaaccataagaagaaaaaaataataaaaacaccccctcttgagagccccctccccctttgcatccagctcccagctcttcttccctatctccatccaaggcagattttttcccctacactattctcatcttcccccacccttgccactacctcgcccccccacccagcctgctcctccagctggggagagaggggactctccggactcccccacctttcctctctgggttggagcagtctctccggaaggggagggggcttggcttgtccgggcgaggtgggagtggaggtatcctgccatggatgctgtgccggggaggcagcctgagccccagcccacatggtgagtagcctgccccctcccttctgcctgtctgcccgtccccaccctggcctttcccctgcagagcctcccctgggccccatcccccgaaaaaccccccgaaaaaccccccgaaaaaccgtctgcctaccttggtccgatctccccgctacatattctaccccccacccccatccctttgccagagacgccgaagaaccggggcagaggggtcctgacagcagccagggaaacgggtgccctacgattctgcccagccccctctcaggacccccaaactgccatccacactcgacacttcggggttctaggttggagaattgggactcccgcttggggttggggccccaagtcctgggaggggcccgctccacaaagacagaaatgggggaagcccccattcccccaaagcttgggggctgctggaagatgctgccaaaggaggggggtggattggggggcggcgctgatgccccagagccaccgggccagggagcggcgggcaaagaggaggggcctctctcgccacttgcccccctccctctttctccgcagccactcaggatgagggtccggccctgcctgccctcgctggggcccccccgcccggccccggtctaactgcccccgccccgaggcctcgcccggctccaaggcccccagcaggctctccagtcccaggatgcgctgagccgccggggggctgaggccgcgccaactacatgcatgtcccccgggggcaagttcgactttgacgacgggggctg

SEQ ID NO: 74709 - DNA, 1037 bp, Homo sapiens
ccccgcagcccctgcccaggtgccatggccgcattgtaccgccctggcctgcggtgagtgacccccggcccggggcccacccgcaccttccgctgcgctcgccccctcggggctgccagtggcgctctcctgctctcagcctccgccaggtttcccatcctaggcggaggcgggcaggggcgactgctgtgggtccagcctcccgcgccgcgcgtctcttgggagggcagccggccggtgctcctcgtttccgcctgcacctccccttctctgcctcgctcgcctctgaccgcgcgatctctatctgccactctcagaacttcctctctctcctcgctcctctctgctgagccaggtctccgcatatcctcctttccttcccagatacctccctcggacctctaacgggctctcagccagcgccccagggtacttcgagaggcagcagggccctggggacaagggtacgtgagccccgggagactaagctcagagccccctaaagaaggtggaaggttaaatatccattcccggcctctcccggactggaaggactggaacctggcgggaagtccagagcagcccgagggacctgggcccaggggagggaggcaagcaaggtgggaggagggcgccaagttgccttcgtttcttacatagctggcttcttcctccgtccaggcctggagcccccaggctcgtcctgtttgtctgcctgtcctcttagtctcctatttattctctgaggcctctcttctcagcttttgtcccagagtcggaagtgacccacatctgtcgcacagcccgttccacttgggcagcccttgtgggtggtctctgaaggaaacgtcccacttagagggctgcaagagggtgtgggggcttcacaagagataacgtgagccaggctccagggagagagaggctgtcctcaagactgtgtgcttgaaaactgatgctcacggagaacttccctctgaggcaggaacagacccaggtcccagtagccctcctcccctgcccctggggccacactg

SEQ ID NO: 74710 - DNA, 1049 bp, Homo sapiens
tgattaaacagttaaacatgggcatgggctacacaggcagtaacatcagcatgcctacatgtatacttccacacagccaggcatgtgccttttttgctcatttggccatatctgtccctcgctgagcaggagacaccctcctcaagcctcataaaggctacaagatacatgtgtcctgaacacatcccacacaccaactgcaacctgctcttcatggtccctgcatgcagacatgttttagcaggctgcagcccaagctttctgtctctccaccacctgccttgtccactctcgatgacagcaactagctcattgcctctgtttctcctataggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactggtaagccttgggctccacaacctgcaggataggtgcactgaggccactttgggttcaccaaggcaaaatcaacttaactagaacatcccaatggaatgaacaagaatgagagctttggggtaaacagacccagaaactgggatttgcttacgcctataatcccagcactttgagaggccaaggcgggtggatcaccaggtgtcgggagtttgggaccagcctgaccaacatggagaaaccccgtctctactgaaaaaaaaaaaaaaaaatacaaaaattagcccagcatggcagcgcatgcctgtaatcccagctacttgggagggtgaggcaggagaatcacttaaacccaagaggcggaggttgcagtgagccaagatcgcgtcattgcactccagcctgggcaataagagcgaaactctgtctcaaaaaaaaaaaagaaagaaactgggatttttttttttttttga

SEQ ID NO: 74711 - DNA, 2509 bp, Homo sapiens
cctccggagtagctgggattacaagcatgcgccaccacacccagctgatttttgtatttttagtagagacagggtttcaccatgttggccaggttggtctcaaactcctaacctcaagtgatccacccacctcagcctcccaaagtgctgggattacaggcatgagccactgcgcccagcctagtttgtagtttgtattttattttaatgttaaatgaagaagctgatataaataagatcctttgctttttttttttttcctcaccagttcagggagcttttgccaggggcagagacccccagagggctgggaccttggggaacaccccttagatgggacaaagcctggaggaagggactgagatgtgattgggtggggaaacataaggccaacagaagacctggagtcaaagttggacttgaaaaagtgggtctagggacaagggaaacctgctggccaccatcttcctgacaatcccctctcccccagctggctggcccgcacagaccccaaggatgtggcacgagtagagagcaagacggtgattgtaactccttctcagcgggacacggtacaactcccgcctggtggggcccgtgggcagctgggcaactggatgtccccagctgatttccagcgagctgtggatgagaggtttccaggctgcatgcagggtaaccagggcaggggcacagtggcaagggcacggaagatgtgaacaggtttggaacccttcatccaggggatgccttcctccacaggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggtaagcacctgctctgccccaaggggaacacagaggccttcttgtactcagaggaaatcccaaatcctacctctccacagaccctaagaacctgtcctctctggcaacctaattcccaagatccagagcagcagtcccagcagagggataaggctgtgtttgcagagcactttgcactaggttgagaaaaatccgtgtccaagaataggggcatggaagctgatggttattatgaggtggggggcttcagccacctcttggtgctgctactgctcccaagtgtctctcctgccaatccctgatccctctggccccgacaccccagttcctgatgctgctgccagcagccccatgaccccattgtccccaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctggtgagggcctggtgagaagcagggcagctgccggggacagggcaggggtggggcctggccagtctgcctcagcctcacctccctcctgccaggtgccaggctggtgggcggggactctacttgaaggcccaaagctttggcctcaggctgctgaatgttgaggtttcccctgccactaacccaggcctgatggcagggcaatcacttatatagttaataaacattggtcctccctattagaccctagctgcccttccccatgcagaccatgccctgacttttggtgacctctttcttattccctctctccccaatgcacagatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtgagggactctcagatcatactcttggttctggctcttgtcagagcctcggggtctcctctctagtgttcacaatgactttgtcagtgagaaagtttcctgaacacccaaccctgctccattcctctggcagcccagccacccgagagacagcctttcctcatcagatcttgggtccatctcaggacaggggtgggtggagcaggaccttctttggtcttacatctcaagttttccttgtttggtccttcctttctttcacttctcctaacaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtatgtgc

SEQ ID NO: 74712 - DNA, 1264 bp, Homo sapiens
atgcgctctgagtccactgctgcagcagaacacaaaggtgagcaccctcaccattcctccctctcctgtgtgtgcacacagcacgtcctctctcccttcctgagccagaccttccttttgtccacccctggagtctgatatggccccacctcttcccacttctatcttttccccatccctgaagatattcagaaccataagcctttcacagcttcctccaactggatgcagggtgcccttccctaccccagtgagaaggaagattccttacccatcttgcttcccccccagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacacaagatttgtgctgttttcatttcccacctatcttcacaggcttccctctaacacctgtctcacaatcatcttcttccagcccctagaagaagcacagcctggcacaatcaaagatctgttttacaggtagctctagcactgggtcacagacataggaattgctgggagaaggcactatccactctatgtcctgagttcttaaaaaaaaaaaaatggtgaggctgggtgtggtggttcacgcctgtaatcccagcactttgggaggctgaggcgcacagatcacgaggtcaggggattgagaccatccgggctaacacggtgaaaccctatcgctactaaaaatacaaaaaaaaa

SEQ ID NO: 74713 - DNA, 1033 bp, Homo sapiens
ttatcccttccctttcagggccaatgatggctgcctgtatgtctttgaccgagaacagaaccggcgcacccttcaggtatggctcctgagatagagcctctgcctcctggtttttggctttttataagacctagaaagaggtcttatatcctggcctccttttcgcctagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaaggtgggccagaagtcaggactgtacagccaggccgctaaggttctagttgcccaggagggcatgaaagcggactggtgtgggaatttgacaagctccttattaaccaaggtttgtaagagttggagtttagggaaggggctcaagccagggaacatgaattccatctgtactcaccagtcctcaaggagcagggcagggctttccgtacaagaaaaatggaagaccggtcaggtacagcggctcacacctgtaatcctagcactttgggaggctgaggtgggaggatcacttgagctcaggcgttccagaccagcctgtgaaacctagcgagacctcatctctatttatttaaaaaaaaaaacaaaaaaaaaaaactaaggccagatgccgtggctcatgcctgtaatcccagcactttgggaggccgaggcgggcagatcacgaggtcaggagatcgagaccatcctggctaacatggtgaaaccccgtctctactaaacatacaaaaaaattagctgggtgtggtggcagtcgcctgtagtcccatctactcaagaggctgaggcaggagaatggcgtgaacccgggaggcggagcttgcagtgagccgagatcaccccactacactccagcctgggtgacagagcaagactccatctcaaaaaaaaattagttaa

SEQ ID NO: 74714 - DNA, 1078 bp, Homo sapiens
agcttcacgccaggctgccacacagcaaaactgggactatcggtggcagcaagtgcccaaaaaaggtgagactggaagtacaggcacagtggatttgtctgtagcctgggagccctggaggacctccccctcagccctctttgccaggcattaactctttatttgctaaatcatggatggaatggccagaggttcctaggattggggcctgggtgggggtcactcagaatcaaccaatataaaagtatgtgagtgtaatgattaaccggcagggccatattggagactgtccactgactattaggtggagaaagagccaccacttgaagattggaaaggcatttgtctctgggcatcgaaccttgctcaggactggtggtacgaaacaatcccaaagcagatttcctaacctagggtttactctgcatccctacccagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttggtaaggattgtgtcagaacagggggcctcaggaagggcaggaatgactccttgccattccacctataacgactagtgaccaccttaaaaagcccagtgacagctacaggtaaaatcaaacttagcttggaggcttaaacagagaaatagaaaccattctatttttcagtgttttaaattaagaaaaggaacatagaattctagacagtaaatataatagattgccaaaaatatagttggttctgtttttcagccagtcaagaaagaggttgcagatgaaaggtaggagggaacagagacaaaatgacacaggaagatggtagcaagtagttaagggacatgcagtcgctaaagcagaaaagcatagaaagaaataagctggctgcagtggctcatgcctgtaaccccagggctttgggaggccaatgagggcagatcacttgagcccaggagtttgagaccagccagggcaacatggagaaaccttg

SEQ ID NO: 74715 - DNA, 1031 bp, Homo sapiens
aaccaagggcaagaaaacctgcagtcgcgaaggcaacacggcccattagtaagtgacagagccgatctagagtacagagccactcaacccataataggcgcaaggcggtctgctttgcccgcagcgctccggaacacccggctacgggatagcgatccatccttggggctcggcggagcgagtggtagtgggcaacacaggtaacaggcaaagccaaccaccaaccgagagcggaagtcggggaacctagccaataagagtgcgggcaattttctgtgcttcacaatggtgggttctttccagtccgctggagacaaaggcggggcaacgttggggcgcggccgctgattggacaaattgaaagcctttagccctatcaaggagcaccacgtgggcgggactccaggagccagttctgcagggagctgcagtttggtctgtctcccaggcaggcgcagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctggagggagcttcacggacgcgagctaggcaccggctcgcctaatccggtactaatccggcttgctgcttcccgtccaggcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtgcctccgttggatgcccatcccccaccgcgaacccacccaacaccccagcccaagttcatccccggtcccttggcagcagtgcgcatc

SEQ ID NO: 74716 - DNA, 1025 bp, Homo sapiens
aactcctagcctcaagtgatgcgcccgccttggcttcccaaagtactgggattacaggtgtgagccagcgtgcccggcccccagtggtgacttcttatatagttatagtacaatatcaagaccaagaaataagacattgctccaatgttagctatactacaggtcttgttcatttttctcatggatatgccgctgtgtgtatgtgtggttctatgcagttctgtcccacgtatggatgcatataaccaccaccataatcaagatacagattgtttcatcaccacaaaggaactctctcatgtacctctttagttatacccttctgcccccacttctagtcacctggcaaccatgaagctgttctccacctctatagttttgtcatttcaagcatgttatttgtatatttaatggaatatgaatgtttttataggcacttttgcctttaccttaggtgtcaccattgtctattttcctccacccgactgtcttcagatgtttacgttgcctgcctggcccctgctggcacttgaggttgttaaccctgcccagttgttaattagaccctgatttcttagtggacacctggccactgcctcttccctagcctggcagctgtggcttctgaccccctcccctccaacccctcaccctccagatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccaggtactgcagcccctctaggactcaggtaccctgagctttgaacagggaccctcccacccaccacctctgcatcctgtccccagcttcgcgagagcctagagccagatgcctatgcgttgttccataagaagctgaccgagggtgtgctgatgcgggaccccaagttcttgtggtgtgcccaggtaagtggcct

SEQ ID NO: 74717 - DNA, 1053 bp, Homo sapiens
tgggtcaccattgggcgcctcttcagcttcctgtaccagagcagccctgaccaggtaaccttgctgctggcagccctcagaggggaacgtgccgctccactcagtgataggcactgtctgctgatgaggctcgggagctccaggctgtcagttgcacctgatgcaaggtgacagtttcagctgttcttttggtactccctgcaccatttcttatttgtctgcaaggattggcagccagtcctgtgatgggacaggagggacttcctttctccacgtagcatttttcctgaggaagctccatttctaccctttggtctgagccagaagttgcagttttcctaggctggtttcctaaaccggggccctttcaaactgtgctctgtggagcccagggtacctctgggccaccacaccatacatttcaatcagatcagctctgctctctgaagagattttgcctgtaccaagtagctaggtttggagtcatgtcagagtgtttgtgtcacccttgtcttatacctttagagactgttgtgtaggtgaagctcctgagtgtctgggtttctttaggtcttgaggctatgactttaatcatcttgtcccacatcccccattccctccaaaaaaaatcattagcaccaagtttcattggttcttctcatgttcatagttgtcttggatgcctgtgaatcagtaccaggtgcaaccacccccctgataagagattctgccactccttggtcctgaccaccctcctagacctggggtctggggctgctgccctgagtcagccactctttcctcacaggttatagatgtggctcccgagcttctgcgtatctgcagcctcattctggctgacaacaagatcccaccaggtgagggtaggagtcataggcaggggcttgcgggaggctgggagtggcagggctcagagagcctggggcagcgaggctttaggagccccgacctttctccctccctctccacccagacaccaaggccgcactgttgctgctcctgacgttcctggccaaacagcacaccgacagc

SEQ ID NO: 74718 - DNA, 1047 bp, Homo sapiens
ggatacaaccctgatcccactaagccagtgggagttcagggaaggagagcagtgtggactggggtgtgcttggagtgataggtaggagcagaagagccaggggaagaagctgggtcatggaaacacccagcttgagaggggccagccctatcaaccaagggcagccccagggacccctgcagctggtggcagagcgtgggagggaggtgtacagtcactgagctggccctggtgctccagcccctgacctggctccacaggctgaatacgacgccatgttgctggagcacgctggagaggccatccctgccctggcagccgcggctgggggagactcctttgccccattctttgccggtttcctgccattattggtgtgcaagacagtgagtgtccatcttctggcttcaagccctagtcccctcgtgcacccggtgcccaccacagcctttatccttggcccaggctgatctgtactccttcctgttctcccccatcagaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggagtatccttggctcgcaggacgggagggactggaggttgggggagtgtccccagggcttgcaggtgggcaaggtctacctgagcgtgtggccattccttgactgtggaccagacacttccccaagctgctggggctcctttttcccctcctggcgcgggagcgacatgatcgtgtccgtgacaacatctgtggggcacttgcccgcctgttgatggccagtcccaccaggaaaccagagccccaggtgagggagggagacatcaggcagggcttggaagctgaggagggagggtggtggagggcagggcaggttggcctgagacatttgtgtgcccagg

SEQ ID NO: 74719 - DNA, 1059 bp, Homo sapiens
cattatcaaaagtgtcctggcttggaagataaatgacatggcttaccagctatagggaccaggggctgctgcccaccctctggtgacaggaaaagccttggtttttccagggaaaatgaagagaacaggtcagcctagggctctcaggtgtagcttctcagcctatgtcctcttgtttgccccatccagactgctgcccccactgctgcagattgtgtgcaagggcctggaggacccctcgcaagttgtacgcaatgctgcgctgtttgccctgggccagttctcagaaaacctacaggtgaaccaggctgaatgtgggagccaccacttgaatgtccccttcccctcatctttcatctcttcaagcatccctgctgccatcagcactcttgtgtgtgcccggcaggtgaacctgactcaggccctgcttgctccctcccccagccccatatcagcagctattcaagggaggtaatgccactgctcctcgcctacttgaagtcggtgcctcttggacacacacaccacctagccaaggcctgctatgccctggagaattttgtggagaacctaggtagtgatggcagtggggagcttggggaagggggatgaggcggcggctttggctgaatgtacaggatgtgcatctccctgcattgctgcctgtggtaggggaaagggtgtgatggtgccaaaaaaaggtttccgcctggagggaggtgggcgtgcaggtagcagacctgggttggttggtagaggagcatcctttcccacagggcccaaggtgcagccctaccttccggagcttatggaatgcatgctgcagcttctgaggaaccccagcagtccccgggccaaggagctggctgtgagcgccctgggagccattggtgaggagagaggcaggaggcagggatgtggggttcacccaaaggccctgtggctggtggtccctgccctctccagctctgattctgtccttccatcctgcagctacggctgcccaggcctcgctgctgccctacttccctgccatcatggagcacctgcgggaattcc

SEQ ID NO: 74720 - DNA, 1802 bp, Homo sapiens
cacaatgacccagcaacatgggagagggtgggggctggatttcagcccagccactgtgctgatggtgcacagccctttaatgctgtgtatcatctcttttcttcacagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaaggctcatgcagttggaggttttggtctggatataggaactcgagccctgctgttaagggcacggtcctttataaagccgagctggccactgaatgcccgaagctcgagttctccaacccagcttgggaactcccggcgtggggaacctacattgccagagtcgggtttccgcgattcagccggtgctcagcctaacggaagtggaggagccggacctctttgtgggaagcgaattgaatcaccttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggtacggagcaggcgtaaccgggccagggcgagcgggaggttgcgggaaaggcccaactctcacccctagcttccccccaggccacggaacagctccagatcgttcttcgggcccccgccgctttgccggctctctgcgacctgctagcctcggcggccgacccccaggtgagacccctgactctcccctccgagcttcccactgtacgccaccggtcaagccccagtattcgcccactgcggtccgctcagcaccttcctgcccggacccccacgtgcttgcttcctcgtcctagatccgccagtttgcggccgtgctgacccgcagacgactgaacacccgctggcgacggctggcggcggagcaacgggagaggtgggctgggcctggggtggggcggggccaggcggagacttttcttgggcaggctgggtaccaaacacctgccacctgtgttccagcctcaagtccctgatcctgacggccctgcagagagaaacagagtaagtacctacccacttctctcgggatcttgacgactttgtctaggtttctgccttccttttcggctccaggctgggacttgtggggcagggacttcagt

SEQ ID NO: 74721 - DNA, 1050 bp, Homo sapiens
tcggcctcccaaagtgttgggattacaggcatgagcctccgcacccgaccaatcccagcactttgggaggccgaggcaggcagatcatgaggtcaggaatttgagactagcctggccaacatggtgaaaccctgtctctactaaaaatacaaaaattagctgggtgtggtggtgggcgcctgtaatcccagctactcgggaggctgaggcaggagaattgcttgaacccaggaggcagaagttgcagtaagccgagatcgcaccactgcactccagcctgggtgacagagcaagactccatctcgaaaaaaaagaattatccaccccaaaatatcagtagtgctgaaggtgagaaactttgctgtaactctgcgcctggggagatcttgtgtgaccaactcctgacttgctctttataggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggtgaggtga

SEQ ID NO: 74722 - DNA, 1112 bp, Homo sapiens
ctcctgcctcagcctcccaagtagctgggactacaagtgcccaccaccatacccggctaacttttgtattttagtagagacggggtttcgccatgtttgccaggctggtcttgaacgcctgacctgaggtgatccacccacctcagcctcccaaagtgctgggattacaggcatgagccaccgcgcctggcctcattttgtttttgttttgagacattcttactctgtcacccaggctggagtgcagtggtatgatctcggctcactgcaacctccacctcccaggctcaagggatcctcccaactcagcctcccaagtagctgggactacaggtacatgccaccacacctggctgattttctgtatttttagtagaggtggggtttcaccatgttgcccaggctggtcttgaactcctgagctcaagtgatccacctgccttggcctcccgaagtgctgggattacaggcgtgagccaccatgcccagccgaatgattcattttcaactgctgtctctgtgtagctgacttcttccatatttttctataagattttacaattaaattcttcctgatttaaatcttgttaccttgtctctatggttctaaaattaaatgcatcatcttctgtcataagccatatcccaatacccatctcgtgtattaatcccatcaatcattcaggtgtctggaatacaattctttagagtcatttaaaattacgtggtccttttataagatctaatttttcacttaaaagctctttctgtttgatttttgtttccatctccattaccctcattctggtctcgggtcttactcatttatatgtttatgtctctgtaatacatccaaccaggttttcctaccgtcatatcccctctaaagtgtagtctaaaccaagacatgacgtacaaaaccataatgtgcaggtcttcctttagcttctttttcattatattactccctaaccccagatccttcattgatttcctcattgcagattactttggcaactgtctttactgtgtgaatcagttttctcattcatgttttttaacatacagtaaaatgcacagttcttaagggtttagttcagtgagtttttgac

SEQ ID NO: 74723 - DNA, 1112 bp, Homo sapiens; identical to SEQ ID NO: 74722

SEQ ID NO: 74724 - DNA, 1112 bp, Homo sapiens; identical to SEQ ID NO: 74722

SEQ ID NO: 74725 - DNA, 1112 bp, Homo sapiens; identical to SEQ ID NO: 74722

SEQ ID NO: 74726 - DNA, 1436 bp, Homo sapiens
agcactcttgcctgcaagggccacttctacttccgggtcactgtctggctccacccccccccccccccccactgggttccggaaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgaggttagttgctaagcaaggtggtctttggtcaactgccgcctggaccaaggcaacaggaagtgagtacctctattccggaaactagttatgaaccctccccgccccccgtcgccaacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtgagcaagcttctctacttgctgtttcttgaccccacgctcccggtgggccacaaccaagaaagatgcctgtccttgtcctaatatggtacgttttttggattaatgaaatggtcaatttcctgttcatatctgcaggtggatctcacaagatccttttcatttcggaactcaaagcagacatactctggggttcccatcattgctgccaatatggatactgtgggcacctttgagatggccaaggttctctgtaaggtagggctttcctcatgccccatccctattggtgtccagttagcccagctgactgcagaggtgtttgcatccccacccccatgcccagtcagttctctggcagttagcagtcaggatgctctgatttacggttttttccactactgaagccctttatctgataagttcaaaaggcca

SEQ ID NO: 74727 - DNA, 1478 bp, Homo sapiens
tggggtggctgtttcaaggattgtggtcttcatacctctgtccctgcccacagcttcaggatgtgctgagttggatgcagcctggagtctctatcacctcttctcttgcctggagacaatatggtgtggacatggggtggctgcttccaggtactaggaatttggaggtgtagtgtttagcctgagaccttttgaggcagtccactggaatagttccatgggctccgggcataagaaaccagttattctgttactatctgttctctttataaggggcctcattttctttttcagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacact

SEQ ID NO: 74728 - DNA, 1087 bp, Homo sapiens
tttttaagggcgggcgccctcttctgttttataaaaggaacagtcgaattcctactggaagcgacgcgcgcagaggggaaggctttgtagacgccggctcgggtctggaatttaaagaactaaatttcgatgggtgaagacagtgggaaagggcggtggcatgatcctcgttttacagactaggaagtcgagcctcacgggagtgacggggcttctccgcaggctccgcgaagaaagcaaggctgggaggacccagacgaacggccacaacagcctcagcggccacgacagcctcagccgccaactcatgtcagccggcagagagtgcaggaagcgggcagctacagctccgctggggcgtggccttctgacgcaccgtcacggttccctctgtggccgcccattggctccctcttaccgcccttttccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtattggagcaagtaggacctggaaggggaaagaaagaaaggggcgggatgcgagcacctgacaagggcccacagcttggggatgagactagttggaaaaggtcagcttgccccgaagtggggattctgaattcagtaccgt

SEQ ID NO: 74729 - DNA, 1014 bp, Homo sapiens
aagtgggtaactgcccttttccatcagaaccgaggcatgctgtggaaggaaggacaggctgaccgtggcatcactgagcacacgcctgtgtgtatggtttaaatggctctgaagaagagtccaggaggagttttaaacatgtttcaagcccaggcaatacgattgaacaagtacacaattggacaatgctcgtttcgacgtctaagttctggtgtccttgttggggagttggtttcatgacccacactcagttccaggaacatcccagctttagcagatggcttgtactcagcttcagctcacaaaagaggtgtggtaaagtcccccacctcacaatgagaccaggggagggagagatcttgacatttccacctagaaaacagtttctcttgaaaataatccgttactgcaatgtaaaggttactttctgaaatattatagttcaattatggtatagagtaaatagacttctgagggctggtctgagcttgaacaaccttgaatcttgtatctatgaaaagttagcaaaaattaagagtgcaaatttgtaagcagtcaggacatagcctagccattaagttatagacttaatttatagacttcctatcatactacgttctattatatatccctgcctccctccttcagagagctcagaaacaccttcaagataatcagatcccactcctccttttactttcacttccattttatgacccagaaagtgaggaacagagaagttaaatagcttctcataagcctcacagctaacaagtggtagaaaagggagtagagtggtccagggaaacccctcagaaccaggttccaagccaaatgctttgccctgaaaaaaactcatccttggagttagggatgttggctcattctcttagaggacaatagttaatgcacaggttctatgtctggaaagggtccccagcggcaggcttgggttgaatagggcaccagaggtaaggtttaggcaaaggcaggaaggacaaattcccacaggca

SEQ ID NO: 74730 - DNA, 1013 bp, Homo sapiens
ctcaatgtctcaggccacgtcaaggagagcgggcaggtgctggccaagcagcacaccttccgtctgcgcaccccagacctctccctcacggtgaatgcagtttgctggggcatgaggggtggtcagagagtgaaggccaggggataaggacatcagaggtgggcgctaagccagcagcaggctggcctgatgagcctttgtaggagaaggtcaaggaccggctctggggcctcagtttcctcatctgtagcatgggatcttatgtctctggttctgtgacagcctttattgaggaataggttggagtttcttctctgacttctggggaatcttctctcaggaggataaatgtgggactcggggaggttttgcttctaagcagcttcccctctctggtgcagtgtacggtccccgtgtgtttggccagggtctctgacgtgggggatgggcctctttttctctcagttactgggagcagcagtggttggccaggagtgtgaagtacagattgtcttcaagaacccccttcccgtcaccctcaccaatgtcgtcttccggctcgaaggctctgggttacagaggcccaagatcctcaacgttgggtgagtctggcctctccccctacccctgcttccactctggccttccccacaggctgccctggctcccagctttgctccctctctgtctggacaagtatgttctgtcaggacccaaccaagcaggttggggccagctagcaatacctcccggcccagctcagtcccaccagcctttagggagacctcttgggcacctggtgctatgccatgtccttgccctgcctcactatctaattagggagcagaaggcccacataggaatcattagtaactcattgctaatatttgcccagcactgaagaattgaccaggccctttcaggaatattatctcctttggacacaaaaactctaatttaagtacattagaaggccaggtgtggtggctcacacctgtaatcccagcactttg

SEQ ID NO: 74731 - DNA, 1169 bp, Homo sapiens
aaccttgcccacctcatcctttaatttcccaggaacccctaccacctccaccagggatgccctgggctctggaagctgcagccccaggaagcaggcagggttggccttcaggatcaggactgccctttcatacggggcaggtggatctgcccctccagcccaggcactgtgatagtcaggcaggcagaaggtgacaggagccctcgtctctcctccccacctcagagttcagtgtcaggggaacaggtttgggatgttggactgcggcactgccctaacatgtgggcaagcattgggtggagacagagctgctctaagggagactgtcagagaataaggtgatggcccaacgtagggacatacacagtggctcatacacattgtgggtggggccgggagaagtcccaggctccatcccctctcctcagggaggccttgccagctaattgctgatttcctactctaggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccaggtgagcagctggggtctggagcagagggtagatgggagggaaagacagggaagggcttcctgccctcggatgtggcggggtgcctaggtgcctgaccccaggagaagccagcctcccattgggcagatgagaggaccgaggcctggtgcagaaaggtggccagcccagggtcacacagccagccacacctctcctggcaaaggcccctggctacagccaatctcctccaccatctgtcatgctccccgtgtcctcccacagcagtcctgtcaggctaggggcatccccgcattttcttctgtggacatgagtcctgcagaactggccagaagtaggtgaggcccagggagagaactggagggaaccagttttgtgtgttctggggacacagaggacattgtgtacgtggaccatgaggattggcggcaggagtatgttcttaatgagtctggga

SEQ ID NO: 74732 - DNA, 1807 bp, Homo sapiens
gccgtgcctggatccagcaaggtggggtgtgggccagctgtgtacctgtcagccccagctaggctgttcccaacaccaagactctgctttccctgtgcacaggctccgggcacctgccatgccctacccctcctggcagccccaagtggggtcttccctgacttgggaatgccaaggaccacaggccccggggtcacttgtctgtcttgtgaggaaccttgagttgggggatttctgctaagaaatgagttctagaagctgtcagtgttgtgcacctctagactgcagagctagcaggtggacggaccaggcccagggatgctggagcactctgatgtgtgtgcagctgggtcttgaggctgggacaagtgtccatgcagggaactatgtggatttcctgggatggatcgttgagtgggtttcttcattgggcagtttttcggatgttgtttggtgggggtgaggggaaggcttttctctgcagcatgagaagcttctctgggtgagtctgaatggtcttcgcggaaggtctctggatgtgtctggagaatctctgggccaaggtgggattgtttcggtcatcgggtgggactgaatcagctgtctggatggagggtttctgggtcaactggctgggactacctgggttaaggagccaccctgcctcttcctaacaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgaggtgaggccggtctgtcctcctcagctgagagctaaaaggctttaatgggaccagagactcagcctggcatttctgggggggataggaagctaatgataagggcctgggctcctcatggggcttcactgacacggagctgtgtccttgcagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggtcagtggggcttggattgggacgggtgaaggccctatgtttggtggggagaggctggcattagggtcagagaggtctttaggctcctccctgccccactcctcacctctgccagataaggcaggtgcaagtgtgtgggtgtgcccctggggttgtgtctcagagagggtcttggtgttgcagtttttcccaagcccatcctcctcaagcctcctggggcatcggtctcagagtactcctcttcagggcctgcctcggtgcctccttcggcattgctgctctgtcctttgtgcatctgttctcattccccaggatgtggctggttctctcttctatctctctctctccctcttgccttccatgtcccccatctctgccaattctgtctctctctgtctctgtccctctgtccccatgacccaaggcaggtgcctcccttaccgcgttgcttggtgtagcttgacttctca

SEQ ID NO: 74733 - DNA, 1019 bp, Homo sapiens
ggcatgtgcctaataaatgctggccgaggaccctctcccaggtctcctgggaagcccatcacctccttcctcccttcaccccccaggatctgacagtgctctgccatctggaacagctgctcttggtcacccatcttgacttgtcacacaatcgcctccgaaccctgccacctgcactggctgccctgcgctgccttgaggtaaagtacccatgtctccgtccctgtcacgggtggttcttttcctcttcctctccctcagaagtctgcccatcctacaaggagatgtgcaggaccctccaccccgaacaggtaactgcgtgccttccacctccatcacgcagcctgaccctgtgagcccctctgtgctctgtggacccgtcaccctgagctcctcagttgctgaaccatccctggctgacagcgcctgtcctgcctccctgccctccctgcccccaggtgctgcaggccagtgataatgccatagagtccctggacggcgtcaccaacctaccccggctgcaggagctgctactgtgcaacaaccgtatccttccttctgggtgcctttcagacagtgggtaaagtgaggtgccaccctgggaagggacagacagcaggcagggtatgtgccaccctcttgcagggcaggagagagggggctctgtagtgtgagttgaagggggagagcctggggctgtcgggctatcactgacctgcactggtggagttgtgcggagtggacttcctcaagtcagagttcacaaatgggcagcccgcagctgttcttcaggtctatgtagttttttgaaaatcaggaactttcatactttaaaaaacatctagagttctaattcctctcttaaaaattggaagttagagcaaccttacactggtattttcactcagcagcccttggtcattgctgaatagtaaatgtctctttggaccaggctagatttccaccttatcataccctgcaccactcccctgatactacaccagcttgcgtggggtgtt

SEQ ID NO: 74734 - DNA, 1025 bp, Homo sapiens
gagagccctgaccccccccttcccttctgggtacaggtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactgtacgtggctgcagattctgtccccacagccctcacctgcccacattctggtactggggcctcagtaaggcccagaatggggagggatatccaggatgggtccactgagctggtgctgaaagggatgttggagccaaatgcatcctccgtggagtgcactgaggtgtttctaggggttcctgaggggactctaggggtcccagccaggtagctcctcttgccctgcctctaagatatgctgtcacctctcccctccagttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaaggtaaccagggtcagggatgctcaggaggactctgcagtgccacccttccagcccccatgcctgaccctgttcctgaacctgtcactcaggtttattgagcacctacttcatgcgtggctccaggggtgcttaagaatcagtccctggctgaaggaagcttaagtgtctgatggggaagataaaactgacatacgtagcccctgtgcaaggacagcatataagtgagactgggggctggaagtactccaaggagagggtagggtgttggagtggccaggagctcaccagtgtcctgaccacagccccatgcctcctggaaccccacagagctggagctgg

SEQ ID NO: 74735 - DNA, 1006 bp, Homo sapiens
agggtccgcgctctccacacaaggtggggcgccggttcccagctggtggcaaacgggggcgcggggccaaggggtcggggcgccccttaccaggccgtaagcggcaaccctggccgcctccggatgggcgctcggagccggctccagattcgcacccgcacctgagcccggaagctctgggatatttccgccgggcgctgtcagcattgaaagaggctcccgagactggggaagaacgaggtaggcagcaacttcggggtttagaccaagagcatcaaatccagggcaggcaaggaaactttctagggtcggcagggcgtggggacttagtttcatttcccatgtcctcttcctcggcctccgacccacgacccttggttaagcgagggtacataactgtattctctactaagtctcttcaaagtgtgtctttcttcccttttcagatctgatggtgcacaatataatgaaggaagtagagactcaggccctagctttgtccacgaacaggactggcagtgagatgctgcaggaactgttgggattcagtcccttgaaaccgctttgtcgcgtgtgggctgctctgcgctctaacttgcgcactgtggcctgtcaccgatgcggggtccatgtattacaaagtgctttgctacagctccctcgattgctggggagtgctgcagaggaggaggaggaggaggaggaggatggaaaggatggtcccacggagaccctggaggagctggtcctgggactagccgctgaggtgtgtgatgattttcttgtctactgtggagacacacatggcagcttcgtggtcagaactctgcttcaggtgttaggagggactattctggagtctgagagagccaggccccgtggttcccaatcatctggtaagtattacaagaggaaagtggacctagggggaagaagaatttagaaagttcagaatgagacagtaaacagaagagtaagtcttcatgggggagcttgaccgggaaga

SEQ ID NO: 74736 - DNA, 1011 bp, Homo sapiens
cctgaccatcaccccaggctctactttagcgactgctcacacctccctgcttcccagacagaagtcaaaacagcaaaagaaacccagtccccagggtcatgctagggctaccaaaactgggatgaactagcacctgtgaactagaacagcagggagtatgcttagagtgcctggtcctgggtgtggggaagaaaggccatcaaggtagatgcgggtggggaacagcttgagagaggaggcaaggacaacccagtttctgtctgaaggggcctctggttgaccctggagtttctgtccccaaacacaggcctcacgggattctttctgtcctcatgcactgggcagaggttccttaacttcctttgttgcacattgccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttttttttttgagatggagtctcgctctgtcattcaggctggagtgcagtggtgcgatctcagctcactgcagcctccacttcctgggttcacatgattctcctgcctcagcctcccaagtagctgagactacaggcacatgccactacacccagctatcttttgtatttttagtagagacggggtttcaccatgttggccaggctggtctcaaactgctaacatcaagtgatctgctcccctcagcctcccaaagtgctgggattaccggtatgaaccaccacaacctgccaggaatttttagtttttagcttttgcaggagacttcaaggaaaggagacattcctctgtcca

SEQ ID NO: 74737 - DNA, 1148 bp, Homo sapiens
gaggccccctggcaccttccagcctgatgtcgtgcgtcaagttatggtgagtagggagtggcatgtcgatcgcagcctccgacattcacacccagagagccccacagactcgctcagagaacgtctttgagtccggggacggtgggggccggcgagggaggctggggattgcagtgagaacgccgagtcacaggggcgcggggagcagcgctgaggcacggcacggccggctagtgggcgacacccctctctcaggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgtgagtgaccccggttgaccccagccgcaatctggccaaaaaggtggagccactgtgctctggggcctgaatggcgaagggagggattttcccacgaccccggtgcgactccagctctctcctggagtgtaggaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaaggtcagctggtctacacccctctcagcctcaagacaaggccccagagctgctccagccaggcccgccggacactagacctccagagccctgtctattgaataggcgtagcctctctctctggacacagggctgccaggggacaaagcccagccaggagttttagctcctgcctaccaggtgatagaggccctgagccacacgagtcatttccaccagctgccccaccagcccctccaaagagtcatggctgacccagccctggagactcagaccttgacctagccctaccacaaggcacctagatctacca

SEQ ID NO: 74738 - DNA, 1034 bp, Homo sapiens
cctcctggtcctcccagcctcaccgacctggcgggctggctctcccaggtgccaggtgagggggctggtcgcggcggtggcgaatgcatgccaggccgagggggtggaggtcggggaataccgataggtgcagcgccatagggagggggctctcccaaggccagacggcagcatggcggggcatcctctgagtccagttctgtcaaaatgggaagaggagcagagggagagggggaaagagagaagcaggtgagatggctatgttccttgagtggccaggccgcaagtccttctatgctccctgcccctcagcaaagagaccttctgagccacaagacaaaagcagagttggacctgggaagatggaggagattgaagcaggcatgccaggcctttgcccactggcccctggatcctaggaccgagggtacccgatccagtgggtcttaaggtgagagaggtgggtccagaggggctggagctggggctgggcctggaggcgtgtttcttgaggcactgggctggactgggggcgactcacacatgaacccaattagcagcggttcccaaacccccaaacggcgctggcaggagccccagttgccatcgcaaccgtggccagaggggaggggggcgtcagggctgtggtgacgaggggaggtggctcctccctctctcctcgccatctaggggcggaggtgcagccgagggggtgatgcgtgctgggcccagccgggggaaggggggcagcgggcagcgcggattcgtgcgagcggcggccgccgcccccggctcggtccccgccatctgcctctcattgcggccagacgggggagggggaggggcgccccagcgaggcctgacagcgcccccagccccgggcgtccagtcggccgggccagagctcggtccgccaggggccagctccagcgccaaacctccccttcccctggcggcgcctggtgctgttggggccgtagttcccgcccgccccccagttcagtgacaggcggcccagccgggaggcggcgcac

SEQ ID NO: 74739 - DNA, 1099 bp, Homo sapiens
ggagttttaggcttgttgtcatctttcacacctcaaggggctctgtcccctacttccccttgcttctggacttttggatttcttcatttctttgtcctttttttagtttaaaaaaaattcttttttcccttcttttcacaagtgttaatgtacttctttatttcttctgtgctttcctttctctcagacccataccccctcctccctcacagatccagtacgggcctgactggggtctgaggctgcacatgatcaatgctcttctctcccacccaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaaggtaaaggacagacagcaggcctgatatcctctctcctctcccagataggttccagctatgcagacacatggcactgccctttcccacactccctctcagctctgaccctgcaggcagcctgggggaggggctggagttgggggaggaggggtgcaaggacccggatatactttctactcctgtccttccacccccactcagctcatcccatgggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtg

SEQ ID NO: 74740 - DNA, 1049 bp, Homo sapiens
ccagtgcctgctctgtgagaggaggcgaggaactggtactgactggctccaacttcctgccagactccaaggtggtgttcattgagaggggtcctggtgagtacctgctggggaggggagggcaggcagggagagcttgggagtggcaggtgaaacatctctggcattgtcactaaactggccagtggagcctcagtttttttatttgtaaaatgggacagacagactaccctttctattatactgtctgctttccatgtgggatgggtatgacagcaatctaaaatgttgaggatgctgaacaaatggaagcaatgcacattctgtctaataaagaggagtctgctttgagataatttacccccatgtagatagggtatatgaggagaagggaagaggtgatttacaccctcacagctgcccgctgggcccctcttgagttatgggcagtgattaacagagcctgttaggtgccccaagatggagctacaggagtggaggaagggaagactgagggtttgagttgccagcaccaacctgaggcctttgccctctccaaacgctgctcaccaagagcctcagtccctatattcttttttttttggtagcaggatctcactttgtcacccaggggagtgcagtgatgctgcaatcacggctcactgcagcctcaacctcctgggctcaagcaatcctccaaaaatattctgtgtagagacaggttctccccatgttgcccaggctggtctcaaactcctggactcaagtgatccttccaccttggcctcccaaggtgggagtggtgggttctgggattacaggcatgagccactgcctctggcccctatatccaaatttagcatcctgggaccatgtcagagcttctccagaggttctaggtcatgatacttgggggtctcattgcgttctgtcgagctaggaccctttcctacctttggtcttccttctcagcattatcatgggaaaggatgtttggagctgggtgggagggctcaagggttgcttccgttactgactccctctggttt

SEQ ID NO: 74741 - DNA, 1015 bp, Homo sapiens
cccagagtttcaggtttctgcctggtgcgctctgggacagcccatggtgggggtatagggatatggggagctggagcaggagcagagggaagcagtactcatcatgaggggccaaggggtgaatggaacctgggaggagcaggcagctggaaggtgtgcagtggggagactaccagacctctcaccagcatgtcctcccacttcctgtcttcccagtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctt

SEQ ID NO: 74742 - DNA, 1049 bp, Homo sapiens
tctctttccaacttctgggcctccttgggccagggctggagtaagctgccccaacccatctctccaaagagctctggagcctgaagcactggtcattgagcagtttattaccatcaacctgtccccagctttccagcacaacagccagcccacactctagacacgccttcactccagtccattctggcacctagcctcagtcttcaccctcctccctcctccacacactccttcccccagccctccaaggcagcaccaggcctgagggccacacctcagctgggggaggggagggaagacagtgagacagacagaagctggggaaagaggagccagggttggccccaagcttctgtagccaccactccaggaaggagggaaagggggcagggctgaggctggggctggggttgccaggtgatgacagttcacgtggttcaggcaggaggctcttctccaggaggtgcagggaagccactcaggtctcggccaatgatctcactcactgtaaaggaggggcagttgagagactgggctagaggtgggtcccctccttttccaaagacccacccccaatccattccaggcaggtcttaatctaggaggcctctagattcctcctctactggcttctattccactgggcctcagtttccccaacacgtcttgacacctgctccgaatcaaatcttgcccaactccctccatgtgggctcccaggcacccgtcctagccctttcctgctggcttagcctgaaatgtcaggggaatcggtatcagcagggccagagatgggtgtagccaatgggaagaaggagaggcaaaacaggaaagctcctcctcaccaaccctgaccacagacaccgtgtttaggggaaagctgaggcaatggcaagtgtgcttgactgggacctcagcaagctaccatccctctctggaactcaacgcctaaacttgcaaattgaatgcgctggatggaatgatcttgaaagtgcttctagctctgagattttatgatttggagcagaggacagaggcagagacaggag

SEQ ID NO: 74743 - DNA, 1050 bp, Homo sapiens
tccaggacaaattggctggcactttgctgctgtttaataaatatctgacaatgcatgaatggcagtgtcctggcagaaaacagaatagtccaccttgagaggcaacaagtcctaacagctttttgtttacacagaggctgatccaccctctctcagagatcttagaggtggtgctgaagattgataaataggacacgaatgccctagggtcccttctgacatggtgattatggggcagtgactctggcagggggctgaaggggatctttgaaaagcaaccaaggcccggtgagctaatcacttgatatcagtttggttcacagcagcttgtgttccagaaaggtaaaggaaattcattgcaaagcagcaacaggcgaggagttactctggttctgttgtcccccaatccagagccagcctctgtcacacccacccctgctctcctgagtacttgctaggactgcctggactcattgggcatagagaggccccacaagcctgaaggtgaggcaagtttcccaagtgcaaatgcccggaatgtcttttaggcacgtccccctgcagccaagcctagccaaatcaagctatttgtactcagtacctacggtgtgtcaggctccaggtgaacaagacagacaaagtgacttttcccagcccagtggaacttggcctctcgtaggccatcaagacaggggacaaaccaggtttccaggccaggcccgtcagtggtgatggatgtaccagctatttagaaggccagcatgggcatatttgcaggataggccaggaactcatatagtgctgtaagccccagggcaggtgacattcagagctgctgggtagactgtttgctttctgcagtctacctctgaagcacaaatctttccagaatatcttcataatccccaggagtggaggatccagagggagggcttgtgccagctctccctcacctccaccctcactccagggagagaagccttagaggcctggacctcctgagtcagcgtgtctgaatgggggctggggacaggagcccaggagtgcagc

SEQ ID NO: 74744 - DNA, 1091 bp, Homo sapiens
gcccccgcctggatttggcagtgtggcaggcaggtagtgggccatcctcctgcctcgccagatcagcctgcgctccttccatgcccgcttcttccctctggttccttcctttcctgccccaccccttccctacgtgtcacctctgtccctcaagtgcactgagagcacctcctcggtgtgtgtcccccatgagacttccctggccagggccccagcatcagcagtcccacttttccatctggggagcaactcaaggcgctgtatttctgtggcctctgcaacacacctctttgttctccaccaagactgaaaggcccaggtccttctgtctccttttaagtctccttaaatcctgggctgccccttggagcctctgagtactaggactggaggggcctttagagatgcttctagagtgatactggcattttacagatgaggtactggtggccagagagggtaaggggcctggctgagtgctcagagtcaggtaggtgaggtggtgggggttggaccagaacccagggctctgggctccctgccccacactcttgatgccactcagcttcttgcaggggttcagagtggggtgcagccctcttcccagattcccagcccttggagatgggtgggagtctgggaggagggctatgggttttcagatgaaagggcttgctatgtggggctggaccttggacaggccagatcacagtgcgcctctcttgcaatctccctggcttctctcacaagcttttcctccccttgggcctgtcagattccactgtcccccaaggtttacctcttcccttagattcctttatcttacttcttctttgtaggaatgccacagcctccctctgccccagaccaccttccccttcaccacgcacacctactgcagatgggtttatacctatatcttaattggtcaaggccatgggtggggaggcccagaactcggccagccagcctggtaggcaggcaggctgggaagttcctccctcaacccctctgtggagctgctaggtcagcagtttttccaattttgacagaggtgctaggagggggaaggggtgtcttcccaaagaaca

SEQ ID NO: 74745 - DNA, 1011 bp, Homo sapiens
gagtgacagcaccctggccgacatcattgccaggctgcaggctgggcagaaactgtctggctcctcaccgtttagttctgcctttaactcactcagcctcgacaaggagagtggcctgcttatgttcaagggagataagaagcccagggtctgggtagtcccgacgcaactccggagggatctgattttctctgtgcatgacattcccttgggggcccaccagaggcccgaagagacctacaagaagttgcgtttgctggggtggtggcctgggatgcaggagcatgtgaaagattactgcaggagctgcttgttctgcatcccccgaaatctcataggcagcgagttgaaggttattgagtccccatggcccctcaggtcgaccgccccctggtcgaacctgcagatcgaggtggtgggcccggtcaccataagtgaggagggccataagcatgtacttattgtggctgacccaaacaccaggtgggtggaggcattccccctgaagccctacacacacacggctgtggcccaggtgctgcttcagcatgtgtttgcaaggtggggtgttcctgtgaggctggaggcagcccaggggccccagtttgcccggcacgtccttgtgagctgtgggctggccctgggagcccaggtggcctccctgagtcgggacctccagttcccctgcctgacgagctcaggggcctactgggaattcaagagggccctcaaggagttcatcttcctgcatgggaagaagtgggcggcctccctgcctttgctgcacctggccttcagggcctcctccactgatgccacaccgttcaaggtcctgaccgggggtgagtcaaggctcacggagcccctgtggtgggagatgagcagcgcaaacattgaagggctcaagatggacgtcttcctgctacagctggtgggggagctgctggagctccactggagggtggctgacaaggcgagtgaaaaggccgagaacaggcgtttcaagcggga

SEQ ID NO: 74746 - DNA, 1819 bp, Homo sapiens
acacacactcacgaaagaatctatcttggccatgaaactgtggctgttgaccttggaattggaaccacagtcctttcccatacagaaaccccaaatgtgggctcctccctccaacctgttcttttggggaccctttgcccttagagctgtcacagatgacataagcctgggcaggctgtggggaggccgctgcctcctagcctcacggtcagctttctcaagccaggtgtggcctgcacagctctcagggcagggctggccatcctcccaggcctcaagggcagtgtcttggagtgggaggatggccagccacaagccaccagcttgtcagcatgggaagggcaagggggaaatgggttggcctacctcatttgactccagccaatggagacaattcctgacccctgctttgatggtgttgaccccacaggaatcaaggatcttgatgccaagtgtggcatctctatctgaagagctgcttctgttagacccaggggccccggcctctgttttaagggggcagggcgtctgcaacaggagtggcacacggtgaagtgctggcatggctctacctcccaacccctcccaaccccatcccaaagcctacagtcctctgctccttctacctccactgtatcctgcatcccagaccctacagattgtgtgattgcttcatctgtatcaccccccgagtcctgtggacctgccttctgtgtagagcaaaacccaggctccctcacagccattctttgcagagatcacccttgcagtgagtgtgagttccttccaggtgtgtgcgcgtacactcaccctctgaattgctgccgctgccaaggaagtgggctccaggtgaaggccagtgccacgtcactctggctggccttcttagtagtttcatttctccggaagctgagccagtctcctggtctagcccaggttgccagaacgcttggcattgcagagtgctagagccagtggagaacttgccaacttgattgttttacagcagaggaaagaggatcacagagggaaaatgattcacccaaagtcacacagcaagttcatggctgagctgagaccaggattaagcttcctgactcccagttcaccatgaaaagggttctggcaacaggttcaagctggagaatccttcaaaatgctacacccacattctctccaactcttcatctccctgatcttccagacaaactacctggatgttgcccttaaaccatttctagctgttaaccctgtccagaaaaatgattgagtgatagctgagaagtggaaagtgtgggatttttggcaggtgctctctttcctccgccccccgcgccattctttctcttcctcctctctgtaatggtatgtccagcctcactctccctccctggtgctgtatgcgttccccctgttagctacatttgtgatcacatacccttcttttaagtgaatttttttcatttgatttgtcaataaacgaatcaaactggagctgatgtccagttctttgtttagcttcagtctcaattgtgggaatgaggagtgtggggcagtcatggggtatggctgctatatgtttcccagataaacttgcagatttgaagaaaagtaccttttccagaccatctgccccaagctcttactgtacagatgaagagaccagggcccagagggtgatatgcttaaggctccatagctgcttcatggcagggctggaaggagagtcccacctctgggcttccaagctggtacccttggcagttaatgtcttggaagtgggcagggttggaatgaaaacgagtgatgaggcagggca

SEQ ID NO: 74747 - DNA, 2065 bp, Homo sapiens
tgggttggatctctgtttctaaatctgttaaaaagaccaccacccatcacttcatgagtcctaccctgtcttgtggaatcagaattactgaatggagcccaggcattttttaaaaaagttcccttggtaattctgttccttagcaagtcttgggaagtgccttccagatagaggaaatagttggagaaatatggaagtcagcataagacatatgtggagagcagagtgtaatctgattattgattttagctggagttgagagtgggttagggaatattgggagagataaggctgtaagggtgatttgagctggcctgtagaaggccttagctgccaggcctgggtgtgtggactttatttggtaaataaagggcaagtgtggaagagttttgtgtaggtgataagcatgctttcttggggcagggcaggggagactggagggtgggtgagtggtcagaggcggggacccccttgttaggaggttatgcataatctcagttgcaatatctgaattactggggtggtaatggtgggcctgggaaggaagggagcagagcacaaggcttttcaaaggaaaggcatgttggatttgcaagggattggttgggcagggtggaagacagagctagatcttactgtttactaacgaggcacaaagtgttgggtgaaggactatggttggcagataggatgctactgggagaccaccttggattcatctttgtttcctctctaggccatggcacttgcatctagtcagttgcctgtagctgggtcaaggtgaggtagggggccagatctccatcaccagaagtggcctatgggagacagtaaaacttctggggttggggccttggagagtcccaaatggttgctgtggtttttacttttatttttgtagatttgggggataccaatacagttttgctacatagatatattgcatagtggtgaagtctaggcttttaatgtaaccatgatccaaacagtgaacattgtacccagtaggtaatttttcaaccctctctcggttgctgtggttttggagacaggttcatggtgaagctggctgaagagacagatgggataattgtctccaatgaccagttccgggacctggcggaggagtctgagaagtggatggcaatcatcagagaacggtgagggagccctcccgctgagaactgggcacagatgcagatgtttttctaaagccagctctgctctggccatggggtgaaaactctgggaaggaggtgaagttttcttgaaggatggagccagcagcttctggtgatactggtctcggttgtctgggaggtgggcaagggccccctctgtgaccacacattatctttcgccatccagcctgctgccctttacctttgtgggaaacctcttcatggtacctgatgacccactggggcgaaacggccccaccctggatgaatttctgaagaagccagccaggtaatcaatcccctagactacttacaggcagcccccacccctggccctctctcagcaggcccagagacttgggtggaagtgtgacctcagtttgggccagcttaattttgcagtggtttgagttgcattggccttggcctttataagcttcccaggggatcctgacatagaacctccttgctgggagggaaacacctgcttcctgtttctcttaatcagcatgtttgatggagttatttggaaaatggttgcttatactgacagccagttgtattcagcatgccttctgctgaccattacataagtgattcatttaggactagaactagatcataatagtggcagagttcaccctgtttctaaaagaacggcccatcttcccttcagaagtgggttgatactgccactcagtggtcagcttcaggaacttcaggatttctcccccaaagccaggaataggcaggacaattacgagaggggtgcccactaagatctaatttcccccccaggatgctcatcagctctttttggtctgtttcttcccaggacacaggggtcttctaaggctcagcatccttccaggggctttgcagaa

SEQ ID NO: 74748 - DNA, 3657 bp, Homo sapiens
gagatgtgggtcctttgtctccaggatccacaccctagattttaacactgcattctcactataacgtgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagcggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgctcattgtaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaactgggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccacgacctacttaggctacaatttcctttaaggcagcccctagctctgggaaggaatactggtagccagtggccagtgttcgctgtgggatcaccttctggccctccagcagcatgatggcacgctgtcgcccaaagacagcttgcaccacagcgctggggagagggatgaaggctcggcggcccagggcagcacccaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcctctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcctcaccttctctggcccttaggatctccccatttggagacagagccatttggatattttccccttgaacttctccatgacctgaagcgttccttccctggaggaactctggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttcaaatagtggctggtgtgtataattgtttgcaattacttggtcccaaaggtgaccaggaactctgttcctaaagaactatggtgtgagaagtaagggactttgggataggtggacttttccctggcattgagtgatgccactccccactgttttttcagggtctcaatttcttagtgaaagtacacaaaggttaggagaaacatgcatggatcaagggcctaggaagtcattttgcctggaaaagaccagtgctctggtgtgtgcatagctacagaggtctgagttaccccgttcccctggcgaatataaggggctggtgatttggggggcgtac

SEQ ID NO: 74749 - DNA, 1019 bp, Homo sapiens
tcagaaatactatgttgtcagcataccatgttctcccatatttgccatgatgctattaatgaccaacattattattaggtcatttgtaaaggacagtccaagcaagggggatcatgctacttataacagtggagctgccccaaccaaaatctcaaactctactcctctatatattgcactgtgcattacgctcctgcctggcctcaagtgatcctcctgcttcccatcccaaagtgctgggattataggcatgagccattgcagccagtttgcaaatttctttttgtaaaagtaaattagctaggatcctttctagcagagagcctcctggctttgtcactagctttgtgttcttaagcaaatgatacagtttaatctgtatttggatctttgtgttgcacaggaaaatcgtccccaccctgcctgcctcagaggcctggtgagtgaagtgggttgtggaatgtgaaagagctctgggaagtccaaagtgctgaggaggtgtgtattactcactaaaacctgcatctttcactggtcccactcaacatttagaggattcccttatctaccaccaccccttcccctacaagctcatccctgaagtactagatggtatcataacttccttctccccctcaaaggaaaaaacctcatgacacttggactctatttgccagcatgggaagtagaacaaaggcaatagtagaagacagttccaacctgctcggggaaagagacagctggactggagaccaccccggggagggggagattcagagcattccaggggttgagggagagtgtggtgccagactgtcagcctgtacacagtccaccccagggccactgacaactcttcagagtctgacatactgttggagaaactgatctctacccacttgggaacagttatcaaaaacaacaaaattttagaaagcagccagggagagtggacatcctctcccccagcatggggactgaagtgaggcacactcaggtccttacatctggtcacctaa

SEQ ID NO: 74750 - DNA, 1046 bp, Homo sapiens
agaatgacaagtcacacaatatacaagattaccatactttttgggtttttagggacagtcacctcagagatgtgattattcaaacacagaatcaaatttgactaaattttttttcaagacgtagggtataatgtcctgttgctcaattgtatattctaaattttgattaggagactatgggataatgtatctatagatcatgaaccaaattctcttttgcttatggttagtccttttttaaggtaaatgaacagcatgtgttgtatgaattggtgatgtgctggtaccaaccagttgtgataacttactagttacaaccccagagcaaagatccacaaaagagaaaggaattccattcctttctctccgtgtgggaaatgtcagattaggacttgaacagcttgctgctgatctttttgttaagggatgctgtcaacacagatatgtctaaaattagagatcagaacagaaggagggcaggcggggacagacaatgcaactttcactcacaatcacagaactcaactcccgtgtagttgcttggccaggctcccagttgagaagggagattttgtaatgtttccagccttcattttatggcctgttggactttttatgatctgggctctcttttaccttttttaatggtttaggttttttttattattgtttcatattctttagcctggttgactttttaatctcagcctatagaaagcatcacaatttaaatctcttagaaattttcaaatcgataagaagtagcaggaattaaataaggaagggcagttgagttgtctatgaatgtagctgtttatgctcaatcttgctcactctccctcagaacatttctaaaaggaattattagcctctaggtgcttaataagacatgaaagggcccttaagttactggccattttttcttttttctcttttttttttgagacgggatctcgatctgtcacccaggctggagtgcagtggtgcgatctcggctcactgcaacctccatctcccgagttcaagcgatccttctgcctcagcct

SEQ ID NO: 74751 - DNA, 1059 bp, Homo sapiens
ctgtccttccaagggaaacgagctacctccttcattctaaggttagggatagctttgctgactcttcctcttcctcccttaacagactgcactaggcagtccccctgctctgtttcccctaaaggtctcatttcttctctaggaacaggctttttctttccttcattcaattacagttcattatccaatcatacaataaatgagaactaagaacctactacatgctagtcactgtgctacgtattggacatagagaataattctatatttggttccttaatagaccctaattgccactactcaaatcccagactgatagatctctaatttgttcttcctttgccttcctgaatatcctcagaccttcccacacagccccaccacactgcttctgtccatcattgagccagcccttcagctttctttcattgccttgtgaaccccaaattatgcagagttgagatgggaacacatatgtccagtgttaaattgttggtatgtgtatttaggcaagccgaatattggtttcctgtagtaagaaaaaattagaataagttaataaaaccaaatgccagaattgcctttgccctgtgtaactgtaggtgtgtctctcagctgctctagacttcagttttcccaggtgtcacatgtagaggttagactagatgctatataaaatctctttcagttccatcactttgaaagtctgtaattcctaaattatagttttattgtgtaggttaattgcttcttatctaaagaatcaaagatttagcgcaattaaatattgacaagtcctggattactaaggaaggcacaaaaaggtttaaattaagcatgtagtaatttgttggcagcacatataaccttagtgaatgcagcatgtcttaaacagttgcttatgcttaataatagttgtgccaacacaccctgataaattagtatgccgattagtcttcttttctgccagctatcacacttctgagacttcaaaattaggtgcttctggggccactacattctgacctctttaacttttgggtatcttccacatcttta

SEQ ID NO: 74752 - DNA, 1053 bp, Homo sapiens
atattcacatattgtttcataatttccttttctaaatgaacatctttccatgtcactaaatattttatagcattatagttgttgcatatttaattatgtgaaaatacaacagaatgcatgtaactaatcccttttattggaaattgaagtcattatccatatttcattactataaacaatgtcatgacctaactatgtaattaaagctttattcacattcactattattttctcaggagcagttcctagaaatattactgactgaaagaatatacaaagtttcaaaagtgttgccagcttttagatacgtaaatttgaattacatatcaagtggagctgattatgtatgaaggattatatgaacaaataaacttatagtggagaggtggtaggctagagctaggctgatttaagggttctatctatcaatgaatttagtaatttatttatgaatgtattcccttgctgagaatgactaggggtggggtagtgaactagaagagaatgatcaaataaataaagccccagggaggcatgtgaaagagaactgagtgaatacaggtcagttcaggcttggcaagaagcagagtactagaaacacgtaaggcagctctgtgattgggtgtattcatctcctgttgggtccagtgaggagacacacagttctgcttgagcttcaagcatctcaaggttaaggaagttgggaccaagtcccttaggtatgggaaagcccctcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtcgcgatctcctgacctcgtgatccgcccgcctcggcctcccaaagtgctgggattacaggcgtgagccaccgcgcccggcc

SEQ ID NO: 74753 - DNA, 1092 bp, Homo sapiens
attagggagttgtggcaaatcagaaatgatttgcctgagttcagtgaaacctttcacatcagcacattctcactgtttttcatccctggtgcctacagcaaagatttaataagccctgtttgcaaaacaaaaagagaaaaagagtaatggctcaatggaagcctccattaatgtttgagaccactgactgttgaatccaaatatagattttaggaagaagggctgaggagagtgaatttcctctaaaagataaaccttttcatctttgctatgagattaaaattgaatcatgaaagtggaaaaattaatagttgggaatgtgttctaagtatgatgcttactttttgttgagaattccttagttgctagtgatgataaattaacaggttcagaattttgctgattttcaggaaaaaaaataaggatgaatacatgatttacctttaccgctttttataaaagtcataatgaaataaagcaccaaagtgtagagaaatgttatatgtattataatagtttaggaagctttttgttaaggccttaactatcaagagcttatacatttctggaagtaaaataatacctttcctgccaaaataccttctcattcatgctttgagtcctgatgtcactttgggtaggacagaagctagatgaaattctgtagttgcatgtttattgtttagaaactcaatgcaagggatttcatgactcttttgggagggttcagaaagtagaaggcatagctcaatacctgtggattggattcaagaaagaaacagcaagatattctacaatgcttgactaggagttgggaaacttggattttaatctggatttatctacttattagttacaagtccttctcaattgctttattggtgttttttaaaattctaaggtagctaaaatgcatgtggcacaagaataatgtgatacagtatgagagtgttactttgaataccaggtttaagttcagactgcacaaagtgttggcaaatgtgtaaatagttaaagttaatgtgaaatgacaagtcataaagggtgaacagaattgttggcaatccacagagtaattaatactaccaaatt

SEQ ID NO: 74754 - DNA, 1092 bp, Homo sapiens
tcatgctctagaacactagcaatatttatattctgagggtgcatggtctcaagtacctttggaatgaataaatcaaaataaacaatgatcagatagaacagctgcaagcctgacttggaggctttgagctggtgattgcatgtttttgctttaatcactaagatactaaatgatttcggctctgtgtttcttgcttctatatttaggtttatcagtatctgaagcagttgctaaagagctggaaagtggtgtcaaaagctgggtaggttatccaattctaatttgttttcacagtatgaggttgttaatagactaataagctagtaggaaaagaaataatggatttatgaactagagacactattaaaattctaaatgagcagcttagcatatggctgtgatcagaataaaaagaaaacttggaggaaaaaaacaaaaaaaaagcaaaacaaaccaaggatgcttggtttgtttagaaacattgacagggggtaaggttaataagaggtgaactggaatctttctatatcccagtatattctctcccacttttcagttttttccatggtagtgctgggggagccaaactcccttcctcagtataagtgtacatagttttcaatttccagttgttaatgatgtgcatttgtatagattaggcctggtttcctaaggaaagtgagaagaggaagttcgtagggtgctgacagatcaatctaacgagggatttattattctaaattccgaaggaccgttttgcagtaggtagggctttcagagcacctctgtgtttcagctttctattttctcctcatcccttcctccactcagttgtctctgtgtgcagaggtataacaacattggatagtaattcaaaggctgtctgtgtggtaaactaagattaatgagaattaaatccctgactgattatatgctctccagaactagaggaaaaaaaaagagtttttattaaagttgcaagtataaaggtttgagaaattttcactttaaaggttaacataacccactgaagggagggggaaaactgtcctaaagaaaaataagccctgaacatctgaacatatatcgttg

SEQ ID NO: 74755 - DNA, 1029 bp, Homo sapiens
gaacctgaaatctggctgagacaattatttgtttcagttctaatattaggcttgatttggactagatgtaaacatctgtgactttgcttttagtacactgttatgaggtcaggcctggtttgtttagttctaaagcttcttggccttttgtactgtttaaaaaagggaaacctacatttcctttctggacctgacatttatggattcatccaagggagtctcattcttggctgatacagcaaagttcttggttctcttatgagcaattccatttgggctagtgccttcacctttttgcacataattattgccctttgtcagttgttatactttatatgtaaggactgtatagatccttgtagcactgctatgccaaccctttttgggaaggaatttttttgaactagaattcaaatactgtgtctccaaaaacatttacatgtgccacatcttacctgaagataaacgttaagtcacaatactccttttccatgaaattgggaactgttaaaaatatcacttttgtttttttaaaataacatagctctgagattggacctgattttctgacaggtttctgaaatggtctgaaggagagattgctctgtgttctccccatcgctgttgctcctcactcaggtgacctgtccaactaccattcgcctcttgtgccctttgcttcccagggcttgtctttgcaaaccaccatgcttggccactgttccttcactctaagatgaccctttctcttcccttaccaagactattaaaaacacagttcctcagagcgactgatctgatatgttagtaaagaaataatacagtttacaaaaacctttgaagactgatatgttgcttaaaccccttcccttgaagagatttgtttttgcagaaagtggcaactctgctagaactagtggtagtggtggtggtaatagtaacactgagaacatttattgatcaacgactatcacccattttacaccttcctggataattataactggggttgatagacgcattatgaca

SEQ ID NO: 74756 - DNA, 1064 bp, Homo sapiens
aacaaaataaaacaaaacgttctctgaggtcagtcaagttcactgttgagcaaacatcagaagtgggagaggctgatacaaatgcctgtggacccagcttctcagcccagatcaggttcttgtttctccagctctttcctgttacccttcctttacatacacacacacacacacacacacacacacacacacagaatgagaactgtactagctctgtcatgtctttgaaactcagttttctcatctataaaatggcaataactcacagggtattttgaggagtaactgaactataggtgcatatgtaatgcctgatacatagaaggtactcagcttccatgaagaagagacagggagggagagagaatacgaatgactgacatttccagctcagttccagtcatgctaaaccatatgcagaattttccagaagaaactattagccacaagcacagtgaggttgccaagctgtccaataccatagagaatagactactaggtagttaccgtgctctgagcatgagcatgtgccccctctggcctcccatgtcatctctgtaatagcacttagcattgctgggctttgtcagttggctttctgtttacttccatagactgtcagcctctagagagtagagactgttgtaggtacctcctttctgttcccagtgctttgatcacagcatccttgtggaacaaatgaagtgtctgggtggggggaattgggcataatcccactcctgctgcgcctctataagagctgagactgcctgaactctgggctcactttctgggtttgagctcacacgttcactctggattatagtggctggtacttgttttggcttttttttttttttttttttttttagaaacttgctgttattcacacacactaagatgctactgggtggtcttttaattcccttggaatccatcaggttacggagcaggagattttattctacctattggaccaattaccaataagaaaatgcacatttctctaatgtattcagacttttagaatctttcaaaatgagcaatttataaatgcttccatt

SEQ ID NO: 74757 - DNA, 1038 bp, Homo sapiens
tgagggatttagtaaaactggaaaatagatccccactacaaaggatttgggtggggaaggccaggaaatactcactctctgaggattgcctaggacctcagtaactgtgattctttctaggttcaaggaattagggctctggtaccatttctgattagcacaaagtaaagaggaagctaactccattttaatttttttttaaagaaaaaattaatttctaccctggggaaaatagagtcaatctttaaaatagataacagtatttactgatgaggctaaacaaatagaagtttgtaaaaatctttttttccttgggtgaaaaagaagaataaaaggggaaagtaggaaaaaagtataataggttataataagaatagtaggtagcatttattgagcgtgcatggtgttaggcactcacctaagcatttttcatttctcatctcaactattacaacagccctctgacacttccactcataactttattttttagttgaggaacccataatgcaagagaagctgcacagtgtctccaaggtcacacagctagtcaatggcagatcagcaattttaaccttggcagttggttcaaagttcacactcttagctacaaggtgacactgccatatgttgagttgtttgacttttttcctcactttgagttcagcctcccagaatatgtgtaaagcacaggagaagtagcagtttgagcttttttttttttttccttgttgttgtttgttaatttaataacagggttacaaaaaaaggcactatgcagtctaaatcaactttaattagacccgtgtggaaaacataacaattatccacaccaaatttctaacatttttcttttttcatgttcaattattaatagtcattggtgcacatattctttcagttattttctaagtgaaataattgaaacttgctccgggattctgactgttgcctagttctttaagaatctttatcaaaaggattttttttttctaaaaaataataaatccatttctttttgtgggatgaactttccct

SEQ ID NO: 74758 - DNA, 1031 bp, Homo sapiens
ttgtagtagaataaagggtgctgggaaggaagtggccaggctctcctggtgagttgatgagcaccttggcttccttttcccattcagtggcccaggccctgccttttcccctcatattgggcatggggtactgtcctggatgctgtgagcagacaggcatggaagaccagactttgggggctaggcctagtcacctttgttactccagcctgttgaattgctctatccaattgctatctaattgcaatcccaatgctatctaattggcaagggatgccattgtagtcatttgattttccttcttgaaagctctgggatctttcctgaaagatccagcttcttatatgtaaaatgggatggtaaccttatgagatatgttctattattaatagggggattaattgagactttcaaagtgttcagctccctgccttgcataccgtgaggactcagtaggataaatggtagctattgctattattattggcctctggtgtgtgatagaatcaagtagtgtctgttataaaggttctgaggcagaattatccagctctttgaaataagaacttttagcttaactaccaaatgagtgtccaggtgttaggattcattgcaaatgggattatacattctttttcctcttcctaattatgtggtaagtcttttcaggagggaaagcacctaccattttctcagggagagctttatactcccgccagcacttggttctaaaagaaatttttcacatgaagcattatataggagtctttgtggttgtttaaaataatacatttatatgcaggcattcctcagagatattgcaggttcagttccagacaacaacaataaaggaaatattgcaataaagtaagtcacacaaattttttgtttcttggtgcttataaaaattatgtttacactatactgaagtctattaagtgtccagtagcattatgtctgaaaaaatacatacctgaattaaaaatactttattgctaaaaaatgccaatgatcatctgaatcttcagcaa

SEQ ID NO: 74759 - DNA, 1149 bp, Homo sapiens
tttatttttatttatttatttatgtatttatttatttgagatggagttttgctcttgttgcccaggctggagtggaatggcacgatcacatgctcactctgcctcctggggtcaagagattctcctgcctcagcctcctgagtagctgggattataggcgcccaccaccactgcccactaattttttgtatttttagtagagactgggtttcaccatgttggccaggctggtctcgaactcctgacctaggtgatccacccacctcggcctcccaaagtgctgggattacaggcgtgagccaccgcgcctggccccgttttttctttttaaactgtctaccttgaatataggaagttggcacttatataaggagcttaaagctaataaagtagacatttctcccaatttcactactgagaaatgagacttcagatccttttttgtcattggcaaccacatacttactggtctatctaatagttgattttaaaagatggaacaggaatcttgaatgaagacatcggctttagggacagcctttgctttcattccccactggattgtgaactccttcaaagacaaggatcttcatttttgtatcccagaggatacaaactatgcgtgtctgtcatacagtagagaatcaataaacatatgttgagctgcttttcttctgtgattccccttcactatctagtctattattttttgtttctttatcagagagaaaccaactccatgacataaaaataataaatttttatttaatactacctatacattatcatatgctaacataatacatggttctaagcactttacaaatgtcgcttcctttaatcctacaacacactctcagaggtaggtactgttacttatctctattttacacttgaaaagactgagatagagaaaggtgaagtgacttctgtctaaggtcctgcagtactatgtagcagcctcagtagacttttagctctcaaatattaccctcttttcctgagttgcagagaaatgagagcagacatgcctttctaccttcaattctaaccacctcccttgtcctctgcctcctttctgaccacccccaagttccagaataatgtgacttgagtttggaaaataaagttacaggtgtaaaacatggc

SEQ ID NO: 74760 - DNA, 1147 bp, Homo sapiens
ctactaaaaatacaaaaacaaattagctggatgtggtggtgggcacctgtaataccagctactcgggaggctgaggcaagagaattgcttgaatctgggagacgaaggttgcagtgagccgagatcgtgccattgcactccagcctgggcaacaagagtgaatctccatctcaaaaaaaaaaaaaaagaaaagaaaaaaaaagtatgaacgcatttaatgtgcagtttttttttcttctgtaacctagtatgttagtgtagtgactatcaattgatgacatcctcaaacaaagcaaggttagttccttattctggtagaaaatatggtttctactcaatgctgtccagctgattgaattgctgagcagttagctcagcagttccgagaatatgttgggtaaagtgctgttggggtgggtattaatcagtttgctcttataaagggcaaatccatttgggaagcactgcctattatttttttttcctcttgtagagattctcaacatgggcatcattatatcaaagactatgagaagtactatagttaactatatcaacgacaaaaacttggttacatttattcaagtcagcgtttcccagaatacagaattttctgaggttatatatgtatcttttaggactccattactgagttagcacaaaccacaattttaatatgtgatttaatattgtgggtgggatggtttcacctagtatatcccgaaaatatagggacattcattaagtatggctattaattaattaactctataagtggttacttattttttatttcagagtagagaagaacattttaagctgtagtggctaagaaagtctccacgaaggagctggactgtgataatataaatggtgggtagcactctttgatagataagggacattttaggttggagggataatgaagcaggagtaaagacttgcatttgtgcctgcatataaataattttcagagcatacaacaaaatggattgtgcccagcacagtgcgagatttactgaatctgtggtggtggtcaaagaacctattaagcccaggcttggttgctcatgcctgtaatgccagcaggtcaaggctgcagtgagccctgatcgtgccactgcactccagcctgggcaacagagta

SEQ ID NO: 74761 - DNA, 1034 bp, Homo sapiens
ccagaggtaggaggatggactctatgacctttgaaagtcaattttcatcccaagatttcatgttccaattatggctgatagactatttaaataaatgatggtttttctattaggaaagaaaattgactggaattcattctatttgagccacaaaaatttgaaaataggtcaactcttaattacccagggtgatataatagggaacatcttggatggattatcccaaaccacaggtaattaacaaaatgtgcaaattaggcactgattcatagcattcattaaaatttacatttaaactactacttaagcagcatagatttatagatgagcaactcaacatggtaaaaataattttaagatgaatatacgcattttaaataaaatgtagagttgaagatattgccaaaagactggacaatctgaaatattttcatactctaaaattcagaacatttacctagtgctgcataagacatttggcagatttaaaaaaatctcatttttataaaaggcaagggagagatcaacagaggtttttcaccccctggaaactcctgtgcccgcccaatgctggacccttccctttgtgctggtgttcaggcccacaaagccacctctttctctccccgacacacttctgtgaaaaatgttgacagaagaacaaagactagggtgagtcaggaagtgagaaaaagaaactagagacaggaataattatagcacaatccttaaccgattatggaaaccaaaattttagtgccatttctatcttacccaaggaaaacaatgaaatgaactttactaaaatttaatatgggttagcacataacacatacatttatatataaatttacatacattggctgcggatattaaaccctggctcacataatcttggtcttcctttgtactctattgtatggcatccagtcgtgcacaggtgtgatctgtcagcctcaagcttcagctcctccatatctctatcatctattattctttctctacctctgtccagccatgctcaagcatgcaca

SEQ ID NO: 74762 - DNA, 1043 bp, Homo sapiens
aaggcagaaatttatctaaaatgcaatgaatggaaaaactaaagaggttaactcaccactcttgttttttttttaatatttccaaattgcttaaaactatttaaaaggctttaaaactttgaatttataaaatgcttaaaaaccttctaattgtgtataatccagctaccatttagtaataatcacattttctataaaacctattttagacctgggaagtcagcaagtacattatttaaaccatctaatggtatactgtttgtgaagggtcaatgtctattaaaccattatttttcattcaccacaaagtttgaaagctgtgaatttgaaataatcttctcagcaaagaagaatgaaaaaaatgcctgtgtttaaaaaagagctttgctgttgggtagaatttaaaacatgttttgaatttgattggtgacctcaagaaatagagaaaaatctagtgttggcttctaatcagtaagtaattcacacttcagacaccttcctagctgatccctggtggactggacatctttgaacaaagattcctaaggtctcattagagctttatctttctgaaagtgaaatcatttcccagatatgagagaaggcacagaagagcactgggggaatatgtggttggtaagtgagttgcccagttaaagactttaaatggagttgatgagtatatggaaaaatgcattgcacacatagattaattttaaaaagtagattaaatggaggacaacatacgtgacatcgagtgtgctagcataatacaggtttttttttcctatatatactcaggtgacaatatcagagaatcttatatgaaaaatagatttctgattgtcattgaatatataccaacacatagactaggtagcaaagttaacttgaaattttgaacaagaaagtaaattttatatcctctgggacttgatgacatgagattaatgttcataatgagataatggaaatgtatcacttcttctaaagatatagttttggtagaagaagttcattaagagtagcagaatctgaagcat

SEQ ID NO: 74763 - DNA, 1305 bp, Homo sapiens
atcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatccatccccaagcacctcctcatgctgtgcatgcagtcttaaattcaatggacaaaaataaaatgctggctacctctggatcatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcatttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaatt

SEQ ID NO: 74764 - DNA, 1044 bp, Homo sapiens
tttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatact

SEQ ID NO: 74765 - DNA, 1035 bp, Homo sapiens
ataattttgacctgaaaattgagtttttcctttgaaaattctaattttacaagatagttatattaaagtgtgataaaagtcactttaaagttgtgatatttctgtttcataaattatgtttaattttcagtttattattttacttttctaggatagcaaagtaatataatgtatatgcacaaaacagaagtattatttatacgtattttttttaattacaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattag

SEQ ID NO: 74766 - DNA, 1043 bp, Homo sapiens
gcagtgttgtaaaacccaacacttctctttgaaggaaatggtactacataaagtgacaaccaagcttgtattacaaatgcatgaagtttaaaagtatacttacatttttactctacataccttgtcttttactgagttttaattatatggtataaaaaccttttaggaaaacaactgattttgtgtttttaatatttcttttgtactttattgttcagtcttttccaaatgtaaacgtgacaaacacaaccacaatacaaataaaacgaatgatttttctcaaggtaaaaaaccttggatctagaaaagaaaacctccttaataattttgcctttgaagctaaatttgtattttctttcatttattcttatatgaacttgtgaatctttataaaatggtttctttaaaaggcaaattatatattttagtttactaatgttgtattttcaccctctagataaagtgctacatttacccttgccaaatctaaattttgctattttgaaataataagtcatttgtaattttatattctgtccactatactctgttatattgttacttatactctgttttcttctgttcttgtacaaagaagcataatatctcctggatatcatgaagcaagatataagagaagaacaaaacaaaatccgtaattcattgaaagaattgtaatcatcaatctttcatattattaatactttgtaattattttctccccaacagtattttccagtagattctaatcatgtggtagggcagaaggaaatgtgttttttgttgttcatttgtttcttgtcaatagtcctgattaatttagctttgctatactgacttatatctggaagtatataaccaagataagaaaataggttttaatatgatcatcttaagctaattgtaatgaaaagaactaatggactgtcaatattcagaaaaccaaaaataaaaaatacagaaaactattcaaagagtaagtttgatctgcatttccaatatttaaaaatactttttattattttaaaaatgatgacatgttt

SEQ ID NO: 74767 - DNA, 1084 bp, Homo sapiens
ctgtagtaacagttgtaaccaatggtagaaaaataaaacctttactgttcaattcatagaacaatcatagcatggagtcattagcatatgtctcagcaaagtattgcatggaaaataaaatattagggaaatttttaatgattggaaatgaagtctctcttgagaaatagcaagaattaattataaaaaacaaaaatagaaaacaaaagatttaaaacttttttagaattttgaggatttactgattactatagctgtcctaccccttttttgtatgatttggtaaaaatcttggtttgactcactattgtaggtttcctagaagtacttaggttttaactttagaagaatcaggaattatttgaggagtggactatgtaaaacatggtatgatgttagaaacagtagtattttgttactggagggcagtgaattaaccagaagcctggaaatttcttattctttttttttatttttaactcttaatggctttattgtacgcaaattacaacttttgaaatgtcaaatgcaaaaatatgacttcaagtaatttcatctgcttttcctgacactgctgaacctttaaagttatgcttttgctcatatctgagtaattttgacaaatagatattaatataatataaaacataatgtccatatacaagtgtatcttcaatataaaaacctatcccatttcacctgtttagaaatattatctattgaggacgtaacataagcaatgctattttgcttagtgagcatatgacacttaaaaaaattctaaacatcttacacttttaaggtatttctgttagacataagaacttttttaaaaatcttaatgaattgttcaacatgtgtagatggccttatacaacatattatatatatatagtaagtgtatatgtttagaagtgaacaataaatatgattcctaatatttttgtgtttatttttaacacagctgatgatgctatattatactcttcatctatattaaatttactctttaagataaataataaaaatattatgatgatttgttagaatgctattagttacctgtttattaatatgaggttaa

SEQ ID NO: 74768 - DNA, 1085 bp, Homo sapiens
ccttttgttccaccagagagaggcaaacaatgaagtaagcaaattacaacaaacaagaatttcagaaaattgtaagggtcataaagaagcataaagtgatagtgatttgaaagaggctgtttatggctgttaagaaagtcttctctgataaggtattattgagctaagtcttttatgatgagaaaggggctgctatgggaaaagccagtggaacagtgttcccaggatggagatcagtgggaaaaaaaaggcctaagagagaataagtgtggcatgtcccaggaactaaaaaagacctaactccctggagtgaagaaaaagagagaaagagtaatatgagatggggactgacgagagctcagcagaggtcagatcttgatgggttttgaaagccatagtaaagggtttagacttaactcttaatatgagatgagaagccgttaagtttttaaacaggtaaattacataatatttacaggttcaaactattattctgagagaggagtggattgtagtggagcaaatagtgaaccaagatggacagtaattagcagaccattgtaatgaacatgtttagagcaaatagtgtctccgactagggaggtgttggtagagagagaaagagagagagagaatgaagtcagattatattttatggtatttacaaccatggggactaaatgaacatcatcctgggaagagagtagcaacacagaagccagaagaggaaactatttccataaggaggaagtggttaatggaagtcactacatgaaaaggaaaggtaaaatgccataatactatagcacttgatatttttcctcatggctacagtttaccagtatctctgtcattttgccttattgactgaaaactgatttaatgtctgcctctacacctatacatctgttcagcctttgcttccaaacactttgaagaaaagaggaaaggctatgacaactttaacaaagaagtggcaaagtggaccaaggaaaatagccaaaatttcatgcccctcccccaaaacctgggatttgagagagaagagaaagacaacagcttccctacctgctccataggacata

SEQ ID NO: 74769 - DNA, 1023 bp, Homo sapiens
atcctcacttcaacattccttccttaaccccctcctgccataggcaatcagtgatctgttttctgtcactatagatttgacttttccagagtttcatttatatagaagcatacattatgtagccttgtgtctagtttcttttgctctgaatcatgtttctgagattcatccctgattttgcatgtgtaatttattcctttttattgttgaggagtagtcattgtctaggtgtgtgtatacacagtttatttatctattaatggaccttaagtcgtttctagttcttgactattaggaataaaattgctatgaatatttgagtacaagtctttgtgcagagttatgctttcgtttatcttgggtaaatacttaggaatggtatatctgagtcatatggaatattcaactctgtgaaaaaccaccaggaggggttgtgtcattttacattcctgccactatttcatgagctctccaattagtccagatccttaccatgactgtactttgtggtgtcagtctttttaaaattttagccattgtaatttgcgtaattgtatctcattgtgattttaatttttgttttcttagtgggttttcatgtgctttgtgaccattgctttattttcttttgtcaactcttcaaacctttggttgtctctattggattgtttttctactaatcagttagaagagttctttaaatattcaggatacaagtcctttgtcagatatatgtgttgtgaatattttctcctgtgttgttctgtgtcgtggtttaccttttcatttatttgtttgtgtccttccaggagcagaaatttttaattttcatgaagtccagtttgtaaacgctttttaaaaacctgtcttactttttgcatattaagaaatgcttgcaaatgtcagattttctcctacaagttttgttttgttttgttttgttttgagacggagtttcgctgttgttgcttaggctggagtgcaatggcgcgatctcggctcacggcaacctccaccacctgg

SEQ ID NO: 74770 - DNA, 1078 bp, Homo sapiens
ttgcttatatttagttatgatttttaacgtcttcattcatacatttgtgtatggctgagtttgtgtgtgactttcttttccattttgattatcagagttatgctagttattagtaaagtgaatttaaagacattctatttttcctctatagactagtttatattcagtattgaatactttttgtagcatgaaaattctctttgcatttatagtttgaaatatcacatacagcagtctgagcacagagcttatttgaatatatttatttgataggcctttttcatttcttggctatttttgagtgaattttgataatttaccttgttctcagagagttgtccactctatcaagattttacaggactatttgttgcatacctgctatgtattaagcattgtgctaggtgctgtgcatgcaaagataagaatttcctaggattcttaatctcaggaagcatgtagtgagagaagttaattttcttagggtagagacataagaaatagaaaagaagaaattaacatctaaacagaacttctgataacgatttcctcatgaatacaggcagcatgtacaaagtcataaaaatggttgaatacatgaacaattgagacatttacaagtagatcattacagcttgagtttaggtattggtcaggaaagagtaatgtatacaaattagaagctgtattatggattattcctgaatttgtaccttttcctataaacattgatagactgttaataatgttcattctgggtttatcatcagtatattcacattttaaaagattattctgatggcaatagggagggctttactgaaggaagtgggagtggttaatgctggaaccacttacccattgcattaccgcaaaatgcataagtggctcctaagcgagggctacaaatagagatagaaatgaaggaaagactatatataaacaaatgctaaagaaatagaccaaagattagtttactgattggatacggtagatgagggagaagtcaagacgacttctaacttcctgtcagttgtattagaacaaaatgttttccttgtctttatttcagacgtga

SEQ ID NO: 74771 - DNA, 1079 bp, Homo sapiens
aaaagcattttaagtagagaaaattgaaaaattacctctatttaaaaattctttttcctggaaagttccagatgagtacagatggtatactaagaaaagagaaagcatattttcccttcaaatcacattgttaaaggctgaaagatgataaatcaacttgccatataatagcccagtgatcttttttcttccttattttcatgttgttggaaatatgaagtttttaatagatatgtttaccttacctaatgacttgcaccaatatgactggtgacattttaatatttaattttgataattttatctgttagcacttattggcttaggaatcttagtgaatggatattctgacctttacattaggttaaatgatatagatggcagatctcagaatcagctcaataaggtgccagatattataatatataatatatatgattacttgtgtgcagtcatacttcttatagcaataacattttgtgtattttcataagaagaaacaaactacaaaatatggccaagtgagtctcagttttaggtatcaagaaacactgtttatccctgtgattttccctgctcctcaacccttgcaataattcaaacattctatttacaacatcagtaaaatacatttttcttgtattttccactgagtttaaggtgaacatcgacttaggatggaactttgagattaggaagaacaaaattctgtttttctgtttttgaaagcatactcggggaaactaaaatgcaatagactttttggcatgcatctagtatgtatcaattataaaataggaaaagtgatgcctaaaaatataatttcctaaaatatgccacctgaagtatatttcttttaaatacttgtttttccctttgtttccttataaatggctcattctgtttttgaattgtaagattgtataggactttagaaaccctcttttagtgggtccagttaaaaagtaagtgattaactgtaaattttttcatataccttgttctttatttcataactaatcctggattgtgttcctatacaaaataccttactcatgttacagggaaagtgcaaataa

SEQ ID NO: 74772 - DNA, 1019 bp, Homo sapiens
agaaatatcattagaaacagctgtgtctgttgttacacaacatgataaggaatgttatattttgttattttagggtttttttttagtcaatagtatgacattttatctcttttctgctacatttatagactgttctatgtgaagaaattagaatctcaaacttcacagagtcttaatcatattaaatatggtgtcatttggtttaggtaactttaaattatgtgtcataagttaaattataatgtgcacatatctatgtttatatattcttagtcaaagcagataaaaaataacttcattctacagtttgtttacttgtaaaatgaggtaggtagaagaaatgattttctagggacattttaagtgttttccttttaattcagggttagtagtgtatgtatttagaattgtaccttaccaagatatttgggcttaagtgactttattctaattagaatattatttgtgttaattaaatgctgagtgataatgttttagaatcaatagagggggtcggatttcctacaaagatttttaattatctatctaattttgtagtgtagataactccattgttatgaaatataatctttggacaatacagcacagttcttagtatcttattcatcatggaagcataaagtgagtaagaataaaaggctttacttacactgagtggaaatttacttaaaggttaccaaaaactcatattgtaatgaggcttaccctctttacttgcatagatttagtatttcatttaatagtcaaagcactaaagaagtaaatgtcaatacttaaaaatttacagtttacacgtaatatacctatgtatctctagccaagagagtatttttatcaatatatgaaatattcgaattgctataattgattctttggcactttctacagtgtaattgtaagtattacttaatcccattcattttatttactgaagtcatcagtatttgacagaatagattatatgttttatatactaaattttggttgaaaaggcacaa

SEQ ID NO: 74773 - DNA, 1038 bp, Homo sapiens
ttaattgcttaatattactgtttacaaatagacaaatatttctgtagcttttatacgcaaggaaaacgctaagaaatctccacaaaatagccatagttaggtaattgctggttgttcctaagaataataaataagaatgtggtaatttaggtattcagcctagtattcatagaatgttttagagaaatgaatagtcaaaatcactacctcattggtactaaccattttataatacagtatgaattgggatggtgaattaagtgggaatgggaacatggagtggttttatttttctccagtgtgaccttttttgtttatgattagtcaaatcactcttttttgtttcttttactcatctcaagatgatgtcatagatttctgagcacttcaatttaatctgactttaatgtagtaaagtcagtttaacttgaatttaacctcatagccaacctataactcaatttctcttctttcagtcaatatgacttggacttttctaggagattatagagtgttggaagaggttgaagtctagtcattctctttgctcaatccagtgagtggagaatgatctgttttgttttgtttttttttctcatatacctatttctcctcctgtgtgctgatgaagtaaggggaaaggtggaaagggaaaaggctttcttatgtaagtagtaccttttgttccctttttttctgtttgtgctccactgcctcacactgactagtcctccctccctccctccctcccttccttccttctttctttttcttccttttctttctttttcttccttttctttctttttttttttttcacccgtgctggaatgcagtggtgcagtcttggctcagtgcagcctctgcctcccaggttgaagtaattcacctgcctcagcctcctgagcagctgggattacaggtgcatgccaccatgcccagccagttttttttgtatttgtagtagaaacggggtttcaccatgtaggccaggctgatattgaaccggggcctcaagtgatccgcccacctcagccc

SEQ ID NO: 74774 - DNA, 1016 bp, Homo sapiens
tttttaaatctagaagtgctgtttgaccctttctcggattttttttactgtaaatgttcaaacctcttatgaaatgtgttaagaatacttattttaaaatactctatctgacagttctgctctgtgttgtttctgctggttctcactcttgccaccatgcttccttgtgtgtttggtgaatgtttgttaagttttcttagcaatttacctgagggaattttttgaatcctaggataaaggtggtttccttcagagtggcttggctttgcgtttagttgtcatttatagttgggaacaacttgaatctaaattcttggcttgagattattttaaccaccaggtatgaattcatgctgaaaatctgcttgaaggcaaacttggggttatgaattcccagataattttttcctgccttctaagtgcatgttaggaattgtcagaggatcagggcgtattttactcttacaatgacagcatagctggttaaagttagtatttactggggattctcatcaggctgcccacctggaacaggaagttcaatagacaaaagatcatattaccttggtttatcaaaagacttcaaggtaaatgtccccttacatgctctagttgctcttccaggttcctgcatttatttaggttttattagtttctggtcagctaacagatgccattgaagaatgtgtttttaatatttttctgtgacatagttgtttcaggcaggagaattggctgggtttccttgcttatactgtcagacataaaaaagcatgttaggttttttgtttgtttacaaaattttcttattttccccagctaccctggaaatatatacgtctattataaccatttcagaaataaggtaagctgaccaaaatcatgcagttggtgaaaaggttgatgtgtactcaagtctgtctgactccagagtccatgctgtacattgtatagcactgcctctatggggtttaaattcttctctcataaatacttgagttcccgggtagtgttca

SEQ ID NO: 74775 - DNA, 1033 bp, Homo sapiens
aaatgcactctgctatgtgtaggcaggtaaagaattaacataaagatatggttggctgtgaattcagtattaaaactctggtgaatgacaaaaaaaagtagcctgtcttagttacttggttgaccagactaagctcacaaactatttacaatttcaaagataattcactgggaaatctagattcatgtttaattttgtgttatagggaaccctgtaggaaatttatatttaagaaatatcagtatcgatatatccattatagtagcataattatttttatacctaggggaattgagttttaaagaataagcatgaatatgtatcatggaatgttatttaaccttaaaaaaggagatacagtgctgacgtttgcaatagtatgaatgcatctggagtatattatgccaaatgaaataagccagacacagatagataggtactgtgtgaccttatttgtatgtggaatctagaaaaatgtagaatacctagaaatggagaatagaatagtggttaccagggtggggaggggaaatgggaagagtaggtcaaaaggtacaaacatgcagctatgtagtatgaataagtctagagatctaatgtacaatatgaggatatagttaatattgtgttgtatactaaaatgtactaagagagtagattttacatgctcttatcacaccaaaaaagtagctgtggaaagtgatagataatttatctgactgtagtaatcatttcactatgtatatgcgtatcaaaacatcatgttttacaccttaagtatatacaataataaaaaaaggaggcaagaggagtaagaaagttctgaataatacctgttcattagattatataaaaataaaatctatcattgttagaagacacagttagcttaaaatgtataccttatcaggtggtatgtgtatatatatatacacacacacagacacacacattgtgaatgataaatatatattgaaccatttagaatattgtgctaaatcaataattcatctatttgaggattataccttaa

SEQ ID NO: 74776 - DNA, 1038 bp, Homo sapiens
ctgacattaacccagatttccttctcatttgtaatattttttacttttctttggaattaaagctacacaatatatgatgatattaagtcccaattctgaaagctctttcatgatcttccttgatgatcttattttctatttcactgagagaattctaaaaatttcataagctcctaccaccagatctacctacctaagtatatgagtatctgaatacttttactattttgttaaactatgtgcctagcaaaggcctacctctactttttttctatattccattccattccatcttacctacttagatatcatttagcaattctttctccactttcctgcagtatcaagttcttgccctactggaaattatttttacctacaaatacactgttctttctcccacttaaaaaaaaaaagtgtgtttctttttatcccacttcctgttctggtaattatggcattaacggtaaaattcttcaaatttgttgcccatacttgtgctatctccatttcctctcttttcatttctcttttgaagctattccaattaggactttgacccaacctttcactgaaactactcatgttaaagtcactggtagcttctatactttttattcagtggtcagttctcagtcctcctttttatataaccatcagcagcatttgacacagtgatcactgtctcctttttgaaacatttcattttgcttctggtacacctttatctcattggttgcagccgtatatttcttttgctgtttttttttttctcatttccttggacttctttttttctgtccgtggttactcccttggtgatccaatccagtatcatggatttaaataaccatctgttctttgatgactaccaaatgtttgtgtccattgtggacctttcatctgaactctacactgatgatgcagctgcctgctttatatcacttctatgtctaatatgtatgttagaattaaatatgattttaaatattctgatctttctcttgaccccctcagatcaacttctctcagtcttct

SEQ ID NO: 74777 - DNA, 1052 bp, Homo sapiens
attctttttgagaaaaattttgaagaaattttgaattatttccaaataatatttatttgaatttaacatattttactgtttctgcctttaaaatgatattctattttgtattttagcttatcttctcaactgaaaatttgaaaccatgctttctttacagtagtattttaaactaattgttctgaagcgtatacctattctgtttaaggaaaggtatgttcctctcaaagctttatcacactttcagctatgctggtgtatttgacatcttgtttaaaaactagaatgtctctgcatacgaacacccaaactgtgataatgagctagatatgccatatgtggcactttaggttggcatatatctgaaatggcatgtttaatgtactgtattactaggattagtaattttacagtggaaggctgctacttttatgatatagtctcctgctgctgggcttataagtctgatggactctttactcaaaacctgttttttaatttctgtaaaaatctttttactattgaaattatctgcataagatctatctggctgattgacttattatctgaagtttgtcaagattagtgagaagtaaaaaacatatatagtttgataggtttataaatgtaaatagtaattatgtatattttgttaaggaataataatgctaacatatttagtattgccagcaatggtttagtaaagtacataattgagaattgttcacaatatttttatttttagaaaaaagtgcataggaaaagctttgaggttctatggagtcttggcagtgaagccattaaaaagcaaactgcaataaataatgttcttttatgacagaatgctcaactttaaattcatattccagttctcatggacataatattcattttttatttttaaaattatgcttttatccaagggttttactgaagcaccttcaaatcagtcaggagattgcgttaaaaataagtagatactgcattgcaatgaggataatttagataatttaaatttaaggtataagtaaagaatgtaaacattttttgac

SEQ ID NO: 74778 - DNA, 1065 bp, Homo sapiens
aacatgtttttgttttctttttatgttgctaaatattttagaagaactgtagctttttaattttggtcatattaattcttgaaatacctggttttgaagtggttagtgttggaggtaagtaagctcttactggtagagctcattcacatacttagtccttaattattctttggataacccatgtttttatttttctatgatgatgatttctttaaaaagtggtgaaggtaattttttttgaaacttggtttcattcttaagtgtgaagtctgcctggaagctgtctcttgttaattattatgcatatttatcagatgcttcctgtaaacgctggtgtaggcagctatttggtaatcattacttagaattattacaatgtatcttttctccattcgaggaatataggcatactttgctttaccctgagaaattttgctttgctcttttctccttagatttttgtttttttttttttttatatattttagatccctgttaaagatttaggacaacacttaggaatagctaagagactttttatttaaaagatttggagaaatcatagagttgtggaaatagatcaaagtgatgaagttcagatgatctcttctaaaactttcatttaacagttgagaaaaccaaggtaccaagagattaagtgatttacgtaaggtttctctaatgccagtaattgtcctgtagctttgaaatgtgttttctgaatttgtggtgcaattgtggtaggtacttcattctcttgttttgttctactttttttttccctcccttctggatgtgactctgaggaagtaagtccttacctcctctctctcctagtcttaaaatgaatatatgttctttaaaaaaaaaaaaaaaactgagatgatggcccagtggttattttgccattattattattattttagttcatgtgctacactgaaggaacataggcaggatgctctttggtcattaacaaatttcttttagaaaaggatatcataggttatattgcctggagcatgtagcctggtcattttctctctttccttaattatactgttt

SEQ ID NO: 74779 - DNA, 2324 bp, Homo sapiens
tgtcttcaggggggtgcatacgagggtgggggtgtctggaacggtgacttgttagttaacatcctgcgcttccttggaagatgagttttaacgggaccgatatcgcttcttcatttgcactggaatcatcttaacaatgcacccaatgcatcgaagcagaggtgaatttatctccagcatatgcattgtagacggatgggggtcttttgagtggcacaccacaacatttggaacattcattcacattaagaaagctggatttaccggggtgtctcctgtataagatgtgatcaagttgacggaaattaaagtttgtggagttggcttaattttctaaaacgtttcattttatttttcctggttcttccaccccctttccgttttaaaagttgtgattattttgggaaaggaacattacctgttttgtcacttttaagcctatttaatataaatgactcctaagctttttagtattggcagaattcttcttaaggtcctttaattaatgagcttaaacgagatcacggtagactaagaagtgctaaagaaatgcactaggattagttagatttgccagtccaccacactgagttatttcctggcagttattgaagacttggaatacaccccacagtttgggtggattatttggtaggagaatggttgttttgcggactttaagtaggatataggcaatggctaattgtagtccttatgtgtctgctaatgacaaataaatatagctcatcactatttacagtcctgggcttttcttcttttttaatatgttaagtgaaggtttgtcatcttataaacctctgaagttttgttaaagggtcagttcatttcattttgccacagatagaattggaagatttccatgtttggaataacaactggaatttagtcatcagtttttacagtgctgcaaaataatagaatatgtttatattttaattccaagcttgaaagtataaatcctataaaatgggaaacattttgtacctgtttgtttttcaatgtaattggcttattttcattctcaaaaaatgtttaacttcatatttcctgcagttatatacccagtgctttagttgctgtttttctctcttgagggtggagaggggatacaaagtttgaaatactgtgttaaccgagtatatttctttgcatttttcagaagacggccagtattttctaaaggttctcatacctagttatgctgctggatctataattgggaagggaggacagacaattgttcagttgcaaaaagaaactggagccaccatcaagctgtctaagtccaaagatttttacccaggtaggtgcaatggtgaagagattgtttgatgagctccccacaggaaagaaagatctacttgtgttgtgtgctgtcttgaaagaatttttaaacaatactggagactttatttagatattgctttataggaatatattgtggaaaaattttcagattatttctattgttgattatgcctttttcctataattgttgtaccgtgtatgtgaattagaccagttgcaagatgattcgggtatttctgaataattcttattagcaaaaaaactcaaaaatttaaagatagaaacctggacagctggcatcaggaaatagggttcttctgaagttttcagacatcattgtaatgacaattagcttagagtgaattcagaagaggggggtagggaggcttcttaaagaatggaccatttacttctgaatccattatgtacctctttctgcttcattgctttgtttgttggccttggagtgaagtaaagaggacaagtgttgcctcttcagattttttaaatattgcagttttaatgcaattgatataaggaaatttatactgttatgcaagaagtaaaataatgcttcagaattcatgttaacttaagagctaaatttgattaaatatgttgacagtgtagtacagtaacctactggaatatgggaagtttccttggtggtataaattttttgtttttcactttcaagtatgcctttttaagtgttaaatagttctgcatgtccatctttttctatttttttcttacattttgctaatcactatatgtattttaggtttaagggaaaagtctctgtaattgagtagtacatttcctagataaaacattatcagctgatttgcttttatttaaatctagctttctgtgatttttttaaaggttattttatctttatggctgtcaaaaacgttaattcagtgctgagggaaccaatactgctttaatttttttcttcctggtggaaaagaaaagctgatttgctttca

SEQ ID NO: 74780 - DNA, 1070 bp, Homo sapiens
cccccctccctccccgccagccccccccaacaagcgggagaaataatgagcgagaccgggcggcagcagcagcagcgccgagcagcccaggcaacggcagaaccgctccggcagcggcggcggcggcagcaccagcagcgggagcgagcgcaacgctagcgcggcgcggggaccgccgcgctccttcccggctcctgccctcctctgccgctcgctcctctctcggcatccacctccttcccctcctcctgctcattcactctttccctcactctcccctcctcctcggcttctccccgcgccccgccagccctcgcgctctcccactccctctgcctgtcctccccggtcccctcctcccgctcattcactcgcccctctcccttctccactctctccccctgtctcctttcttcttcttctttcaccctccgtctctcacaccccctccattcccctgtctcctttctgacactgcactgcagctgctcctcagccctgccccctccccagtgagaacaaaccagcaacattgctttttttcctaaagagatttatattgatccgattaaaaaaaaaaaaccttaagaaaccccaaacgcaaaaaaaaaaaaaaaaaaaaaagaaaaaagaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcggtgggtatcgcttccacctccccgctggccccatcccccgccgcccgcccctgcctccctccctcgccgtcctccctccctccttccctccctccctcccgcggcccggacacctccagcccgaacccggcggcccctgcgcccctgccccgcgccccctcccctgcacctgccccgcgcctaggtgtccccgacacatttccatttctgtgtttatcattcatcaaaatggcgaccag

SEQ ID NO: 74781 - DNA, 1060 bp, Homo sapiens
ctattatacatacacaaacgttttcaggcaatggtaactttcatccttgtttttctaaccctcttctcttttgctctgcagagattagttataaataaagaacatatagccagctacattacattcctagatgcctgagtttctatcaatagtgcaattttttgatgaaacacatagaaaatatcaacatggcaaactctgagatgttacctggcgcccttccaccaaaaaggatttctacctccttttcaagactgattcatctctagttcacaaacaatctagcactgaaatatttcaggtacccactcctctgaggtcattgtaaaagcgaagaatgagacaacaccatataaaagaaaattgtgtcaccttttcagcaaataaaaagttcagtctcaatttcgtgctgaagtatgaagcacagtccctgaagagacagccagtttggtttgttatagcaggatttgtaactgtggaggtggaaaactttttcaatctatgaaagatattgtgaaacatttactgtgaaaaagctggaataataccaaccaaaagctataaaagtaagaggggggaggcttaatttgagaagttttacactcttttataagaacggctccattattcttaatacagacaaaggttgagtcaagtttgtgatgcagtaaatgaaaagttcagctcatctcttcaagcgaatccatacagattcacagcattcgtttctctccctgttcttccttgccctgcacttcttcattttgattagctcgttcccttaactggtgaagcaaacatttgtccttcaagtccaataagttctaactgtcattaatcacaagtttctttagtgagtgtttaaaaattctaatcaggaggggaagagtgctaaagagaaaatacgtggcactctccagaagagaatcagggtcaaaaactagacagctaagtttggaagtctcagataattgaaaaacaaacaaacaaagaaacaacaatcaaactatagctctcatagttttgttttcaaatagatgtatacattaaaaagtcactt

SEQ ID NO: 74782 - DNA, 1738 bp, Homo sapiens
cagcccaggagtgtcaagccataatctacaaccaacactcaaaggggagaggagcccacactttcagagcactgaaagaaagcctggctgcaaccttgaggaaatataggggagtcacaggactgagcaagagcctagcaactgatcatgcctaagcgtcacctactggatcacatcccaaagctttaacaccaaaaatacctcaataacagactcccctgtgaaaccaaagaaaataagtcagctacaaataaggactctgcacaaagccttggccctgtgaaaacatccaagaagaagtctacttcctgtactcaatttacgttgtaaataaaggaacacggctccggccgggctgcggggctccgctcagtccgggagcgcccccgggccgcggcgctcctacctctgctttcccaccgcccgcagctgaagcacatcccgcagcccggcgcggactccgatcgccgcagttgccctcgggcgccatgtcgcagaacggagcgcccgggatgcaggaggagagcctgcagggctcctgggtagaattgcactttagcaataatgggaaagggggcagtgttccagcctcggtttctatttataatggtgacatggaaaaaatactgctggacgcacagcatgagtctggacggagtagctccaagagttctcactgtgacagcccacctcgctcacagacaccacaagataccaacagagcttctgaaacagatacccatagcattggagagaaaaacagctcacagtctgaggaagatgatattgagagaaggaaggaagttgaaagcatcttgaagaaaaactcagattggatatgggttggtcaagtcggccggaaaatattccccccaaggagttcctctttaaacacccgaagcgcacggccaccctcagcatgaggaacacgagcgtcatgaagaaagggggcatattctctgcagaatttctgaaagttttctttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaattaagtaaaataaaagaatagacactaaaatcatgttgatctataattctacctatgggatcaataagcatgtcagactgattaatgtctactgtaaaaaatttggtagtaaattttcatttgatattagatataaatatctgaatataaataattttaatatactagtcatggtgtattgtattttaaaaattatctgcaaccttaattcagttgaagtactttatatttcaaaagaatgaataacattgataataaaatcgctactttaaggggtttgtccaaaataaatattgtggccttatatatcacactattgtagaaagcattatttaatttaaatggatgcaggttgtctactaaagaaagattatacataactatgctaattgttcataatcaacagaaaccaagatagagctacaaactcagccgtacagttcgtacactaaactcttgttgcttttgcattataaggaattaagtctccgattattaggtgatcaccctggatgatcagttttgtgctgaa

SEQ ID NO: 74783 - DNA, 1065 bp, Homo sapiens
aaaattatttatattcagatatttatatctaatatcaaatgaaaatttactaccaaattttttacagtagacattaatcagtctgacatgcttattgatcccataggtagaattatagatcaacatgattttagtgtctattcttttattttacttaattaggaacgcagcatttacagaacaaataaacacaagtgacgtggccaccccaggatctaacagctcttcagtgagctatgttgcaagctcagaagtaatccactaacgaaccaagtcagactccagttcttcatcaaaaggtgctggtggaggttgtcagacgccttccaatatagatccccaatccgatggccagcaaatgagagagcagcagagatggaaagaaaactttcagaaattctgcagagaatatgccccctttcttcatgacgctcgtgttcctcatgctgagggtggccgtgcgcttcgggtgtttaaagaggaactccttggggggaatattttccggccgacttgaccaacccatatccaatctgagtttttcttcaagatgctttcaacttccttccttctctcaatatcatcttcctcagactgtgagctgtttttctctccaatgctatgggtatctgtttcagaagctctgttggtatcttgtggtgtctgtgagcgaggtgggctgtcacagtgagaactcttggagctactccgtccagactcatgctgtgcgtccagcagtattttttccatgtcaccattataaatagaaaccgaggctggaacactgccccctttcccattattgctaaagtgcaattctacccaggagccctgcaggctctcctcctgcatcccgggcgctccgttctgcgacatggcgcccgagggcaactgcggcgatcggagtccgcgccgggctgcgggatgtgcttcagctgcgggcggtgggaaagcagaggtaggagcgccgcggcccgggggcgctcccggactgagcggagccccgcagcccggccggagccgtgttcctttatttacaacgtaaattgagtacaggaagtagac

SEQ ID NO: 74784 - DNA, 1047 bp, Homo sapiens
ctcttggaagtagttgccattgccttgttgtgcttactcaggtcacttgggttgggtactgtggcgtagtcagactaatgattgtatgcttcattcagcagaacaattttttcatttttacttattccattcccttcagacacttctagtttcccctctgatagtacttccctccccattatgcagtgtggttcactgttggggcccatttgggcacaaacgagaccttttgttgagttactgtactcctgcctttctaattacagaattccaaacagaatgagtgaattaatgacatgaatttatttcctgcagtgtctagggcagtgtaatgctgcagcaagcttgcaatagcacataagctctcccttcactccttgtcctccatttttgccgggtgacttcacagcagcaagaatggaaggtgcactttactcaccagtgagtaaatcatgtgaatggatattttaaagcacatgccctatacgcagttcacagaactatacttttaaaagctctctgagaacacatgcttggaatatgaaaatgtactgagtactgtatttcttcaggtatcctaggtaaggcaagagtgtataggcataggcaacatttaaatgtgtgttgttgcatttcatttctccaaataattgtttgatatttgactctacagcccttcagggcaggcaaatacttgtaacattagctccatagagatatggttctcaattaccaaaagactgtagaagtcacttttctttgcctgacactgggaaggattctgattgaaggaagcagtctttgttcctctggtctcatgtgacagtctgtatcttcaggtccatacaggttgatgcacaccaaaaagtggattcaaagctgcctattcaagacttggtgatagggaaagatgaggagttaattttcattttcgtttatcagctgcctgtttgattaagatttttggtaggaagagccatctttcagacataatgcctagggtaggttaagggcaaaaattaactctttgaaatataaatgcttcct

SEQ ID NO: 74785 - DNA, 1879 bp, Homo sapiens
gtgcttttagagccgtggtaatttttaataaatcatagataaaatgagagagataccaaggtatttaagacaagtagaacttctaaaagggggaaagaatggattctgaaattattcaacaagaagctcgataaaatgagagagataccaaggtatttaagacaagtagaatttctaaaagggggaaagaatggattctcaaattattcaacaagaagctcagtatttatccttgacaaaattctagaatgaatgaatgattaaatagatgatttgcaaatatttagaaaacaaatcttggccctgagaagaaaatgactgaaagtcagtatttgtcaatgttaatttacttaaaatgtattattccagaataactgcacttttttttaagtaggattaccagattggtagaatgagtcttaccaagaactgatgtgtctcaatgataaagcatttgaaaaaaaaaatagcctaaaatagcctttggagaagatggtaaatatgagctacataggaatacttctaggaggaagcactgcctgcttttaagacttgctcaaagaataattaataggcctggcagttggtaatgtgttttgtgatagagtcagaaagccctatgtttaggccttatcctgaaaaaagttctaataattgtattaatacatagcagatgggcttattcggtgtgagcatgacagaaagctaggagaattaacgatatgaggcagagctatggtcacagagatgtacatacacatacacacacatccttgcgttcaagcacataaaagtgtggtggaaacataactaagaatgtaattatcatgactgtaaaaataaaatgttaatttttgagataattatccacttacaatgataagttaatggcataatatggctgcagtctgccatagtgtttaagagcacaggctttgaattccagtccccctgggtttcaaattcagctgtattgcctaggagctgtctgactttgaccaacttacatggccttttgaagcgtcacgttttccttttattaaaatggagattaaaataataactactttcagggggttgttataaggactaaataagaatatgaatgtaattttttaaaaaagaatgaaaacccctcaatcctagactatatgaataatatatttgcgtataattcaaattggcagttagtgaggaaaatgttggtcagtgatgatcactgaattttaacagggacattgagtagagctagtgactattaaaatcgaggtgtacaggaggactaagcaggctgaaagatctgaaggaactatagaggtgagattaaggggaatgaatcactgtctccaaagatgtaaagaactgtcatatagaataaagttttccattgcatctaaaacataaataggactaatgacagtaagttataaaaagaaaacacttttttttttttgctttgagtaggatatgaattaaaggtcaaagattcagaatggtgtattgtgtcatgatgtcatctgtggtctggggaggggcatgcatgtgcctttgcaactagattgtgagcttttcggggtcagggcttgatcattaactttttatttcataagtaattgccaacaggaattaaggaagatttggtgaatgaacagataaatgaatgatttatacatacataatacatctgagactattttattacatgaatattgtatcaatgtagacatggccagtaaagagaatattggaaggaaaaaagcctctaaactgtgttcaaaaatgtttagtaaaacgcattttggatggtatagttaatgctggattgtatacaacttgattaataaaaaggatattttaagagttccagaaaagtaacaag

SEQ ID NO: 74786 - DNA, 1049 bp, Homo sapiens
ggaaaccctgtctctacaaaaaatacaaaaattagccaggcatagtgtcatgcgcctgtggtcccagctactctggaggctgaggcaggagaattgcttgagctcaggaagcataggttgcagtgagccaagatcaagccactgcattcctgcctgggcaagaaagaggaggaggagggggagaaggaggaggagaaatctagccagcttcagcttgacatggaatgcaagagaagaagaagaaaggagaaggacatgaagaggaagaggaagagaaagagcaagaagaaaaagaagagggagaagaagaagaagcagaagaagaaggagaaggagaagaagaagaagaggaggaggaagaggaaaaggaagaaggagaaggagaaggaagaaggaagaagaagaaatctagccagcttcagcttgacatggaatgcaagtcttgttatttgcaaatctgaattaataagtttccctaaaaacacctcacctagtattctgtgcagggtattgacgtgcagagtacatggtaattggtaattcttgatcactttatcccaggaagaattctctgttcattagtagaatgagatacatttgctaaaatgcaacctagattcagtattgaggataaattttaaagaagaaattttagaggaatatttctataaaaaagtcatttatttttaaatttcataatagttactcataatgaaacctatgaattaacctctggtttttttacattatagtgttatccatttatctgtcataattttttaatttatctctacaacgaaaatacatattaatagaatatatatgcctattttagtgctaagcactttatatgagacctctattttaatgcctaatcgaattccaacaggtagactttaacgatttgcctgttttacaacttaagaaatcagtgtctctcgagcgaggttaagttgtctaagcttgtaccaaagctgtgaagtagcaaagccagtatttgaatccaagtccttctgactccaaaccctaaattgatgaaatattatttt

SEQ ID NO: 74787 - DNA, 1037 bp, Homo sapiens
actctacctcaggtttacctgaaaactgaacaccatacagttcaacccaaaatatgaggtgcttattacccagccttgggaatttttttttttttcagatggagtcttgctctgtcacccaggctggagtgcagtggtacaatcttggctcattgcaacctctgcctcccgagttcaagcaattctctgcctcagcttcccaagtagctgggattacaggtgcccgccaacatgcccagctgattttttttgtacttttagtagagacggggtttcaccatcttggccaggctggtcttgaactcctgacctcgtgatccacccgcctcggcctcccaaagtgctgggattacagatgtgagtcactgcacccggccaggattttttaaggtgtacaaacaacgtgcctatcactcttcagagtaacccactttcagaaccatggtgcctgacaatacgttttactaaacatgagatgtgaattttgtaaagtttcacttggattagctgacataaggttttatgcatgaaaatacataaaatgtacctgaaaacattttttccctacaatattttgacttctcaagtccatcaacaagcaacaatatcccactcatgagggtagtgcagtctgtcaaacacacgaagaggaaaagcagcacagtcatgaaagaaggatggatggtccactacaccagcaaggacacgctggtaagatccacagggaacaatgttctcttgccttgctagctttaattagaggagttgctaatgtcccgtgaggactgtgagatttctgcattactcagagtaaacctcagcacaggcatgacacgggattaggtaaggtgcattacagtctctgggtgtcagatatagttgagcaagcaacgaagttaggaaaaagtgtggaaagcaatttcaggcaaacaaattcattgaccttgattacctgagatgtctacctgccattttatagcacttgtggaagccacagtatgtgctttcagaatgcttcactgcaatttagaatttta

SEQ ID NO: 74788 - DNA, 1048 bp, Homo sapiens
cttcgaaggactgctaagaaaaatgccatatcttaagcaaagagcttacattttcttcttgggtagcattctaatggatcactaccaaaatatttgacttagaatcccaggttagctttttctgcagatagtggtctttatacctttagcctgataccagttttccaattcctctggaaaggaaaatggctgtaaaagatcacagatactttcagttgaatatttttgttgctaagaagctgaagaatgactatctttgctctagaactttcttctctagaagaaatatatactgtacctaaaagaagaagaaggaagagctctccaggaaaacattgtcacacttgtttctggcttggagattcatgaattagctgccaaaattgaaagcttggcgatcgtcccactttctgtggcatgtggtgttgactttgttcaggctcagggaatgtcagtgtgtactggataactataactaaggggatacagaacagtttttgatgttgttgattactttgaaattctattttcttatacattcagaaaaatctggtaaaatgtgaattttccaagcttggcaggctagagtctctcattaatctgtattttcattttaaaatgagtactttgcattagtaagtaattttaatttttgccattaccatcaactgtataatgacaggttcaatattacttcaaatatcaaatgtcttatttaaaagctgcagctatgtgaccaatttaatatattggaattcgtgattttcaaagttactccaatagtaagaatcagtggcttgaatcttttttcatgtgaaaatttctgtcatcctcttacatacttttttttcccaccagggctgtgcttctaaaatatgagcagcttcccagtcacttgggcctggtatcactttgccttctagcattttacttctatcccagctttggcttccttccaaggtttttcatgacttttcatgttttcaggcttgggaaaacggaaaacgagcatctacctataaaattacatgttcaacctctcataaac

SEQ ID NO: 74789 - DNA, 1370 bp, Homo sapiens
cattttggctgcactatttactagcatttgacccaggggtatgtatttaaactttatgagcttagatgcctcaactgtaggtaataaggcctgtcttttaaggcacctaatacagttattgctctagagtaggaacttaataactaagatatataaatgagatacataattataacaacggttcaaaagtaattcagtttatcttattctgatgattctaaaatacatttattctgacgattctcaaatatatcccaggatatcaaaggtactgtgaaattatccaaaaacatagaaaacatggttaattttagttaatttaatttttaaaaatctatatactgggctgattaaataattctaaaatgatgggcaagagtacacagagataaaattacatccaaaacatccacttttatattcctcttatagtatattcgttctgtttccagtaatacaaatcttttattgtatggctgaggaaaaatgtaaaatcatatttatttttttctttaggtaatccaaaggaactgtaaggcatttttttctttctttctttctttttctttttcttttattatttatttatttattttttttgagatggagtttcactcttgttacccaggctgtagtgcagtggcacgatattggctcaccacaacctctgtctcccaggttcaagcaattctcctgcttcagcataccgagtagctgggattacaggcgagcaccaccacacccagctaatttttgtatttttagtagagacgggtttcaccatgttagccaggctggtcttgaactcctgacaccaaatgatccacccgccttggcctcccaaagtgctgggattacagcattttttcgatgaagtaccatgtagggcaaacaggaggcatttacttttcattttctgtctttcataaatgcttgcattttctaaccatgtgaatgtaatcctgtaaaaaatgtcaatgatataatatttgcactgtttatttgactccaactttatatttctgtattaaaaccacttttttaaagcaaaaacttatttgaaagacctagaaatcatgtttaaacattctgatctccaattctcttttttttttaagattatacaagcaaggtaactcaaatagaaatggggaaggcaagtaaattatattaattaacagaaatacagtatgatttcatattattaaacatcaaagtactaaatacaagagtaaaccggtatcttaaaatatataaatatataaatcaaatagcctcttacatcttgcttcctttattgttttccaaaatgtagcaaaaatcaccatcagagtcgtttattggtcgagagaagaggtcaaattctcaat

SEQ ID NO: 74790 - DNA, 1050 bp, Homo sapiens
tcttttagcttttaaaaagcttcagcttttccttcttttggccttcctagggtggttctctggccggagccacttacttgcattcaacctgactctgtgctggtccttctgctgttgattctttacttttctgaacatgagctcatcagacagttccctgggcagtcacaacatttatctagttaccagtcccttttcttcctaattagggcaacttgctattgtgttctcagtctggcttgtgagacctttttctcttgtagccatattttttttaatctctaaccacaaacttaggaaataacttcccagaaacttctgagctgcctagtcaacctatctaaatacatttttttttctctcttggctactatgatctctgagatgatatattcacagcctcccaaattcccatcattgcacctcactaacaattttctggtcagatgttaagtcaaaaatggagattcccttcattttcagcacccatctgaaagatgttattgcaagtccctctgcaagaatttattgaatgttcttgttgttggagagctgtgggtcctcacaactctagatgtttccaggtataacaaaaatgtgaaatgtgagattaacttgaacaacggttgcatgaagggagaatctgatctaaaactggcttggagagactgggatcaacagagaagcaggaaaaaatgaccaaccttgggggttaggtatatgtgtattgggtgatggggagggagaatggacatgtgcaagcttagttttacaaacactcacacacctgggccacaatagtgtgaaattgatctgttgtcatctctcagttccctgcctcatggacaatttgtagtcattcttgctgatttccctgacagtgcaccaaagatgataaagtgtcaagaacccacaataattgtaaagaaatatatagacaatcctatgttatatataattaaaataagactatataaaaatgttcactcttttatcctgttctctgcttttcaaaatactcttcaaccttcaggattctgtacaattcct

SEQ ID NO: 74791 - DNA, 1030 bp, Homo sapiens
actctttaaattccaaaagccttagatttcttatttgttgattgacgatgacacaaaaatcaacctggctgtggtctggggtcaggattaaataagatctaacatataaagtgtttaacatagggcctgcattttcactgtgtagccatgccatgcgatatgcataataatgttacattgtactatttttcagcccatattttacccagtagtcatcttttccatatttgatagtatttttaaacccttctatttggatattgcttctcttttatcatcccttgaattcttgcctcctcttttatggctctttacgtggctcagaagaacttcacttggcttctttcttctttgtattggtgattttttcacacacatgtctttaagaacaattttactctttcccctaacctctgtcctgaattacatttttagccatctgctggactttttccacttggatatcccactggcacttgagctgaacatatctagaacagaacccatcattccttctgctcagctcacatctcctgctggtgatttctcatcattagtggtaccagttggttcctggtcagttgtaagggctcattgtcactgttgaccgcttttttcaattctcgccatattaatcgtcaagtctatagcttgcatttagttttctcttctctgtttctattgctacagccccatatggtaaccctataactctttctgaccagtgtcctcactgctctgtagtccatcttctctgcaatccttcctctctacagtccatcctgcacatcagtcttccagtaacctggccatgatctcacaccatctctactcagaagcctccagtgctttcccgttcactatctgctgaattatttatttaagcaggcacccaggcctctctacacaaggcctggctccccttccggctttgctctggcacacttgcacacatatcctttggtcattctgttaaccagccaaactgaatgactgacactccttcaactgccctttgcattttgactct

SEQ ID NO: 74792 - DNA, 1044 bp, Homo sapiens
ttaggaagcatgaaatctttgcttacataatatcacaggtttttgaagcagtttatgtaagtaatttgtttccttcacaatgactctggaaagtagagaagtcagatatttgaaaagctatagaatataaattgtaacttgcctatgtcctgcagagagtaggagtaacaccagagcttgaatctaagtgttcagtcactattaataccatttcaataccatttagccctttgaacttgaacaagtaaacagaaatagttgaggacttgttcaaagaattcctattgcagtaagagtttatatttcagggaccattgatgatatttgtaacagcaaaagtagcagtgagcttcaggaaccattgagatgatgtttgtcatagaccattatcatcctcttcctcataaaaatgtaaatatttaattcatatactcaaactttaatgaggttaagaaaaccctgaaggttcttctctatagttataatacaaaatataaagcaatataacagtgtcactgcatcactaggatcccatcataagttcacaattctgatcaaaatggaaatagtgtcttagggtcactatatttaagaaatccttataagcatgttttactcctactacgattcaatgcctaaatcataaaccaggaaaaaaaatatggtaacaacattttattaagcttcttttttcttttatagaaagtgcaaattactgactttatatattaatttctcttagatataatattatattaatttgtcttagatataatacattggttagcaatgtagcaatattttatcttctgtgaaatttaggcagaagataaaaaccccaagagtgatatagtaaatcactgtattatttcctcaaaagtatattgcatagatatagtttttgtttgtttgcttttaagaaggcagaattaattgtgggcaacaccttctcagccctactactacttgggcaactaaggttttataagacctggccttcaatgctcaatttatatttccttgtgtttgtacttggacatctaa

SEQ ID NO: 74793 - DNA, 1083 bp, Homo sapiens
gattggtttatacactggttcatatttattttgtgtatgtatttgttgaagtttcccctactgtcttttagtcacctggttttccacacatgtgagtgaatacaatagcagaccatggattctataagtgactggtaaggctagggctcactgaggtcacctagactgaagaggagctatgttagaacttcattttacatggtctcacagcatcctgtacacctctgtaacacttatgactatcataatcatgtaatgaattacataattagtagattaagatctactctttaaaatgcaagactaacttttttgttgttgttcaccgggctttgtgtatagttaaagcttactactgtttgttctgtgagtgaatgaataaaatatcgtcataatctaatagttttatggtatgggcaagaaaggccctgtgaaacagtgattccaagttctttagaaggatgtatagtttagagatcattataagcttaaaaattgaagaaaactttacagaaatatgagcaatgagattaaaaactagcatagacattgggaaatcatgatgttgtagataggttaagccaaattaaaaaatcccgtggggctggctaattccagggattgttaaactcagtcaattgattaatgcttatatcaataagagggatcaactctttctttattcaaaaagcaaaactaaataactggcagtatttatggcacatgatcactatgttattgaataaattatgaatcttttttttagctggaatgatgaaatctaagtaataattagactgtgggcgtggtggctcacacttgtaatcccataaacacttataaacactttgggaggctgaggcgggcaggtcacaaggtcaagagatcgagaccatcctggccaaggtggtgaaacctcatctctactaaaaatacaaaaattagctgggcgtggtggcacgcacctgtagtccaagctactcaggaggctcaggcaggagaatcgcttgagcccaggaggtggaggttgcagtgagctgagattgtgccactgcactccagcctggcgacagagtgagactc

SEQ ID NO: 74794 - DNA, 1054 bp, Homo sapiens
cacctttcacatgcaatgagatgctcagtgaatcccaataattatccttttcttagagtctcaagttcttatcctctgtttttattaaaacagctgtgtttccagcttggattatttttacctcctacttaaactgttgcaattcatgggtcatttactccttcagagttaccaactatgtttttaacaagttgagtatgctaatatagagttacaattttgatattaactagacaaaaaaattaaaacttggtgacttctcattgtcagtaaacaaaaaaatcatttcccaatctggtcaattaaaattccccaaaatggtcatagtttaccttaaaatattcttgctagaccttcctaagtatgaaccttgtgtgccatcaaaatgagactgtttattctagtccatatgtacattgtatttcacaatatttggaccttagctctgtttttccctccatctggaatggtctactcataatttctgcccactgaaatacttcttatccttaatccttttccttaagcctgtgggtcctttcagccctgaacactcaggtatgaaccaaatactaccatttgggagggatatatagaggatagtcttgcatggcttttgacctggcctgtctcatgtccggctcattgaaatgcagtttctggttctcagattttaagttccagaaacttcatttttaaaataaaaccagagttgctatagttcctagaagataaatccaggctagtaagcctcacaaaatatttttatggactggagtgcctgtatactaacttagagtgagtgatgtgcttttcttggatattgcctttctgcaacaagatgtctgcaaagcagattcagaaactggaaagttgctcaattggctcagaattgaaacataaggaattggttggtcttgaaggatattccatccaggttatgggaaaatcttattgagtcacctgataagattcttttccttggataatttgatgtaaacactggtggattcctcaggttccaatcttttatctgttgctccaactgactgaa

SEQ ID NO: 74795 - DNA, 1017 bp, Homo sapiens
gcattatttagcttagttggctaccactaagtttgatccttgtagactttggcagaaggtagcaagtgtgacagaggctgtttctctgaaatgataaaggaacattagaacatttgggtcctattatttccttttaagaacctttcaaatacagaattgctggaccctcatcgtagctgataactcacttaaaattcacacaacctgatttaaaaatgcaagggcctcaagcactgcattccaactgtgcgtattctaattatactgaatgcatgcagtgtgtgtccgaagaatgtgtcagcttctggagaacagggggtgtttctaaggcttagccccagagttctcaaattgaacatttggagagccaaaatacgcaatgggaaatacacacaatcttgctgttttcaattaggagtgagctcctgtttcttcgacttcagcaggtggctattcatcattcaaatgaaaaatgtttattaacgtgaatgtaatattttggaatttttacaattgagaatcaaatattaaaaactttatctttcctcttctatcaacaacttataatggtctcatcctaacgtttctgtcctctgacctgttacttaagagcttttcaaaagtgggcttaaccttcttgccttttatgtcagtggtcggttgtataatgaggacagtgctccattaaagagtgttttgtatttgtatttgtagcacaaaagaagtggcaatatagtattcattcaatgattctgtcatttagagctatcaattcaatggggtcaggacccaggatattttaaaattgtgagcttgtttatatttattaattaaatatatactttaacatttgcatttgaatgggtttttcttttgcattattctcggaaaacataggctctgcgaataacaaatattaaaaataacagcttgtgaattcacttgtgatggtaatttaacatatatcaaaatggaatattttgtgatattctttgtttacagactggcaagtaatca

SEQ ID NO: 74796 - DNA, 1067 bp, Homo sapiens
gcaatatggcgaaaccccgtttctacaaaaaattagttgggcgtggtggcacttgcatgtagtcccagctactgggaagactatggtgagaggatctcttgagcccaggaggtcaaggctgcagtgagccgtgatcatgccactacattccagcctgggcaacagaggaagaccctcctgtctcaaaaaccaacacatgagaccaaaaaaaaaaaaagtttctatgggatattatgttaagcttagtatatttatgactcccagttgtgctaaatttgatttttttaatgtattgattaaaagatagactttgtctacttgaaccataccctttcttaagtctgctgattgttatggttaaatacacacacacacagagagataaatatatgcatttgaggaaatacagagtacatcctgggtagacctgacttaattcttagattaattcagtaaaatatggattccttaaataaatgagaagatttgacaatgtgcataatttaattgtacaaagacaaactccactctgaatgtcttcttggcaaacgaaggcccattaagccatatttcaatacacactctgggatagagggtggggaaggagggagggacaatttgtagtacactgtatctactttatggctactgattttaaacaaatttcagattacccttattgtctaatcatatgtttgggaggatgggctatttatgagatgttagctttccagatgctcgaacaatgtgctttaaatgctatattcacaaatcagcccccaaaatgcagcagattagctgtttctaatctttgaattcagaacaaatgttagaaaaaggaacatttgcagagctgtgtagtctctattacctcattaaaatgtatttataaatgaagtagacagaggagcaaatgtctgcacaaaacattgctacttcattaatatttttttattacaaaagcactttctatgaaatctgtcagcgtagaggaaataagtgaatcagttggctttcatttttgtgttttgtttattttccctgatatgcaaatgaaattttgaaag

SEQ ID NO: 74797 - DNA, 1078 bp, Homo sapiens
cttgtggtgtcaaattctttataactaacagctttacaaaaagtactatgtattcttttctgtatgaccttatttatgagattcctgttcatttttggttactgagatttactgaacaaggtgatgttcagcataggcaaatatttctttctttcttctttttttttttttctttttgagatggagtttcgctcttgtccagactggggtacaatggtgcgatctctgcttgctgcaacctccccatcccaggttcaagcaattctcctgcctcctcttgagtagttgggattacaggcacgtggcaccatgcccaactaatttttgtatttttagtacagatagggtttcaccatgttggccaggctggtctcaaactcctaatctcaggtgatccatcctcctcggcctcccaaagtgctgggattacaggcatgagccaccacacccagcctcttcttcttttttaaagtaagagctggatctagtttgttttcagccttcatctttgtatgcttgatgtttgtttgcacacaccaaatccaagtgtaggattctagaatttaggattatgttttgctttgattttcataatggtactagtggctaataacttcagagaacattcctcagtgacttttgagttctttttttgctattatttctgatagctatgagcacattttactagagatataaattatatgatttctccctaagtgtatttgccttgcacttgtgtccgtatcgattggcctcagtaagtagaatgcatgtttccataggaactagaataataacttgatattactgtgcctagtgtttcattgttccatgaaaacatttgcaaagcaaaagaatgtgaatttatatgctaataatctatcaatttttgctttttaaaaatgtgtctttttgaaaagctgcactttactccaagtaaacctatttctcttcttcattatttttgaggaaaaattgttagtagtaattattggatttttcacctctcattcctctattatataagtttatgaaaactaaatgaaaaaaatgcagtgaaggtaagattcagtgc

SEQ ID NO: 74798 - DNA, 1053 bp, Homo sapiens
agatctttgcacatattatctcatttattaatctcaggataatcctacattagttacacttataaccccctttttataaatgagcaagctgaaacacagagagggcaagtcacttgttcgaggtcacatattaaatggcagattcaaaataagaactcagactttctgaatacagagctgcatctactacactctcctgcctctcattttggcaataaagtttttggcagatggtgatcacagaagttgcttaaagtcacaacttttaagtactcttttttctaaagtcaaattgtatagtttttatcctaaaaaattatattatcacttttgtagtttagaagaggaaggtgtgaaaatttgaaatgttatctattctcatttaatttcctactttccgtggagagtattccatacccagattaaatgtcatttccaattgttgctcacacttaccaaagggaaggtctctgctcagttttgagcagaggctccctgtgtaggagtatgacagtcctcagtaaagttttgtcacctatgtttggcaaaacatcctgggcagatgagcgattcatgtggcaagagcactgccaattgaaaaggtgcattagtatgaatattagcacctctaagtgtttgtgaaatagcaaaggtagaaggactagaatattgacaaagcattttcaaaaaattatactacttctaatagcttaacatgttgatagaaaagacgattcagtgtagaagtctgtgatgattcaattctaagttgtatgtaatagagctaaagtctgtaattatattttagaggagtattaaacaatataaacatgatctctgagtcataaatgtcattattacactgagttttaaatataattcatttataaccatataatagacacataatattactgtgtgacaagaaatactcttagatgtagcaagaaaaaatggaaattacaaacatatgtgatttcaaaataattcttaacatttcttcaggggttattacaaagcaaatgaaaggaatttttacaaggtgtagttcag

SEQ ID NO: 74799 - DNA, 1022 bp, Homo sapiens
caactaataaaagataaataaactggagaaaaacacaatttttagagtaatttggactggagcttatttatttttagccataattgtttctaaagaataatacctaggactagtctttgggcctttaacataatcatcgtataatacatgataacgaattcactggaaatatattagacaacattggttaagtttcagtggtgagtcactatttgtcctaaattgccctattttatttatttttggtggaaaacatggacatgataaattattatttgtagattaattgaaagctaactaatatactgaaatcacaatattcaaatatgtatttagcagaaatgctttgtttttatggttatcaatttgtaatcaagaaagttattcatatatttattgactgcttactgttgtgtcagggattgagctgagttctgatatatattgatgtataagttaaatcttgtccttaaggagtctgaaatcaattgcatttggaaatgggagaataacacagaaatagaaaattatgctaaaaaactataaaactatggaagggataagtaagacgtgctccatgagaagagatagaaagttttgggagtttaggatttctggtatgaggaacactttatggaagaagtaataacttctttgggtggggagggaaaggtaaaggatgatattatgacttgggtgagtaattgagcagttcaattagataaggacaaaaaaaggagaagttttgggaaacacatccatatttattgaagttttgggagagaggaagaataagccaagtgaaagtccatgggatgggatcaagagaggtccccaaactggaacctgatgaaaaaattaaagaattactactgaatggcccacaaccaaacttaaccaaaccaaaccaccaacaaaacaaaccagaagcaaaacaaaacaaaaaaaataaaaagcaaaatggagaaggagtgggtcagagatggaggaggaaaactgtgagtgtcatttcaggaaactaa

SEQ ID NO: 74800 - DNA, 1021 bp, Homo sapiens
gctatataatatgttattctttctttttagaaagtattgatccagggttttatttacattatgtttgtttatttagtttgcaagtgtgtgacgttgaagcctggttgtatataaagatatgtattctgttagtgtacatggttattgttttcaggagggtaaaaaataataacaatcattgacttcactttgaaacactgttactttctactgtcaaagaaaccttgaatatgtagactgaggaggaattgttttaaagcaaggaaaaaaattccagaggaagagctagtttggtttcatagtacatcatctacttatctaccacacacacaaacacacacacatactttttttttttttttttttttcctcaaatgagctgtgttactctttagggatgcttgatgccattaatatgattgttcattttggttattaccttattagaaaggcaactgatattttactcttaaatgtacttaaatggagtaatagcatttataagactcctggcatatagtttcacttttcagaatcatcttttggctaaagaaatttaacagtgagattttaagtagatagctcactaaagaagtaaggttagtgccttggtttgaaagtagcattactttgcttgtaattgtttcactttaattgtattatacattgttttcttaatagttgtgatgtcatttttctctttattactaattttagatactccacacattccacatagattgagaaagccgaaagtaattaggtgcttgatcaatccaactcacctggaccaacaaactccttttaaactaatgatggtctttggggcttaggtgtatatatttttattccaattttataattggctatattatatgtctactgatttctgatttaatgatgaagtatagaatttgtcattttactgtgtgtttttttttttttttttttgacagaatctcactctcttgcccaggctggagtgcagtagcacaattacagctcactgcagtcttggcct

SEQ ID NO: 74801 - DNA, 1020 bp, Homo sapiens
agagtgcccccggaatgacctggagacaaggaatttctcacctgtcagataagcttttaagagagtgtgattgactcggccagttgtcaaaacaactgaccaggagtgcaggtacccaaggccttgtcatcttttagttccacttctgtatgagcatggaaacacattttccaacgacaaaacctgaaagttgcgaccttcctatttttcattcccgggatgctgatagtaggacgttgaagtggtgggggtgatgtccaggaacaccccgaggctggctgtgtccttaagtttgaggctgtggggctctggacagcggccactgaaggcaggttagaagggtcattatccggggccaggccacccccagaggagactcagcccacccaccactgtttacagtagcaatttggattttcaggttgcctctggagccatccagatggatgttgcatggaagggggtgatacagacgtgaggcagagggggccatggcgccagtcttcttagtgtaaacagccagcgtttcaggagtggagacagaggtctctaaaggtgctgaatttttcagccctggaggactggctagcactccttttgctttctaattatcacttgaataatcatgaattgctttctttaaattatttgtaacagagtttgctaaatcttaagggttgtgaattgcagcactgagcacaggaatgttaaaagctccaggtggaaaaaaatcactgatctagaaagttgtgaaagttctagactaaggtaacaatgagtgccaggaatttatttatggaaatttacttttatattacgggtaatgtcaactgtttgcaacttccaagaaaatgacacgttttgtctaatgctgatgtaagtcatatcatgctccttttccacatcagtattgtggaatgtctattgtgggtcagcaggagcactcctaggcactgtgaaagccttgtatacaatcctctccatttggatgcagaccagttaatgaaacagcaatgcttc

SEQ ID NO: 74802 - DNA, 1749 bp, Homo sapiens
gtgaaggcgttgccacgtttaaacaaatctcttttaatgaaagatggaaggttggggcgggtttagaatgaaaagatgctctacgtggctccgcgttcctcctgagagagatacccgggcaaccttgattaactctggactgcagggaagtgacagtctttgaaatgcctgagtgggatttaaactgaaattcgagtgtcctttgtatttaaaacccggatatttttctttcacggttgacatttttcatgtaccgcaaaaatccgagactcctatttaaaccggctgtggtaacagcggtggtgattaactagggtcttagtttgcaaacaatagggataaggtttagttccaccgccctgccttttcgcctccctcattcattggccaactgggttattatggagtctttttggaagtaatccactaatgctttgagcatctgtttctttgggttttattgttttgggcttttttttttttaatttttaatgatgaactatctgaaatatggaactctgtctaacccagtagtaaagtcatgccttctggaatggtttaaaagtgtgccataaatgtaaactataaatgggaactttaaatgtgtacaagttttacatctttattaaaaatcgtcagttttgtgtagcttaatacgaaaagatattttaagttccttttaaggttttaacaccaggatattgtaccatttaaatgtataaatatatttttaaaagtaggacttcataataatcagaataaaaacattccttcatccagtgctggctattccagcacccccattcttcctgctattgaacttttaagtgttagccaggaagaatagacttaaatactcggtgtttaggatagttaaaatatgagcatttttcatatagtgtctttgtaacagagacattggctatacttctctaagcctttctgctcatttcatatgtgctgtcaacaaatggtaatttttaaaaattgatcgctatatcctaatctctttatttttttctacctgaattattttcattggatttttgctctttcttaaatcagtgagtttcagaatttattgtgtatacactaccttgaaggatttgttcaacaatgctgattcctgcacttcagatctcagattctgaatcagtaggtctggaggatggcattgaacagtctgcatatttaactgaaaggttagaaaatactgtgagttttcaaaacactgatttgatctttcctagaaaggcattataatgtgttgattaaagacatggaactggggccagattgccttggtttgaagcccatctccaccacttgatagctaggtgaccctgggcaagctgtttaacctctctgcttcatttccctctaccgtatgatgaggttacctactttgtaggattattgtgaggattgaatgagttaatatatacaaagaccttaaaatagtgtgtgccacatagcaaatgatacataagtctccaattacattgagttactaaactgtaaaaaccgcatcacatacattctctcattaatctttacaatatcgctgaggtagttactatcttcaaataagaaaacaggctaagaggggctcggtaatttgttctcacacaactagtaacacgttggaactgaagtcggaaattagatttaactcaaaagtttatgcttttttaaaaaagtaatatttcttgcctctcttcagtctccctccagatgttgctccataag

SEQ ID NO: 74803 - DNA, 1035 bp, Homo sapiens
cctctacgtgctcacaacaatcttcccaaatagatgcggtccgttttgacctttgcttttaattgttgttttcttcatttattataaacagtatctgttgtcttgctacaatgaaatatgaggaatttaaatgattacactcttctgccacttctacctcatccactgtattttagatccttttaaattcactctaaaattaaaatattattcttacaactctatatcttgatcattacttttaaagtatcttttgacaccacattatgttggataaggaaatttatgctcctaaacctcttctactttctttccctgcttctacctccagccttctgtcagctatgctaatagttctgaaacttttagtacttcatggactacctctatgcatttgccaaatgcaaatacacatctactattgatactttttcctaagatggactgtttctttatttacatgaatgtatttaaggtagaaactttacttcattattgtaatagaaaccagtatcatttactacactagacaccaatcttaataataaatataatgaaatcaggacaattttaccaaattttaaacattaaaagcaggaaggtacaaatgaatataaaaataatctacttataaaaatgcatgcctgaaacctagtctgttctgcattcaaggccctccatactgggtagagggagacaaggggagagaggaacaaatggaaaaccacaggtccacagcatacagcagatgtacctccatccagggttcatggcaagagtttcccctcttctatagtttcagccagttcacaaggactcctcttttgtagactcagctaattctacataattctctttctcttgagctttatgcacacttgcgggtaaaagtgtaggtattggggatggagttaaggtggagcttactggtgtagaatgtccaatatgaacaaatggcaatttgctggagttaatgtgaacagttcccttgtatggaagggaaggaagaggagctgaaatcttttaaagggttag

SEQ ID NO: 74804 - DNA, 1047 bp, Homo sapiens
ggttcaataggttttcttgtaaataatgccttaatgattcagaattcagctagatttagagttagcctgaaatgtcactgaattaatctgaattgtctccatctgtattcaccactcctttttgttaagcttaattgtaggtgttctttctttctttttttcttcctctaacccacctaaccactcactgccttctttcctatcttttctttttctttctttttctgttacttcctggaatacttttagaaactaattaggatatacaaactgataatatacagtgccatctaaatcaaacaatgtaagtagcctcttactttgaccatgaaaaataactactatagataactacttgaaatttgagccattttatgtctgttttttattagactgaatagtatggatatatatttttttaatgcccaactagtttcttagagtttattttctaattgagaatatattcatagttgatgtcaagtggaatttggcagagaggcaaagaagaagaaggagtttatggttttctaatagaagatatcaggaaggaagtgaatagagcttctaaactggtaagtaaattattttactattaagtaatgtcataaatattgtcaatacttgggaagtcttttctatcagtttctgtactagaaatttatgactttgattataggtttcaatgcatattttgtcatttaaatatggtaagttttaggaggacagtttatatttttgcccattaaagaaagcttaattgaccctggataatacatgtgacaatactgacttcacttccttatcttattccaacatgtccatcagaattgaccatcagaattatgatctgatggtcaatcttctctgaccatcagaattatgatcataactccactctgctgttctctaaacctttgatcctgagtcaacccaaccatatacttttttattcttatacctcagtttctgagattggaatgttgggttgagttagaaattacacagctttccagactggcaattcatgatctccatatctcctga

SEQ ID NO: 74805 - DNA, 2224 bp, Homo sapiens
agcataactttttggagaccactctaaatccactgtaggtgtctcaacactttttcatttggtcagaatagagtgatcttagccttttttacaaattggtttatagtattttcctattcttcttggtgagtgttgcctaatttatgtgctttctcttgagatttcaatgaggtgtttatgtatatagcttttatgtttataaacccttcagtttaaaatattttagtaggaaggaaaaggggcttctctgtcttatccacatgttaggctagagatgttttctttatcgaaattgttataggagtgaatctttggtgtctttagattgtttctgggtagaacagtttttcaggaaatttatttaatatacccttaccacagctgttacatgatgaaataattttcagattccccaccaggagtatttatttatgtcttgatcatattataatactcagattttttatgttgtgacccctattttcacatactcttctagaaatgctgtgtttgcaagaaaaatggtgcttcaattggatgtgttgcaccccgatgtaaacgaagttatcatttcccatgtggacttcagagagaatgtattttccagtttactggcaattttgcgtgagttatttaactgttaaatatgaaagttcagtgttaaagaatagtggaaaatacatatcccaatgatataatactacaataaattttctgtttagagcatcagagtttagatataacattatatgtattaccctcccgcccacccttatggggtcatttctatgtgccaagtcttgagaattaccatgtctaggatggacctaatgattagctttcattttcaattttcagcttttggatataacatgaaattgttaatttatccataattcagtgaaaatctccacctttacataattctagatttctgtgtcactctttagaattattgtagacttattcttcacagggctgtatgcatttcgagtaaatcaaaggcatgtaaatttgattgagtacacaaagtaaatattatgccctaggatacccctgaaaatatttgcttcctgagtacaactttaaacatcaaggttttatgaattttgacttttggtatcataagtattccatttcttttagtagttgtgtttttgacctatttaatggattgttatcatgtaagaaaactacagtttagaaaatacaaatggaaataaagtgaattgggaataggttattaattgcattttatgtgttatatgactaaactattttttaggcgtaagttcctgcctcccttaattttatacgattttgagcacaacgtatgcacccatttgttgaatacaataatgtatatactgtattgctgacaatattacacaggattctcaacataattattagtttctgaaattctgtataagtaagtctcactaccagaaaagttcagatttcgaaggtccagctctctccttggtcatagattgtgagacttaatttttagtgccaaggctccagtctgttgtaggtgaattatgagacagacacaaatgaatttcattttatatatgtgaattacagtgttttccaagttttgctttgcagttcatgagatttttttaaaataatttacatttttaggtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggtaagatacatattttgtaagctttctctgattgatataaaattatggcttgctgatttaaattttaaattagaaagaattgacgtgtatattacctcttactacttgttacttttaaaacagctttaaagcacttaatttgaagcagattttacatacaaaattcaccctatttaagtatacaattaacattcaataaatacttcagatgaaactttttaatgtatatttatacttaaagaattttgttgtttttacctaaggattttgtttgatttcacaatgaataaactagattttaattcctaagtttcatttacatatttatgctggaaaaccaggatatttgaaatgataagaagcttgatagcaagttaagatatttaaacattagtaggcttttcttcc

SEQ ID NO: 74806 - DNA, 2539 bp, Homo sapiens
attccagcctgggccacagagcgagactccatctcaaaaaaaaaaagatgtaaattctcttatttcaataaagtcttaaaaatactaacagtactaaaagtagtaaagtttgactgatacctttttttttttttgtatggaccttgaacttttatacttaggattattcagttaaaagtgcaggatgaaggcagggcacagtggctcatgcctgtaatcccagcattctgggaggccgaggagggcggatcacctgaggtcaggagttcgagaccagcatggccaacatggtgaaaccctttctctactaaaaatacaaaaaaaaaaaaaattagctgggcgtggtggtgcacacctgtgatcccagctacttaggaggcggaggcaggagaatcgcttgaacccgggaggtagaggttgcggtatgctgagatagcaccactgcactcctgtctgggcgacagagcaagattctgtctttaaaaaaaatgcaggatgaagcctgttttgttggggaaatattagaaattcggttaatacttgcaaagaggtgtttataaaaggatcctagagagtgcagttaataaacaacattgtgaagtgttatccttacctgttcatattatatgagaatctttaaaaagtaatttgttttaattaagggtttgtatttggatgaatataattgctgccaaatgtgtcatcttgttaattttgtagcagtatgttatttttcataagatttttctcatttatttgttaataattaagcaaagaaaggttctcatacttgacctagtatcattaaggccttttgtgaacactctgaaaatactgagttttaattttgtcgttaaaaaagtagaaataatattactaacaaaaaagactaggtctactttatgcaaatataactgaagatcacagccacatggacacctgtctatgatgtaagaaatatcactaagcaattattattatactcgattagagcatactaaggatggggctaattcttgagtcactctctctaaaggagttccaataacttttgtactctggtatcggtcttaactgaaataacatatggagtcttatccaatctagatagctgtatgtggttaaacaaatgtcattatttgtaaccactacaaataatatacattgggattttgggagaagagactagagattgctatcaaagaaactggtaaaaactttccactctgtgtctacagaattgtcactatttttgttcagcttggatttttccatcattgctctagtcttgttggtatcttccatgtgtcttatcctgttttttctcctctataccagatacttccttttatcgtataccatatttagttaaagatcttggcatctgtctgcaattgctcaaatatcctttaggttcagagatttcaataacctgttgtttccctcccttatatgggtgggtgggtgggtgggtgtgcgtgtgtgtgtgtgtgtgtgtgtgtgtgtgtcacttgctaattgtctgaacctggaatcctctttattagcttctctcttcaccatccgtaaatcattccccaagtgtaatcaagtctacttagtatattctgtgtatcctttttattgtaatcctactctcactgctttaatttcagacactctttttggtaggagaccactagttggtctttctctagggccttagtccctatcaatttattcttcatactactgtctttaacttacctacctagcctctacttagttcagtttggcaagaatgtaatccttaactatattattaattgtattttcctaattacacattctctctcttgccggggaaacttcatatatattattccccatccttggaatgtcttttgtcctattttcctggcaaacctctatttcttcttctaaacttagcttttgctttactaaccctctgacataattatcagtatagacttaggtactccttcttgtttctttcatgtgtatacttaaaatactcacatacttttacacagtattgtagttttatacctgtatacctactcactagaattccttgaagtcgaagctgtcatgttttttggtacataataccaaatgttgtttgtatttttggtacatagcatggtgtttggcatctataaagcaggagttaactatctgttaaataaatgcatgctactagtttttactggggactggctcttctttccagtaggcttacagtttcctgtttccttctgagtaccctctgtctggtgcttctgtatctgtatttgctatagcaatgaggataggttttatacttctcccgttttgggaagaaagctgtcttagagattgagttaaaaacagaaccagtgatgatttttatgtaacatttaaaccccatttctagatgaggtaactcaggagtttcatttttttctcacattttaaagggcaacacaacatttagtaacattacacagtaagtaaaatgacattgcacaataagattgaaaaaaatatatgggtgatg

SEQ ID NO: 74807 - DNA, 1150 bp, Homo sapiens
tctcctaagtatataaaagtttttattttaggccaggcatggtggctcacgcctgtaatccctcccctcactttgggaggccgaggcgggcagatcacccaaggtcaggagttcaagaccagccttgccaacatggcgaaaccctgtctctactaaaaaatacaaaaaccagccgggcatggtggcaggcccctgtaatcccagctacttgggaggctgaggcagggagaatcgcttgaacccggcaggcggaggttgcagtgacctgagattgcaccactgtactccagcctgggcgaaagagcaagactgcgtctcaagaacaaaaaaaggtttttatttttagattcattcctgatcctcttatgtaacattatttataggtcaaagcatattttatatcttcttttatagagatgcttcctgggaattagaggaaaacgcttatcaagagcttctgcagcactatgagcgttgtgatgttcgaagatgtcgttgcaaagaagggcgagactataatgcacctgataggtatttctgaaagttcagttgtgcttagtggttccttgtttaaaccttctgctgagaaagtagattttatagttagtgaaacgtagtttttctcttaggatgttagaagtttaaattgagatgagggatattttctaatgcacatttacgtctgtttacagagaaatttttgcagttagtatagttgtaacctatttctctgttgtcttatcacgagactattttctagagccacactgtcctatctggtggccactagccacatgtggctgttgagcacttgagatttcccttttccaaattgcaagggtgctgtaaatacataccaaagacttagttcactagggctgccattaacaaaatgccacagactgggtggcttaaaataaatttattttctcataattttagaggctggaagtttaagatcaagttattgacaggtttggttttttctgaggcctccctccttggcttgcagatggctgtgttctagctatgtcctcacacgagttgtccctctgtcggtgtgttgtctacgtcctaatctcttttatttttataagaacaccagtcatttggtttagggcccacctatctgaccttattttactgtaat

SEQ ID NO: 74808 - DNA, 1047 bp, Homo sapiens
gagcagaatactgggagccttgtttcatgaaacaaggttgagtcagctactacttaattgtgaagattcagctgaggtctagcctgctctggaaagtttcctgttagcagctctcctcattcctgattccctactctgggctaggggttcccttcattgtgcttgttacaatatagttggcgttatttaaatttaatgctattaaaccaaaaattcttagaaggcagagatctcattgaaggtatcaagtaacatgtattcttgcctgtgttacttgatctagtgaccctgattattcattcgttaacaccaataatatctccctcaagagttttgctgaggcacagatgaaataatgtatatagaattttaagaagcaatacattcataatattgatatttttcaaatttattttaggctgttcttaacctatatgtatttcttgtataccattggtctctcaatcagtagctacaactcttctttccaggacaaagatattgtctatctgaatgactgctttgtaatctcacgccctctcatcctagtgagaagaaggcagttttagtgaaaggcagcatggttagtgcttaagagcatgtctgaagctagataaactgaaatggaatcctcactctgagacttggctagtgtgaacttgagtggacaagttattgacccctctgtgccttgatttcctctttataatggaagtgacagtggttctctctaccttctacaattgtgaggattaaacttttcatatgaacacagagagaactggacctggagcataataagcacttaggttagctgtttcttcctccgcactgttgtcactgggcagagacacacacatacacaggacagaaattaacatacgcacacccacacagagggatgatatgcccccacctctggggtagggatgatatctagttacctctcttgccactcacacacacggggagctaaatctgtttctaaacagagaaggcatagtcatacccaacaaaaaggctggagccctacactacagcccacac

SEQ ID NO: 74809 - DNA, 3258 bp, Homo sapiens
gatatttagagaagcagataatctttttcttcctttagtaaatcgattgggcgggtgtgtgcgtgtttgtgtgtaagaaggcaggccctgtggacattgctagtggttgaaactagaataataacaaaatgtaagttctgcttttctttgtgtcctcagcaaatgggaaataaagcgctgtcagtgttgtggttccagtggcacacatttagcctgctcctcattacggtcatgggagcaaaattgggagtgtttggaatgtaggggtattatctacaattcaggtaatttttttgtaattttgaataaagtttttattcaaatgtatatgatttaaaagtttttacctatatctctattatgctaacatggaaatttaaatctgtaggagagttccaaaaagccaaaaaacatgtattacccaattctaataatgtggggattacagattgtttgttggaagagtcatcacctaaattacccagacagtcacctggatcccagagtaaagatctactgaggtatgtattttgaattggagaaatacataaaaatctatttggagaaaattatgataggaaatgccatatacatttagaatattaggtgatcatacagtagtctagaagaatgtttttcagccttcaggacccaacatttgatcatgaaatcaatgcaaccagcattttaaagaaaatgaaatgggatagaatagaatacaaaataccaaactgcatcatacgtgggaaaagtgtatctatcctactgcatcatacgtgggaaaagtgtatctatcctaattatttttttgtgtactgagtaatgatgtaaaatatattttttattatagatcactttcaagatagtttgaaaaacactggtctggaaaatgtacttaaaatgttatttgattatagagtaagacaggaaagtaaaatatcaagcataccgtgtcaccttattaaaaggaaagaatcctatttaatatagaaatttttttttcttttttcttttttttagaaataaagtctcgctctgttacccaggctggagtacagtggcatgatcatggctcactgcagccccgacctcctgggcacaagtgatcctcccacctgagcctaccaagtggctggaactacagatgcatgccaccatgcttggctaatttttaaatttttgtagagatggacatcttgctatgttgcccagactggtcttgaactcctggtctcaagtagtcctcccacctttgcctcccaaaatgttgggattacaggtgtgcgccactatgccctgccattttttgatgttataatcattgtttgcctgtttactgtcaatggcaggagtctaaatgtcagctcttccctttagaaagtttaaggcatacatactattatcaaattaatttctgttcccatgagacaaaataggccgggcatcgtggctcacgcctgtaatcccagcactttgggaaacctaggcgggcggatcccgaggtcaagagatcgagaacatcctggccaatatggtgaaaccccgtctctattaaaaatacaaaaattagctgggcatagtgttgtgcatctgtagtcccagctacttgggaggctgaggcaggagaattgcttgaacccaggaggcggaggttgcagtcagccaaggtcgcgccactgtactccagcctggtgacagagccgagactctgtctcaaaaaaaaaaaaaaaaggtagcaaaataataagttactttcaaaatcttaaacatttaaataagactggaattacatctttataatgttgggtatttgttcagctgtagttaagatttttaagtttatatagatttgcaaaagagtttttagagccttgctttacccaatagggaagaagtagaaaattagtcgctaagcatgatgaaatactttcttgttaaaaataatttcaggctgggcatggtgactcatacctgtaatcccaacagtttgggaggctaaggtgggaggatcatttgaaccctggagttcgaaaccagtctgggcaatattacgaaactctgtctcaacaaaaatattttgagaaaatagccaggtatggtggtgtgcacctgtagtcctagctaggcaagaggctgaggtgggaggatcatttgagcccaggagttcaagctgcaatgagctatgatcatgccactatactctcacctgagtgacacagcaagaccttgtctctaaaaagtttcaagtttaaaaccttagaagatagtaaagagaatttttgtgaaaacatttgataactggatttgcagacaggtagaatattaagtactctttcaaaatgtgaagaatatctgttttactatgccacttgtgttagctctactgaaaaatctgttacaaatattgttataacacttttagtatcaaaatagatgttcacattattttaaaataattttaatattgagatttccaaagacgctacaccagggaagcttgactccttgctcctgctttaacatgcagtcatatttagaagaatagcatcagcattcccctgatccaggcaggagcaaggaatcaacctgctataaaaaaggtatgtttctgaagaattatcttacttccaaaggactttcgcttttattcaacatgagttaatgaagagaggatcataagaaaaaagaaaaagcaaaacctggcctacactagggcactgtaacgtcttggggtgggacagattcatacttggtatggaaaatgatccatgggcattgcccaaaacaagattatttttgagaacattaattccagttacagatggagaaactgagggaaggagtgattgagctggtttatatcgtcacttggattgttaaaacagattgctgggcttcatgccgacaggttctgattctatagatgcgctgtagggctcagtaatttgcatttctaacaagttctggggtaatgctgctgctgctgctgctgctggtctgggagcacactttgtgacttactgatctagactaaaaggtactattttaggaattgtgaattctgtttataatattagctctactgttaattatgactttatgatttaaaatatattgtgtaatctctcaaagacattttcttatatagtaaggagagattacatttgctttttttaaaaaaggacatagtaaatgtgaagtaaactacaattaagaaagttaattatagccattagccaggaaggtgagagtttgagc

SEQ ID NO: 74810 - DNA, 1394 bp, Homo sapiens
cctgtgggtcacactggtctcgaactcatgacctcaggtgatccgcctgcctctgcctcccaaagtgctgggattacaggtgtgagccaccgcgcctggcctgagattctgattcttaaaccggaattcactggttggtcaaatttgagataattatctatcaactttcttgtacatgattctaatttggtaaaagattggggtgaggaatcaagaatttaaaactaagattatcaaataactgtttttggttctagtagcagccattgttacaattttgggtgggaattggggaagaatatcctattaatctttttttcccctcgtcttgttttattggctatataactgctgtttcacataaagtactttaaagtacttatctctatatttaaattcatgttttataggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaaggtaattattttatttattgttgtatataccaaatatcacatgtatagaaaaagagatagatagctggttagaattgatatttaatacctgtgctctaaatatactgttcactttgttaataaactactgatagaatcacaggaaagtgggaagggggagtgatagtttaaaaagtaaattttgtggtgaaacattttttatttaagaatatacattctttatagcaatattctccttaaaataatccataattaagtgtaactttatcttaactctaatttcattttaatagagtggccaaatggggatgattatttgaattcttcctgtttgtatatttggaatttgcggttaacatagagtttttataacatagtttcctggtccacatgtaaccaatttttcagtatacttttgtttgcaatatttttttttttgcacaattatgtatatgatggttttctgtcttcactattggtgagaacttaaggtaattataacaggcatctcaaaacagtgggtaattctggcattctcttttaggggcttttatactacttttgctgtaataggaaatttgaaagaaaatgagaaggcatttcatttcatttgaatttcctactatattttctgtaaacatcctaaccattgcctaaagcatcatttttactctgta

SEQ ID NO: 74811 - DNA, 1039 bp, Homo sapiens
gtgctatgacagtataacatcactaggtcataggagtttttcagcttcattataatcttagggaccaccttagtgtatttggtcattcttgaccacaacatccttatatggtgcatgactgtacaccaaagtgttcacagtggttattatggtggtaggtttattgtgttttatgttttctacaatagatttttactttatattcagaaaaatgtgtctttttttatattttaggtaagatctatattttctacataatgatagcttctaagaattatatttatctaatgcttagatttttggactaatttttaatataaaaaatgatggttatcttataataatagaagtgtatttgatatattttcatctgtatttacagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcagggtaagcaatgtatctgtttattaaaatgcacactacattctaggtatcttttaatgtaaatgactgatctgcaataaaataatagtattatctatgaaggagttagggattgtaaacatatatttctgtttaccagtggagttctgaaccagttaaaagatagttttaaaagtcagatggctggagattaaagtgccacgtttaatgttggtaaaaccagttggataatgtgattttggtctgtgttcaccatggcttgtgaatactcctcagaaatacatggatttgcctgccttgctagagacaacgtgaggcagattccctattgcaagctagaaagcagatgaaagtgcactttgatggaggccgatgggtctgaagagaggaaggatttggcttaccagttagaatacttttccttccttctatagggaggtatgaatgatagatggagagaaagactaggctgaatttc

SEQ ID NO: 74812 - DNA, 1009 bp, Homo sapiens
acccacaccaggccttttttttttttctttagaggggggctagctgtgttgcccaggatgttcttgaacttctggcctcaagcaggcctcccacctcagcctccctagtagctagtcttacctagtgctatataatttttcaatgtcagttatttccttttttataaatagtttcacgtagtaaagtggcattatactctggatttcttgaaggcagaaatagacaaatttgttgaactggatgatcagacatttattctagaagaatatttcttggtttacttttactgcacccatatgtactaagaaatttgagtataaattaacaagtatcatttgaaatgtgcatgtcactcaaaagtaaatgagtaaagtggctgtattttctccttcattacagataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaaggtaagttgtttctattaatatatggctctttcaaattacatgtttaaagtggttaattatcttgtaatgtgagatatatttggtaataagtgagatgtttttctcagaaaaaaatttaaatgctatttttaaataataacttaagcctttttaggatggttactgttctgatcatttaataagcattgtgtaggtcgggcatggtggctcactcacacctgtaatcccagcacttcgggaggctggggcaggcagatcatttgaggtcaggagtttgagaccagcctgaccaacatggtgaaaccccgtctgtactaaaatacaaaaattagccgggcgtggtggtgggttcctgtaatctcagctacttgggaggctgaggcaggagaattgcttgaacccaagaggcggaggttgcagtgagctaagatcatgc

SEQ ID NO: 74813 - DNA, 5815 bp, Homo sapiens
acatgggttttaaatttttatgtaatgaagatttatcactcttggtaatatctgggaaactttatttttataataattagctttgaagtgtaaaacacttcagattttgatgtctttcttactaataaaaacttgttagttttgaaactataaagccaaataatgtaggtacataaaatattcatttgatattaatgtatttgcttgttatggatttgaaagtatcatgtgtagtatatccatatcttctctttttcctcacatctgaaaatatgattgtctcttgtgggggttttttggttgttttttaaaaatcattagctgttttgaaaacatgccagataaaatgctggaaatattccctaatataataccaaacacacatgtatgaatgttggctcattatttttcttctcttaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaaggtatgtggatattttattttacttttaacgatctcagaatatttgtttcagcatatttgttgggggttttatttgtgtatgttttgccttttggtattaatattaagatgctaactccgtatttacaaaagaaagttatttcaaagcaagtttatatgactgaattaaaaataatgagaaaagattacagagtaaatttatattttgtaatttttttctctagataagtttaggtgaaaggcattctttctagaaaacattattgtcaccgcatagaacagttttaatcctaataatctatttcatcattttcaatttgaagttaaactaaattattcttcacccactggtcagggctataacaatgatatttatcattgagcattagcagtgtaaaatcattctgcctgatagagtggagaagaatttaacttatagttgaaattttgtttagctagatttttggttttttaccgtttagtctttctgtctgtatttgttatatacaataagtagttgtactaaatgattgtattagtccttctactttgagattcatttatgtactgtttgcctgttactacatctgactttgtgatttagtttgcccaaaacaaatgtgggagtctgtgcctttcagtattccaagtctatttggagaagaatctatgatgatagcaatatataacatggatttacttttgtttcttttactcttttattggtaaattttttcagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggtaaactgcctatttaaactaagtaattttttgggatttaataagattaagattctgacgaaactgaaagatacaagattcctttactctccacatttgagagatcctataagcaagcagttagtgtctgacacccaggaacctatagaaatgagggaatctgtgttaaaactatgtatcctctaatgtaaaatagcttaccagaataaattatttaagccaaaaatctggactcagataaatggctatagtaaattaggttaatgaacaatctgtagccatagattattttcagtctttctgattctaataaaacaaataccttattcagtctcagccttacaagggctatttgtctatggttgctgttcttctgtgaggtgtatttttctataaatttattgcccacattctgtgcacttggtcaggagtttttatcatttcatatatatgcagtgtacatcaattttaaaattgtcttcgtggttttaacatgactcatagtcttgggagagaatctgtgatggaactgaagtggctcaatgatggatttgcatttgaaagtggaagtacccaaatgagcaaaattgggctctcagacattttatatttcatagagactgtagaatgcagtagaactttcccatagggcagaaataatttgtttagttggaacacacctagatcattgaagattccttcaaaatattagtaatagtactgaagacacacatgtattccagttaatttcttaatgaatgtgccaattagctataaaaatgagattacataatttttttttcttttttgagacagaatctcactcagtcacccaggctggagtgcagtggcgcgatctctgctcactgcatcctccgcctcccaggttcaagcagttcttcct

SEQ ID NO: 74814 - DNA, 1148 bp, Homo sapiens
atctccattttacaggtgaggaaagtaagatagaggtaaactaacgtgcctgtttcttgctttgcctgcctgaaaaatctttattggtctcctgaaaaatctttattgatcttttgaaggtcatcccacaagccatctcctttcttcctggttcactgtcccctctatccataccttcagttcaataggtagaatcagttgcctcctgctccgtgttactgttgttcttcattgaatgcgtcttcgttacaggttcttgcacatcttcccagcttctcaacattgcagggtcccattagtgttctcatctagcgccttagctttcagtattatctgtatgttgatgattcccaggtttatatccctagtctggccgtcccatctgaactcagtctactccatatcagttaatggcagttccgtccttttagttgttcaggtcaaaaaccttgaagttttcttgacttgtctctttcatgtctcatgtaagatctttcagtaaatcttgtcagttctactctgaaaatacatccaggatctgactgttgtcattgctattccgaggtcctgtccaccatgaatttctgcagtaacctatttggtctctttgcttttacaatcctgttctccttcattatttttcacacagtacccaaactgatcatgccatatgtttgctcaaaatcttccagcatcttcccatttcaaccatgataaaagccaaagtgatcttacagtgttctacaaggctttatacgatctggtttccatgtagcttttggacctcactccctatttctcttccctctccttgaacccaccaggaatgctcccaccttcgagcctttgtatttgtttcttctttgtggagtactgtttcagagataatctccatggctcactccctcacttcctttaggtctttactcaaatgttaccttctcaggaggctttccccaattattctgtttaaaattacacctcaactccatcttcccctttcccaatcttacctttcttcaaagcacttaccatgatctacataccatatgttttactttttttttattttattttttttatcccccaattagaatgaaagctacttgaggacaggcgattttattcactgttttgttcagttgcta

SEQ ID NO: 74815 - DNA, 1050 bp, Homo sapiens
ctccagcctgggcaacaagagcgaaactctgtctcagaaaaaaaaaaaaaaaaaaaaaagaaagactgatctttctcactaggccactcacacttaaaaaaaaaaacagacagacagactgatccttctcactagaccactcagacttaaaaaaaaaaaaaaaaaagacttaccttaatctatgctttcagccagacagtacacaggcaacagcatcagtatattgaggccattgcaagttcttcctgaacatttcccgcgatttcatctgtggacagatgcttattgtgttttgggaaatctcccaaatacatgtcaattagctgtcgatggaatagtcttacaagatctgacccctagttctacacatatagtcatttggttaatcagttttactagagttgattagtttattttgctttggggtagtgaatgatgatggaggaaaaataaaatcctaaaaaacaatgacaatatttgataaaactttttattttcagtggctttgaagcgtatgttgaatttcaatgtgcctcatattaaaaacagcacaggagaaccagtatggaaggtaagagtttatcttaatgggaactgatttctgtttttctcagcccttattggtggtaattggagggaatttattgtaatatggaagaagtaacacatattagttatcatgaatgttttatccttatttaacatgatctcttaatatgaattgttttgacagacattctatggagtgagacaagtgataaaatagtaattttcatctagggagtccagttgatctctttggtaggatgtcactgataggtctttttcctggttgatattttgttccttagcttttcaagtccagactttggattttataagcttgctcggagttagtcacattcagagggcctggattattttaacaaactcatgagaaaatgatctgtaaactgtaataccactttaataatttatgagatataaaacttaattgaaccagaaagcaatctacaatcttttcctttgagaaatactggagagccttta

SEQ ID NO: 74816 - DNA, 1101 bp, Homo sapiens
aactggcagcatttttatttctcagtagtatataaaatatattttaaaaattatgttttaaaattgttaccaccttgggtttcatgaaatacggtatttgatgagttttcctttcatttttatgtcagactgaaataagcaggtttgctttgataatgtgttaatttttatggactgaagtaaagtttaacttcatgctatccttggaaattgtggtttattaataaacattgagtgccattgtctctgtactaagtgtttaactcctttatttactaatggaaggactgaagtttagaaggcttaagtgattgtctcacatttgtacaaccagttaataacagagccatggccacattgcttgaccactaattctgtgctgtttatctactgaactgtaatggctcagtaacagtaactaacagaagtgaggccttactcagtacttcattcaggggtaataggatagtctaccagtttgagagtctcgtaatctctgcctaacttgctacttgccaccagagcatggaaatattacacagctaccatggtgaactcttgtgtactttgcctccaaccattctcctctatttgctggagaatactgtatcagttactttataccctgcaagctggtttaggctaatttgtaggaaacagtaattacaagtttccacagtatgaaatggtggttgtagcccattagacagttggacaagcagtgtgaaaaagaccacaacctatggcagccatcacattatcattcttgatatcagtggcaacagttattaaacacagactcactggcagcatgtgcctctttcctctctctccttgattatagaaggatgactagagagaggtgaatattcctcatataagcatggtttgatgttgggatatttgtatggaaattgttcctaaattgtaaaaggagaaaactgtaaaatgacttaatctataagatgcttacattctcttatgaaacaataaatagacaaaaatagattgtctttaatttttaaggaaacatttatatacctttcatttaaaaaatatatttgatttcatgtttggttaaatttttttatagcttctaaa

SEQ ID NO: 74817 - DNA, 1023 bp, Homo sapiens
ttttttcattgcgtcccctagctttctgattttcccctcagagagccacactttcctcacattcacccttcccctctgaccaccacatttctatgaaaagtgggaataagattgattctgaatatgttttagttctcattcaaggagagtgttggtagaaaagaatgtctgaccataagcagtgctaaaagtgtgagcagaatagaacaaatgaagactaacaagaaattagggtcttactaatgctaataaataataacaacactgacatgggagaaagataggttaactcactgattaattgcaacaagagcttttagagcactggttactgtccttgagctagtgaactcccattttgaggaatattgttttaaataagtgaataaaaaaataagttttagttccttatgtcttctaggcttttacactctgatcgagatcctattccagatgttcctgcagtatactttgtaatgccaactgaagaaaatattgacagaatgtgccaggtaatatgggttcttattttctggactcctgaatttggaaatggatttttttttcaagaaaaattcctagatgtccagggtgaaaaatcagaaattcctatgcctactttctcactctgatttttgagactatctttgaattccaaatagcctgaaagacttaaaacttttggctgaagaagtattatacagtagtcctctcatgtccacagtttcactttccacagtttcagttatccacagttaaccaggtactgaatatattacagtattttgagagaccacattcatataactttcattacagaatatattttctgtaatatatttcattacagaatatattttataattgctctattttatttctagctattgttgctaatcatttaccgtgcccaatttataaattataaattaagttttatcataaatatgtatgtataggaaaaaacatatacggttcagtactacctggtttcaggcatccactggagtcttggaaaataac

SEQ ID NO: 74818 - DNA, 1974 bp, Homo sapiens
ttagctatgatcgcgccactgcactccagcctgggtgacatagcaagaccctgtctcaacaaaaagcaaagtattgtggtgcttgcttcagcagcacatatactaaaaaacaaagtattaggaattgtcaatattagcatactattattcatatcaaaatggcatatactggaaagtagtagaatattttagatgtatacactggtatcaagagttatgtaatttttttatatgtatatttacagcttccagaggcccttattagtccttgttgacagaaacatagatttggcaactcctttacatcatacttggacatatcaagcattggtgcacgatgtactggtaagagactaaatgcagcacttattactgaaatatagtaacatgcagtgttccctttaatttaaaattaacatcatggctacagaaacaaaaatgagaaggatggaactgagacctatgaacaaaacaagtgatgggatttggtattactgggtgtggatgctggaaaatgtgaagcattaaagtttagtttcaaatttatgatctttatagggtaaagtagtggttttgttggccatggaaaagaaggaaaagaaaacaattgaagaaaatggattattttgttttatttttaattttctaaccgaataagtaaataaatgtgttctcccttaggagaaaagcagtaatttctcccttttctctgggagtcagttaaacctcattttacgttaaaaaaaaaatagtattttttatgttacaccatatgttttctgaagtaattccacatatctgattttatgcttatagcaaaaatttgtatttatgcatatgtaaatttagctgctaagtgttgtgtttagcatgtgacatacacaggtgataaaacacggcttcagtcttcaaagacaatggaaagaaaataggtacacaaataatttctctatgagacactatgtaatcaggccagaatagtctctatttgatagacagacgttaaagaatttgaactcaaatcatgggctttgttaaaactaacactgtagtttactaactcctagctcaggactctagggattacactatataatcatatcatgatagtaaagactgcccaacatgtcatataaacagggaatgaaagctgagtgtagtggctcatgcctataatcccagcactttgggaggccaaggcaggcggatcacatgaggccaggagctaaagaccagcctggccaacgtggcgaaatcctgtctctattgaaaatacaaaaattagccaagcgtggtggcacacgcctgtaatcctaactatttgggtggctgaggcttgagaattgcttgaacccaggaggcggaggttgcagtgggccaagattgtgccactgcactccagcctgggtgacagagcaagacctagtctcaaaaaaaaaaaaaaaaggaaatgaaagacatgcaatagatgatttggtttatttctttaaaacctggatattggctctaaagtgtttatttaaataaatcagatttagaattactgatggaaattggccattcttctatgccatgactctaggatgagtgtcgaagaaatagcagtcaactttaattcagtagacagggcaagaagaatcaaagggactcttaaattaaaccctaagtagtagaacatggaatcaggctttaggaggtcaagtaagaggtgggagaggaggaattcagttctaccaatatttgagtgcctactctttaacacactttctaaaccctggcttcaatagtaacaaaaacaatagctttcctgtctttctagagcttacattctagtaggggaaacaggcaataaagaaaataaaacttgcagcatttcagaaggtggaagataccctgaaagacagtaaagtagataatggtgaacaggagtgaaattttaaaacagggaagttctcactgataaaatgacatttg

SEQ ID NO: 74819 - DNA, 1048 bp, Homo sapiens
ccctagttttaaatagattctcccttgtattttatttctcttgttggttaatttgatagtggaagttgaagactcaccttagtgtgtcacctcaatatgaaaattctggcattgtgtttatgactccaaagtacatctgttgaaacaatagatgtttaatgattgctgtaatagcatttagagttgagatagtaaattcttgccaaaataaaagatatttttattttactttccttttctttgcctgtgaactgcaagtctgcataaataggtattgcctatattatccagagattattttgttaacattaactctctctggctctactgattgctctaacttgggaaaagaaaacaagactgctgaaggcttctacatgtttttagcatttcctgatgggatctatttatatgtagtgatttggggcacctttgtcctatcttctaagttaggaaaatgtgactgtcaatggaaacagattagactctatcatgttaaaactaattctgttgtcttatttgtgtataaacgttcagttgctttaacatgattgagtacagcacaggatgttttaatttcctaacttggaagattgaaattacctttatttgccttactattatgcaaacaatggaaatatccttgctattaaattacttctcagaattcttaacatcttttattcctttattattttgtgttttaagtattccatcaatacttcagtaataacatgctttcctacttttagagcagtaattttgctagcaagttaactttattttgaatgagctgtgtcatcaccatggaaatagtacttcactagaaattctagttaataaaacttaactgtttaaagatgtttctcttcaatatcttttattttgttagatagttttttaaatctaaggttctttccagatgtagctgttactgtttaaaatagttttccacaattgtgctatttttactttctctctatatggatgatttttgtgcaaagtgaagtttagatacgaggatgggaaactgagaggattaagtaaa

SEQ ID NO: 74820 - DNA, 1056 bp, Homo sapiens
aaaattggactgtgttcctcagaatcctttctgagctcctgtcttttctgctagtctccattggataaaatgtgcttgttattagagaggtattttcagatgtcagagctgaggaaggggggaaaggtttttgttcactgttaatgagacatgaccttttctttcttaaaggagaaaaggcttctggcctccccctaggctgtagatgaaaaatactcattttaagaaacatttaatgatcaacatgtattcacctagagtttgtcaagattagtacagtgttttctacctgagtgctcatgattgcagatcacttctgcctaaagtctatgtaagttactgctaaaccacaatgtcctggtagaagacatcaggtattaggccaccaaaactgtggcccaagtgctatttttaccagtagtgttctgggatattatgagttctgagttacaagaattttttcacagttacttgcaggtgatatttttaaatgctgtctttgtagttgcatggaccctttgacatgacgtgttaatttggatgggaatatttaattgatatttgatataacatgacttgtcttccattgattttcagtcatgtaaatattttactttttcttctaaaaacgtataagtgaagagaatgtatgatactgttaatgaaaaatagaaatgaaatttaaattttagatgtatattatatgcattttaaagaaatagtattatatagatatcagaaagatatgtagttgtatttgtgctgaatcttttctgcctttgttatatataacatatattcaaatccaaataagtatatttaaaataataaatgttcattgtatatattttagaatttacacaaaaattggtcttttaatgtcatcctcatagttcttgtgcaatactgttttagtccattcccagaagttgcagaatcagttcagcaagaactagaatcttacagagcacaggaagatgaggtcaaacgacttaaaagcattatggtaagattctatttgctttctaagaattataggaaagaggaggattatct

SEQ ID NO: 74821 - DNA, 1756 bp, Homo sapiens
agtggtggtgcacgcctgtagtcccagctacttgggaggctaaggcaggagaatcgcttgaacctgggtggcggaggttgcagtgagccgagatagcaccattgcactccagcccaggcgacagagactctgtctcaaaaaaaagaaggagggaggaaatgtgttttagaaatacagataacgcatgtttccattaatttgattttatttaaacctccaaaatttggaatcagaaagtaaagtgatagaaataatgatatttgggagccagattattttaaaataagcatttcacctgtattaataaatactgtaggtgttcaagtctagagattaaattagttgatagtttaattcgtcatcttgttactgtttcactgttctgagtttccacaggggaaacaccaggcatgagataaagtctatgtcattttagaaaatttattggttaatatttaattttttgatacttgcagttctttgccagaactccttgagaaaaaaagacttattgatctccatacaaatgttgccactgctgttttagaacatataaaggtaaatttaactttttcccccccacaatatgacttgcatttacatagggttttatactttgtaagatgctttagtattcattatcttattgagtccccactgtaacatgaagtataattatggaagacagcagtattatagttatttttttgcaaataaagtaacctaggaatccagaaagataagtgatttccaaggtcacatgtttagtaaatagaagtgggaatctatgatatttctattatattgcactgcctcaatatcactgctgtacatactactgtattaatagtagacttgtatctcagcatcagtaatagatttggaaatctcttttaccagagttctatctaaaatatccattaataacatcacttttatttatgtgactttgttctgaactttttaaatttagagaatctgttaacattgaagcttcttactgtgtatcattgaactgtgattttgaaacaagtatgttgggagttctatatattgttatagttctttttctcattaccgtgttcatgattgccccattgtcagcttacttaatcagtccttcagtattctgctattatttgttctccacacttggagctgaatttctgtggcagattgaccatatgctaaaacttggctaatattgacccctcctttccattttatatgatgcatttgaaactgtttaaaaagctgaatataattgctggctgtcagagaagttgataacacctgggatttattgagaaggtacttaaaggtattatttaaataattttaaaagccacaaaagcattagaaaggcactaacatagataatgggcagcatgcagtttaaacctgcataattactattacgccaacaacctaatttttttctttgtttcacatcttggtacttgatatttttcaggttcatacaggaatagaaacagaactgcagtctgtaggtgattctgctgatgttttcacttctatatgtagtgtctctgtgaaatggcaaaaggctgttcagatctgtttacctgaggtcattgtctcttgtggaggtgatacagatacagatatagatgtatagatatatcaccaggtgaaatacaacagagagctatattgagaatttccttcaggtcggagactagaacttatagtttgagaaaattttggttaatttacttattcaatcatgtttatt

SEQ ID NO: 74822 - DNA, 1050 bp, Homo sapiens
tatatattttcaatatgttcatatggtttgaactcctaaagcaaattgtccaagttactagctttaaattggttttttttagcattagacaatcaggaaggcaaggaattctcttcaaattataactcgcaaaaaaaaaatatagctaagactaggaaattaagatgtttattttgagggcagctctttatttttgtattttttaataattattgactaatcagagtattttaattactattttattgttaaataaaattgcagctgtgatacccatggcagcagaaattctcaagacccttctgtttagtgaaaacaaaggtggtaggtacagcgagcatcagcatgtggtgtgtaatcaggtaaatattttatcgataacagattggagaggcactttgtacttagaatggtccttctcttttgcccctacctagtcttttatcacgagtcatgaatacaggatcacagtttgtgatggaaggagtgaagaacctggttttgaaacagcaagtaagtacacttgttagaaaacatactggtaacttttaaacataaatgttgacaggctaactgctcaggtaaagcaactcctggatttattcaagtaataaataggaatcataaaatcaaggagttcctttttttttaagttctggggtacatgtgcagggtgtgctggtttgttacataggtaaatgtgtgccttggtggtttgctgcacagatcagcccatcacctaggtattaagcccagcatccattagctcacttccctattgctctcccggcctcctacaggccccgatgtgtgttgttcctctccctgtgtccatgtgttctcattgttgagctcccatgtggtatttggttttctgttcctgagttagaaatcaaggagttctttattagtgtatttaagactctgagggtattttttacatgtgtagctcagagctctgtaattttatacttttttaaaaaaaaattgttcatttggatttggactttacttacattttgatttgtatttaccatcaggttgttgaaa

SEQ ID NO: 74823 - DNA, 1067 bp, Homo sapiens
gagaacttttataatccacagagaggaaatgaaaaaaatacagtgggattctggccaggcatggtggctcacgcctgtaatcccagcagtttgggaagctgatcacctaaggtcaggagtttgagaccagcctggccaacatggcgaaaccctgtctctactaaaaatataaaaattagccgggcgtggtggcaagagcctgtattcccagctacttgggaggctgaggcaggaggatcacttgaacccaggaggcagaggctgcagtgagctgagattgcgccactgcactccagcctgggcgacagcgagtctccatgtcaaaaaaaaaaaaaaaacgggattcttgtttgatcaaaacaaaagcttgcagttactagtattaaaagcaaacacccaacaaagtaaaaagcccaaacatgtatttgtactaaaacctgaatacacctatacatttaaagaagcattttacttagaattatattttcctgtggaaacttgagtagtgccaagagtatttacatctttgacatcacctttaccattcacagactacttaatcttagaatgtgtttaattgaaaggtaagcatacttaactgtagaatgatcaggttgttttaatagagaagaactttggtttaatattctaatatttaacaaaatacttttccacagaatctacctgttactcgtattttggacaatcttatggagatgaagtcaaaccccgtgagtaccatataacatattttgtgtaaattcccgaatgtgtcaaactgactagtatgaaagaggataaaatcagattgagttccttgtgagcttaatcacagcagaatacatgaggaaaaggaagagtccatgttctcaagaagccttttttagccattatcacggattctgggaattggttttctcagctgccatacccattctggccagctctcattcaaatgtcatgtagattatatcctatatgtataattaaatgtaaaatatatcctaaggaacaaatttctataaatgaaaaaagaaccagtgagcatctgttgatatagtataaag

SEQ ID NO: 74824 - DNA, 1050 bp, Homo sapiens
ccttgtaagtctggctggtagtggtttcttggagcaaagtgttgaaggatccttacactatgtttgggtttactgagagtgctatgattgattagcagtgtccaccccattgggtacaggactaaatagtagcaacatgtgtagcatatttgtcaagaatcaggttttgatagtcctgtcaacactccagaagagaattagtttctctggcatggtaattaagaacttgggcattgaaaatagactgcctgggttcaaatcctgtagttcccatacttactaatcatgtgactttagaaaagttacataacttttctctaccccagactgtcaatctgaaaaatgagggtaacagtaacaacctgatagaccattattaggattgagtaatttcatctaaagcacttagaataaaggttagcacatagtaagtgctcattaagtattagggatggttgttatacattctacaaaattgatagattcattaaaataggatactctaagccaaactgaccttctgaagagaaattccacagtcatggtaaagttctattttttttaataggaaactgatgactatagatattttgatcccaaaatgctgcggggcaatgacaggtaagcagcttttgtcttgtttaacttgtggattttttcccctcgagaatggaaataatttttttattatatagtactgcttattaaaaatccaaactatatggaaaactcgtaaggaaacaaggatgtataatctcattatccagagatatctctagtaatgatacttggcattcagatgtttttccttccacatatacacacacacaaatccatttagacgtttactggtgtttttatgaaatggtggaggtattagaaactaattgtgggtgagggaaatttcgataacgtgtttttaaatgaatattcttattggaccaattgaaaaaaataggagctttatattggataccagttgtttggttgttttttatttaactggtccataaaattaaagtcactgggaaccattgctatgtaacacct

SEQ ID NO: 74825 - DNA, 1760 bp, Homo sapiens
tgtgttgctcaagtgagactaaaagcacaatccatgccacctgcaccatagcccactttcagcataaagaaactcgaatgtattcttcaagtagtacacatcctacattggaagaatgttgttctaagattttataggtaactgttgctcctgtgaaatttgacagtgagattccttctatttttagtgtaataggaaatggcaccaatagtatgccatagtatatattttgggggacaaaaatactatgctcatttcaccactttattcctctttatttcatgcaattttaggtagatgtgtatactaaaatccaacagtatcccaaagaaagactgttaagaataacaaaaaaactagcatattaatctcttttcttgggaatattgaatatatttcttgttacttgtatctaagttctgactctgatttttacaggggaaacaaggcaaacacattttatatggctgcagtgagctttttaatgctacacagttcataaaacaggtaaagtatacatttgttgtttgtttctgttaacatacccctagttgctattggtatttttcaaaagagagaaagaaaaccacttactcacctgaaccagccgaaaccaaagccatccagctataccaagataaggtgttttcatggacgactaagaaaaccttgataagtaataatgtttccagtaggagtttgcccatccttccagaactgaaagccttttctttggcttttaatgatcctttagaaatacaaaaatatatgagaactgtcagtagtgtgtcactcatgacatttctctttatattgtcacaaagttagcactaatttttttaattcccagggtttttcttttccatcaattgaacgttacctaataatgtttacatttctttactatgacgacgtttattgcaattccattttcttttctttttcttggtagagacagtctcttgctatgttgccaaggctggtctcaaactcctggcctcaagtgatcctcccacctcagcctcccaaatagctaggattacaggcatgagccaccatgaccagccttcagttttaacatttgagttagtggtgaacattaagatttattattctaggaatgcagtgaataaaataggaagtgtaatttattaaggggtttacaaatatgtttgaatgtttcttttatgatcttttttaaaagttttatgtatgattttgtgttttgttttagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaataaaatttcaacattgttcattttctctgataaatcagaaagtactaatataataactaataggttatgattgaagctggtgacattttaaggttatcatatttaaattttatttgattggttcgtgagtcccctacttgtatgcattttaattatacaactactttctcatagtttgttgggtatccatgttgcctatagattttagatggagattttaagccactttaagttcccttcttctggcacacctatgtatattttatcacataaagtccctccttcatgtaatggtgatcaaggcaacactaacatga

SEQ ID NO: 74826 - DNA, 1170 bp, Homo sapiens
tgaggcggagtctcgctctgttgcctaggctggagtttagtggcacgatctcggctcactgcaacctccgactcccaggtttgagtgattctcctgcctcagcctcctgagtagctgggactacaggcatgtgccaccatgcccagctaatttttgtgtttttttgttttgttttaatggagacggggttttgccatgttggccaggctggtctcgaactcctgacctcaggtgatctgcccatctcagcctcccaaagtgctgggattacaggtgtgagccactgcgcccagctgtgaaggtatgttttgaactgatgctgaaaaagcaccaatatctagaaaagatgctggaaatggcatctttctctttcaaggacagctctattcattccctcagggtttggcaagatagctctctggagaagcagatagggctgaggaccatttgtgcactaagggttacctgtcctaggtctaactgctcctaataattagattactgctgaggggttttcttacatcctacaaccttacattatgatttagaaacttcagttatgaaaatggcacctctttttatatatcagtcagaagcagctatgatatgggctccagtcttttgggaaatgaggcaagttataaacctgtcttttcttctttgtaattctagcatccctagagtatcttgcacataagaggcatttaatgaatatttgtttacttgaatgaatgaatgaatgaggccatatggccacactggatttttgaagtagtcaacaaatgagggtttgtgactagaatctgtcctcatttatcacctgttcttccatcaaacatttgctttaagtaccagtgtctgctaattaatcttgggtattaagcagacatataccttgacaagtcatcaggctgaaataatttggtgggagtatttctaagtcactcagttttctgccctcaaactcctcgtttcaaatggaagaggttctagatttggatctcaccagttcagattccaccactcactaactgaaggaccttgggcagtggctgaattctggacttgcgtttcctcatctgtaaagcagccatagtgttatacattttcctgggatttttattaggattaaatgagctaacatacagagcacctaacaaagcccctgag

SEQ ID NO: 74827 - DNA, 2712 bp, Homo sapiens
gagtcgattagtggtcaggggttggaggggcaaataggagtgactgcttaattgggtatggggtttccttttccagtgatgaaaatgttcggaactctagagaatggtgatggttgtgtaacattgtgaatgttctaaaagacacaggattgtgtactcagatgtttacagtggtaaattttatgttgtgtatattttaccacaataaaaaagttgctataatgattgttttatgttgatgctatattgtagtttctgttgtctcgagttagtatttgtgaaaacttaatcagttctctgttatgttttgtttaggtaaaatgatccattctatggtagctcacttggatgctgttacaagtctagcagtagatcctaatggaatctatttgatgtctggaagtaagtcttaaagtcctgtactgcccacaaactttataaaagattgttactcagtaacaaattttatttgttcttttacaggccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagtttttttttttctcttcttcttcttcttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagatttcttagtgagtccttcatttttatgctgttctttcaaactttgtcctacttattgatattctaataagagtagatcactaacactattaataatgtctaagtatttcaccccacttgaagattaagaaaaagtcttgcattaaattatgcaattcaaaataacccccagaaatgcacaggtgcagttttaagtaatttgcttagacatcctgttacattattaaatctgaatttcaattaatggcagtgttgttctatttgccatacctgttcccacaaaaaaattcagcaaggaataaactacattgaatatttaggttagttggtgcaaaagtaattgcggtttttggccgggcgcggtggctcaggcctataatcccagcactttgggaggccgaggtgggtggatcatgaggtcaggagatcaagaccatcctggctaacacga

SEQ ID NO: 74828 - DNA, 1672 bp, Homo sapiens
ttttgcttaaaagcttgggtggacatatgggaaaagaggaatgtctagagcaatatgaaggtgaaagtagagaaaataacataatgaacttaatgtactcagcattcagttttaatacctatctataaatgcccagtattacacatgcattatgtggtgttttacagtttatttagatagggatcacataagatttatgtattgcagttgtttgataggtctctcaggtctctcttcatccatagattccccttcatctcttttatgttcttttttttttttttttaattgacgaaattggctactttgtcttgtcaagtttccgacagtctggattttgctagttgcattcctgtgttatttaatgtgcttctctatttctattcacagttctcctgtgaattgattatagatctaaagacttattcaaattcaggttcactgtttttttcttttaaaaatttttaaatgttcttggcaactttacttcataagtaatttgtaagcttttatcagaggtgagtattttctggttgttcatgtttttgtgatgttttcagtctggattatttcctgggttcattcattttctattgaaagattttctaattttatcattccctctccatttattagctagattattcctataaaaaagaacatctctttatcaacaatttggttaccttggagttagtgtgtattaaggaaaaaggcaagataaatgattgggttttggttttcccctttatttaccagtttttaaaataatgagttggtttgctagcaccctctaaaggtgaccagtttgtcttgggtggtgtttttggtatcatcatactctctcatggatataaatgtatttgatgtgttttgatccattgcaggtattatctttatttattgctgttcagatcctttgattttggccagtggggcttactcagtggggctcatgttggctcctgagtccttttgccatgactttggttgttgttgatagcttcctgatatgacatatgacaagatcttctaggttcatgttgttcattttgtgccctagatctgaaatcagctatttatctaaggagttgtggtttcttttagtgggaaatggtatttagagactacagttggggtactaggctgttgagttgatcctcatggtcttcatggctcctgggttgttcattgtgttaggctttttcaatggacagagctaagaaataaacattttttaaaaagtaaaatacttcaacttcagatttatcttggttctcaacaaaattgtttctcattttatttaccccacagtgtacacagaatcgtctcagtaataataccattaccaccaaaagatcaaatattgataataaaactttgtaattagggtatattccactagtgatatacaatctaatttctatgctttaaagtcacttggaatagttccttcctttgtagttacaccaccagttggatatacttaagttcatttgtttaattttacttttgattttcattaatttcttttagaaaaacaactgttggctgggcgcattggctcatgcctgtaatctcaccactttgggaggccaatgtgggaagatagcttgaggctaggagtagagaccagtctgggcaacatagtgagaccccatctctaccaaaa

SEQ ID NO: 74829 - DNA, 1005 bp, Homo sapiens
ggattgttttggtgtggtagtggtatcagaaaccaaattggagtgatttgaagagtaaacaggaagtgaaaagcatatttctattgctgggtggaaggggtggtaggataggattaatgaagattttttgttgaagagattctggaacaagttttttttcactatggtaatgattccaaggaggagaatttgtgtagtagagaagcagtaaacattacagcaagttagtgacatctggtattagcctttgataggatggaggacagattccttgcttgtatctggaagctaggagaagatacctttagacactaatcatttatatattacgcagcaagaagatgggggataagaaacatgcagcattatttgaatgctatattttctcagtgaaatatgaggcatagtcattcatgaggaagagaggttgggagctgtgagaattgtggagatgataagaaccattcatggaaagtgggaggagtttactagaaaaacaggattgtcagacaaattatgctcaatgttatcagctgtcaaatgtctgtcagttaaggaacagataaataaaatatggtatatccatacagcagaatattatttggcactaaaaataaatggagtactgatacatgctccaacatggataaaccttgaaaacatgttcagtgaccaggagttcaaggctgcagtggactgtgaccatgccactgtactccagcctgggtgatagagcaagaccctatttcaaaaagaaaaaaagaaaacatactcagtgaaagaacccagtcacaaaagaccacatattgtatgattccatttatagaaaatgttcagaaagacacatctatagagacagagcattagttgttgcctagacttgtggaaaggtggggaggaggaattgggggaagtgactaatgagtgatgaaagtaccctaaaattgattgtcatgatggttgtataactctgtgaacaacataccaaaaatcattgaagtatac

SEQ ID NO: 74830 - DNA, 1026 bp, Homo sapiens
gagaccagcctggccaacatggtgaaactccgtctctaccacaaaatacaaaaattagctgggcatgttggcgtgcgcttgtagtctcagcaactcagtaggctgaggcaggagaatcgctcgaacctgggaggtggaggttttactgagcagagatcaccactgcattccagtctgggctggtgacagagtgagaccctgtctccaaaaaaaaaaaaaaaaaaaaagtaccagtcaggtgtacatgttctcttaaaacagtttttagatattacataaattcagaggttgggggaatggagatttgagtttcttcttagaatttatcagtaatttgtttttcctctcttcctacaatagcggccctgttctgtcattagctattagttctaatggagaacagtgttttagtggtggtattgatgcaaccatccagtggtggaatatgccgagtcccagtgtagatccatatgatacatatggtaagtaaaatgatcaaaatgtattttttttaagtgaatggagctgacaaaagtaaatacctcaaatatgattacaaggttatttaaacctatattagtcacctcatttagttcttccatttgctaataaattgctttattaaagagaaaaattaggaaatgtcatgccatgggtatttaagcctatgaattgatactttctctgttgtttaaaaaactatattaattaaaatgttaatttaggtagtagttacaaaaagaaggaggaaacaaaatgtaatctaagtaacaaaattttgaacttaagaaatagtttatatattttaaaaatattaagcaaaagacaatggaaccaacatcaggggtataaatcattaaaactttttggagccaaaaattttttttgttattcttagctcatatctacaaaaacattcttaatttcaaaatggaagaaaaaaaaaaagaaaggaaacctcctttgacttgcaaatgtagcttttagaaatctgttctacagaaacacctacctgtacctgtgttc

SEQ ID NO: 74831 - DNA, 3246 bp, Homo sapiens
gaaattgaaatggcaaatctgatcagaaattaaagctctgtggtcaagattacttgcttcattttagagtgtcatggtaactagaatgggacattaaaataaaagtcatagtcaaagctttaaagctggaagacaggctgggcgcggtggctcacgcctgtaatcccagcactttgggaggccgaggcaggtggatcacttgaggtcaggagtcaagaccagcctggccaacatggtgaaagcccatctctactaaaaacagaaaaattagccgggcgtggtggcgggcgcctgtaatcccagctacttgggagaccgagacaggagaattgcttgaacctaggaggtggaggttgcagtgaaccgagatcgcaccactgcactccagcctgggcgacagagcaagactgtgtctctaaataaataaataaataaagctggaagacattctgaagaccacgtggattaaccttttatagaaaggaaactgacattgttggtggaagaattttttcctagaccattgctgttactaaaggaatctgaacaattaaagcttcattctagtgaactgatatagtatatagctgactgtaaaccatttacatttcaatgtttgtactagtttttatcagggactaggatgcctagtacttctttagaaagcaaaaggacttggtgacaacctattaacatttaaaaaatactatatgactactttgaggtccttgaggtccatggtagaggtttcccctcatgaatgcaaaaatctgatatttaactccattatttaatcaaaatttgtcctatttcttatttaacatgtaaactatagttataattgtactgaagtgataagagatttagacagacaaagcttttgtgccctagcttccaccccagaataatatatctagtgcacattttatttgtggacagttaatacaccacagttccaacacatttgtttaacactgcttagtaacaggattttttgagtagaagtgggaaaataaaaattaattatattactgaatattgtaactgttaagtgcttaaattttccccacaatattgtcttgtactgtatgatttttcagcatttaagaagcggttttgttctttatagctgaaccaataacgtttccatctggaggaggcaagtcatttattatgggttctgatgatgttttgttaagtgtactgggccttggagaccttgcagacttgacggtaacaaatgatgcagactatagttatgatgtaagtgcagttttatttttaattttttaatgatttaatagaaggctccttattttttggaatcacttataaaacagaattaatatcaaggtgcatggaaaagataagtttgtgtcaatgtgttgatttgaagtgacatgtttttcttttataactactctctttgtggtatttaaattttttttttaggtattttggtggattaactagaagtttgagatgattaatatattggtcagtaaatacatcttgagtagtcaactctcaattatctcaaattaagccatattttggtgttaacaagaaaaaaaataacctgaatcatatatttgccttcagagtacttcttaaaaagcatgttttatttttgaacttttattttcttaaggaaatattttaaagtttctgaacattttaaagttagcttgcatcatttcctgaatacttaactccttcattagaggattggggagtggatggaagggttggggagtggggagtccagtgttagaggtgaaacttgtcttggatttaattttttctagtcattaatatttcaattgagagttaactatacttgttagatctttatgttaattgcagtttttcagcaatttttttttctttttataatgagtttcttttttccacgttttatacttaacattagcatgcttagagacagcctttggtgggctggattattctcattaatatatttttttaagtatataagtgactaaattccagtaaacttttgactgctttagaagtggtttcacagcctatctttacagatggagaaatgtgaaggtaaaaagataaacctctgtcaatatcaagaattatgaaaatgggataaaaatattcttaaagggtctttagttcagactttcagaaagtaccttaacttgctgcctttaataatttcacatgctaatacgttttctaaatgacaactttactgttaatactgtaccgttggatatttgtaataacttatgtaattatttttcatgtaaagtattgcagcaatggtagttattttgttctcatctgacatttaatgggagctttgggtttagcttaataggtaaaaacagattaaggaactcttcatttgacctaggctatttgtaaggcgaatgaaattattctgagttattattaaatgataaagtttttttagaaagttttaaaggtacattaaatttccactggacattttagccaacagttttaaatatatgtgttaaacacaccaaaaagaaacgaacaaacactccacatgccttccagtttactacttttaccactaaatattgtgctctttccttttagttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagcaagtattttagtgttagcctggtgtatttcttccaattttgctaatataagtaattattcctcattattgttgcatgtctttaatgcacacatttgatctaatgactatttaatatcaaccagtgattcatagttatttaattgccttctcttcccctaccctttttccccctcttttaggagtgcctctttagatgtagagcctatctacacatttagggcccacatgtaagttttactgaattggtatttaattaacatcatcattattgttaaatattatttatcggtcctcaaaccttgtaattttctcaatgttttgtattagaaaagatgtattacttgaataatagctatttaataattgtattggtgagactatgaatataatagtaccattcaggccagatgcagtagttcatgcctgtaatctgaggattttcggaggctgaggcgggcagatc

SEQ ID NO: 74832 - DNA, 2586 bp, Homo sapiens
gatttccctagtggcacagtttccttacagttaaataattttgcattttttccctctcataatttaccatttacttcactcaccttaaaaaaaatcactaaagtaacaaaatcattcaaaacaaaatgaatgaaaaataaaatagtgtctgttaattttttcagatctcatttccactattgagatatattcctgttttactttagaagtattttctaaaatacacatagcaactcctttttttttttttaattttatgcatttagtggtgattttgcttcgtttttggtctgttttgccaaatatgcatagtacaacttgctaaaatttttgtaattaatgtacatttaaagtgcaggttttgcaatttaaggcaaagccacgttagcaatgtggacccttttaaatgtttcaaaccaatgacttaacggaaaaagccagtcaaggcacactctacacaaaaaccaacttagaactctctatgtgtgtttgtttatgtgttatgtgtgtgttttaaagaaagaatataggtcagtgatctgtttcttgatgctggtaggagggcgaggggagagatttgataagtgtgaacttcattacagtttttgaagtatcgatcttcctggaatttgttatttaaagaggtgtgagtttgacttcaagctaagaaggcagctttggagtatacagtctccttattttcagtggcagtccccaacttccttctttacttttgaagtccatgtcctacctcattttataaagaacaaatgtctgttttctaggagtggaacttcaacattacaatcttctagactattgctgctaaagacttgagacctaccatgttgccactggtataaatggaatctgttacctggactaagttcttgggaaaaagagttcaatatgcgagctacaggtttccttcatcataagtgtccatcaaaaggaagattagttacaaaagtctgaaaaagaccttgtattttatagacccgttatactagtattgttatcttacttgatgaaatctcttaggcctcctaaatttccatcattaaattaaaaactagggcaggcatagtagctcatgcctgtaattccagcactttgggagcccaaggcaggaggatcacttgagcccaggaattcaagaccagcctgggcaacatagcaaactctgtctctattagaaaaaaaaagaagatattaaaactactttttttaggccgggcgcggtggctcacacctgtaatcccagcactttgggaggccgagactggtggatcacgaggtcaggagatcgagaccatcctggctaacacggtgaaaccctgtctctactaaaaatacaaaaaaattagctgggcgtggtggcgggcgcctgtagtcccagctattcaggaggttgaggcaggagaatggcgtgaacctgggaggcagagcttgcagtgagccgagatcgcgccactgcactccagccagggcgacagagcaagacttcaaaaaaaaaaaaaaccaaaaaaactacttgtttaaataattacatttttctttgaattactaatgacatttttatattatgggtaattatattaccattaataaaatgaataggatagaaattaattccctctgcagggaaataagggcaaacagatgagtagctgctgtgattaccatatgccacagtgatgggtaatatggaaagcagaggtagtagtgtaaaagaatttttgcacatatatgtgtaaatagtgattaagcagaatagcttgcaataggtacataaatatgtcataaaatatatgtgtgtatatagagaaaaaggacagaaatgtggtcatatgattaattagaaatgagtataatactaattttttgttaagtacaattaagccaaaactcgagtaaaactaatgtccagacacttcccttcacatgctcctaaattggtctggctgatcagagatagtcttgcaaaatcatttgttacgttaaagttattttattgggcttttgagatttgtgtcagtgaatgtttgtataattgtgagtgggaggaactgtggcattttgttctgacttctcttagaaacaaattccctgagcttaaagtaaaaatatttctttgtctagagaaaaatgctttgagtaaatattatataatgacttttatataattatccttaaacataagtttaaattattgattttatagtttttagctgcttctggtattgccaataactgcatactaataattggtaggaaaagatcaaaagatcaatgctacagattattcagattcaataagtgtcatcattgaaagattaaatactacttaatatctctatatattttctgtcaggtgctttcagattcattttagatcaagtaactgaatcagagctgcattttagagccctatttgagtcagattatatagcttattttgataggataaaataataaaataacaagatattctaagtacagttgaattttattttgccatagtatatatatgaattgtgtcttctcagaattatttccagtagtttagtgatgactgtcaagttt

SEQ ID NO: 74833 - DNA, 1024 bp, Homo sapiens
cattaatttacaggggccaacaggacaaaactctacgacatgatagctgatctgggagatgatgagctgccccacatcccttcaggaatcattaatcagtctaggtcagcctctactagaatgactgatcatgaaggtgcaagagcagaggaaggtacaaaatttagctaccatgtttatttacatttcagaagaccttaaatccaaatcacatcttaatgcaactaggctactgttataaaatgctgatgatcattttatatgatctttagagaaggtgttgggcaagctcttgatgtaactaatttagggattttgacatttctggtttctatttctttatattttgtttttgtttttaatgtgaggagttgttgtttccatcataggtgaattcagagtcttttcttaaatctaattttagctacagatccagtaatgggaaaatagtaatttataaaaacaaacttaaaataatacatatggaaaaaactactcattttgtcttattgcttaaatttaggaactaatagtaattaccacttactagaagacaactatggtgccaggcattgtgcttggaacctttttttttttctttttttttccttgagacagagtctcactctgtctcccaggctggagtgcagtggcatgatctcggctcactgcaacctccgcctcctggggtcaagcgagtctcctgcctcagcctcccaagtagctgggactataggcgcacaccaccattccccggccaattttttgtatttttagtagagacagaatattaccatgttggccaggctggtctcgaactcctgacctcaagtgatctgcctaccttggctcccaaggcgctgggattacaggtgtgagccacagtgcccaatctgttacattaaatatatattacttcaaaaaatatatgtaactgttacctaaattaatcatttgagaataaggcagcatcattattctttaacttggtagcaagtatacgctacctagtaatgaattttat

SEQ ID NO: 74834 - DNA, 4617 bp, Homo sapiens
tatgaccacagtacagtcatgaaaatcaagaagtaagtgttgatgcaatactaatatctaagctaaaactcagttttctttcactttttaataatttctatgttttctgtaatttgggaggagcttgaattaatcttttgtaaaaattttgggctggtagcatttttctaactttttaaggtctccatttgtgctgtattttatatcttagtaaaaacatataaatcaatgattaaaaatcacagtatgaacgaagcatctgaaatatggaggctttagttagaatatgagagagcagctaaaaatcttttaagactttctttgatatttgttactctttttcaacatggacaatttaaactgtggattataataatgtattttcctttgataggagctgttattcttatagcctgttgttactcttaagctatattatacctataaaatttaaacttaccaagaaaagattatttcatttcctttcttgaaaagatgtataggctttccccattttaaaaattcatatttggggaatatgtatgtttgcattcctggttcttagtgagtggacttatcttaattttcctaattattctcgtttatcttaacttttctgtcttttctatatatggaatatgacttttttgccatttcccttctctccgttactggtgttgcagaattgctatgcaccttctggcctgattatcaatacatttgaaaagggggaagtcttgtaactttttcaacatttcttttaatataaatcataagtgagctcccccaagtcattttctaatttttatttttaaagttttgtattaatatttgtcatttactattccagatccaagaaaacatgttgtcaccaggaaatacagttgtttaaagtgtgacttgaagccaaatatccaaaattaggtatttgaatacatttaagaagaacttactcttaagtaggcttttaaaaacacctttgctcacactacaaattatctgttatgattaagctacttccgtttagcacatagtactaattcgaagagcccacaaaatagttatattctctctcctccctcaaagacaaaaacaaaattgtttcatagcaaagagatgttattttcaactaggcatgtggttttatgttactggctttaatttcattctttaaaaacaaacattcatgtcctttaactcgggatttttttctttcaagaaaataacttaggtattttgcctaggatcagaatgtatcagattgatactctaatcagtgcactttttaaaaccgaagagtcactttgcagctgaagttattttttcttattattgtgatctcatatttatttaagacaacaattgtcttaaataaattaaataaagctgtgaaagctttaattatgatagaaaatagaacagatctagcaaacatgacttaactaaatttttgtgctaaaataagcgtatcttttccagattgtttgcctgctaacagttaagcttcagaatataaaagttgatcaacaaagggagggctcatttgagaaaggggaaatgttagatttgttcaaaagtactattttacttacagttatatagggcgtaggaagataaatttcatggcatgagtatgtgtgtttgagcggaatttgaaaatgtaacagtagtctatagtttggcttacacgtggcataattagtatgtttttcattgtgtcagtctagaggattatgcatttatataggactttgtatttgttaagaggtaggtgggttgtattcatagtagtagaaaagtttttctagctgggcatggtggctcatgcctgcaatcctagcactttgggatgcttaggagagaggattgcttgaccccaggagctcaataccaggctaggcagcatggtgagaccatctctacaaaaataaaaaatacaaaaattagctgagtgtggtagtgcatgcctgtggtcccagctactctggagactgaggtaggtggattgcctgagcctaagagttcaagaccagcctggacaacatggtgagaccctgtctctacaaaatttttttttaaattagccaagcttgatggtacgtgcctgtggtcccagctactgggcaggctgaggcggaaggatcacttgaatccaggaggtcaagagccaaggagatcaaggctgtagagagccatgtttgtgtcactgcattctagcctgggtgacagggcaagaccttgtctcacaaataataataaaaattaaaaaataaataaaagtttttcttgccataagaattagaaaaggtatttgtacttctataaatttcagtttttatttaattagtgcttaatgggccttcaatatgcctttacatattggtattaatattgtctagtatcctgttatactactacagttttcttattgctgataagacttcaggttttttatttgaaattgtttcattgcatttattatatttagaatattggataggtttagaaagaaaacaaagacattaaatttgcagttgaaagatgctctgcacaatagagtaaagactactactaaatgaaatctgctttcatcttttggcaccttttgagaaactaggattagagcagggaagttgcatcatttcctcaacttggcactgtgtcacactgaagctatcaggctatagtatgtaaataatattatataatttgggatcgtcagtttgaacagtaggttccataatatctcctaatttctttcccttctatatctcccagttcatgtgtacagaagattttaactttacattatctgtaacaaaactttgtcaagcctttattatgtttcacattaactatcatataattaaattatttacaaggtagtatttaataaagtcattttatgttacacacaaataagagaacattgaaagatcaacaaaagctttacagaagagatggaactggtgtggaggaatgggtagaatttggataggctgaggtgcatgttagaagataaggaagtgtgtgtgtgtgtgtgtgtgtgtgtgtgtgtgtgtatatgtatgtgtagaaagccttctcacctttctgagaatgggtgaggataaatatgacaaaatactgcagaagtaacctcagtgaacactgaaactatgtggaaattgctttgactggaaaatgaagggagtttgtattgtggatcattaaaagataagatggggtagaaaaaataggatcagatcatgaagcacatgaaaggttaagtacatgattttagttaactttgatccaaagagtgtggaagtgctgctacttgtggtttctgagtgaagggagatataataaatgtgataattttggaaaattaatttagttgtagtatataaatgtgattgaaggtaaatggagcttggagatagaaaaaccaattaggagtctgttgtagtaattcataagattgaaagccttgattaaagtcaatagagagataaacttggagaatactttaaagggagattcttttttaaaaccagcccccaccgttttataattttacaagttgaagaagaattaagatgtggttgcaaaattttaggaagcgaaattaaataaatggtggtggtagtcatttaagtggcaaggttacaaaagggagctattttgtgagaaagaataatgtttatgttcttttacgttgaatgtaactggtggttggacatccagtagacagttttttgtttattggagaatttgtttacagtcatttctctgtgggggggaaatcctcaggtaacactgagtttcttcattattattagttaggaaattcagactacgtaacatattacctaatccagaagtaaaattgtttaagcatttctaagaaattagaaattactgtaaaataggaccaataaatgtataaaagtccacctatttccactaagttttaccatcttaactgccaggcattttgttaaggatacatagatgcgtaatagttcttagagttacttacactcaaatagccacagtgaacttaatatatagcagtcggattcttccattaatgttgatgttagtaaatataacgtcataatgtttgaccttggacttacctattttatttttttaaacttatgtagattataaagcattgtcttttcaaagtttttttctgacattcttaaaacttattttctttcaaaatatatggttcaaaataaataattctgctatttctaaagttcagagttaaagaatattccacaatggtacagaagcttttgagttttatatattttggcctgaattatccaggcaacagccaaaattcttcccttatatttatggcttatgacagtgctgacttttcatatcattatgagaaactcagagatctatctcatggataaatcaggtttttcaaatttgggaaaaatgaaaaaatttttgaaagaaattggggttgatttgttaatgacaaatttgtactaacatggcaggaaaatatccatggaaacaccaggtaaagttaattgtttgttgcaccctcataaaaattactcgtacttattcctttgttaagtttttaaaacagtgaattatgtt

SEQ ID NO: 74835 - DNA, 1582 bp, Homo sapiens
atgttgtatattaatcaatttacttattaaaatgtaaatctgctatagtacctctctcaaagtagcaattcatttccatttggtgaagcaaacttaaaagttgccacataaaaatatcttcagatctatgactattaactggagagacttgaaacttatttttgggactcatttgaactagccagtgacccctgcttgtctaacattttgactatataaaggagaaaatagtgtgagaaaaaggcaaaagcaatatagacattcttttgtgtttctttggtgacaaatacattcatatattaaatggtaggtgtaatggaaacgtgtgcgagtttctttcagtaaaacctttttgagtgatttcatttactgtggaggctaataagtgaagttttgggggtttcacctgttacacaattttcttttctaactttatgatagcttttgttattgcatgtgaattaaaagactatagagtgaactgcttattgtatttaaaaacatttgatactgggctggggttgtgtttagttctaacatcatttacctataatgcaagcatgctgagtataaaagtacatttgcatgattgactatgttagaatagacaaaatgacattagaattttagggtttaatttttttttttttttttttttttttgacggagtctcgctctgtcgccctggctggagtgcagcggtgcaatctcggctcactgcaacctctgcctcccgggttcaagcaattcttcggcctcagtctcctgagtagctgggactatagtataggcacgtgccaccatgcctggctaattttttatatttttagtagagacggagatttactgcgttagccaggatggtctcaatctcctgacattgtcgtaatctgcctgccttggcctcccaaagtgctgggattacaggcgtgagccactatgcctggcctagggtttaatttttttttttttaaagaaataaagtagcttattttactagtggattgcttattttatatatagtatcataaactgacttaatctgctgaagatttcttttgaaatgttagataatgttgcttctaatttaaaatagaagtattccattttccccctctgatagactgtgactagacctatatctttttgaggtctacaaataagatgtaagtcaaggtcttttttagttcttgcttttaaacttttcttaaaattttttttttaattaaaaaaagtatgtttaagaaatattagaaacagataaactaaaaaattaaacaaaatttattttttttagaacccaggttggagtgcagtagtgtaaatcatagctcactgtagcctcaaactctcctgtcctcaagatatcctcccacctcagcctcctgagtagctgggactataggcacgtgccaccacacctggctaatattttatttttaaaaattttttgtagagatggggtttctctgtattgcccaagctggtctcgaactcttggcctcaggccattcttccacctcagcttttcagagtgttaagattataggcacgagccaccgtgcttgaccttatgtttttt

SEQ ID NO: 74836 - DNA, 3003 bp, Homo sapiens
ttttctttcatggagactaggcattttaagaatgttcatttattgtctcctatctttgatctgtagagatttatagaactacaaaatacaattagcacctgaatgtttgtacttaagtataattgataaagtatgagtatttgcataaagttagttacaaatttatgctacagttaatagatttgtataattcatctgctttggtaatcagaattgccgtaatagaatttcgtgtttttgtgggtttgagctgtcaggagtcaactttcttacgcatatttgtgttttcttttagacaaaaaagttactgtaaatgattcaacgtcatttcttggtattttttccccctagattttttaaaaaaaggattaatatgtagaagattttgctgtctcttcccttttgctcttacctatttcttataagcaatatcaaacagctgttacttaccaggcaagtttcaggatgttgtttgtgcacatatgcattcaccaacctgttctttgcactgcctaaatttacttttattttctagatttgagattatcttgcaagtaatatttttttccttaagcttatcctttttttattccctatgcattttcactccactttctttgtcaactatagttagagctattcacagttttattctctctacacaggtcttttagaaaactatttggctcttattaaatttttctgttctatctaatttcctatataaacttcatacaacttaagggtttttttggtctctgtgaggtttaaaaatatttgctcataatgtatcaatttgtcttgctttaagtagttgaaattaagaattattaacttcattaagatgagtgcaaatgattaattgttgagatcccgtttttcttggtatattcaataagtttacagaaagattcctgatgcagcataattttcaggaaacttcatgatttgaatacatgcgaattgagtaaagtgaattttctctttacaactgtattacaaacagcattataatttgtggatttgacagatagataatcttaggtgtaagttttagtcatgagtaacctagtttcaagtgattcaagttagcagattaatttcaaacttaggatttagcttttcacatactgaccgaccacctgtgatcataccatcagggaaaaagttatgacaattgtagcaggaaaaactcaaggcgcagtaaatatttgcatttccgtgtgccattcaaatatgagaatttcttaagtttggtgcatatagcaatctataaaggaagagaaaggctttttatgtctactttatagattaagtcagtgaggcctagggtgtctcttataaaacttgttagccagaatatactgagttatcaaaaacttaacaagtcagagtgttaaacttccttatgagctgttttaaaaccacacaaaggaaggaaaaatcctcaatatttaaaataattctcaaagacttaattatttttatgctgcctctttttagtgctgtttttcctctagttgactatgagtaaatttttctcagtcacaagtatttagttaaatacagatttattattcagctaaaatagctgatgtagctttagcagttgtacagcaatgtatgttttcacttctccatgctgatcactagttttatcctgaaaaaaaatcaattctaaaaaaattcttcagtggaatttgagtttttttttttttttttttttttttgctaatcttagttgtagaccaatggaagaaggtaatgagatgttgaactatttgggtgggtggggcagaggtgggactctgaatgctttgtatggattattcaagacattgtatttttgaactatatgtattatattggactagaatgcctctccattagtacagttaatcctgtgcatgcagaatcagtatgacagaaggtgcatgaatattttcatcaatgaaacagcacttacctttctagcttgcacttttccgagtagttcgcatgtatttcattcatttgcttttatgatgctggctgaataattttttattaacatttttataaagatgcagtgatctatttttataacattagatttctaatgtcagtctattgaatgaatgataaccttcaaatttgtggttcatgaaaatgaagcaccatttaactgttgatattaaatgtttagaaacttatgacatgggcatttagagtttgagttgtgaataccagaactgagactgcacctttaaagtattttgagtatatgctattagtacattttattatgattatgtaaagctataacagtttactgccaacagcttgcattgccaactgctgattttttttcttttaataatatgctgcatgtagataaagatgacctctccccaactgctgaggtttgggatgtagaccagggactaataagtaaactgaaggaacagtacaagaaggaacgaaaggggaagaaaggggtgaagagtaagtgcagattctgactattataatttttgtataccaataattgagaaaaaagttcttcaattctgtttctttgtgtaacttaattttttgtttcataaagggggcaactaactttaaactttgtctgttgtataattgaaatttgtttgtatataatttaggatgtgttattgatcaagtagaaaatcatttaaaatatatgagaagggtaaaggaaagattttgaggattgtttttaagctttaaaaactttaccaaattgtttggaatattggcattggaataaaaaataaagatttttcaaaagggagaaaagtataaatttctccatttttgatacatagagtatagctataaacaactcatatccaggttacatttcttagtttgggaatccttacctacagtgaataggaaagccctttctgtagtttctgctttctggtcttaatccaactactaacaacaacaatagcaaaaagaatctcttgggtagtattttttggctactgtggt

SEQ ID NO: 74837 - DNA, 1328 bp, Homo sapiens
atatatatttacttatttagttaacaggattttgctaaatgttgatttgtaatgcacacttttcacttaatacatggttcttctgcatcgtttttttttttttttttttttttttatgaaacagggtctcgctttattgcccaggctggggtgccgtggtgcaatcttggctgtctgtgaccttcacctcccaggctcaaggggtcttcccacctcagtctcctgaataactgagaccacaggcgtgtgaccacacctggctaatttttgcattttttttttttgtagagacggagtttggccatgttgctcaggctagtcttgaactcgtggactcaagcagtctgcctgccttggcctcccaaagtgctgggattacaggcatgagccaccatgcccagtcagcatcatttttaatagctggataacattctgtcaataatgtgccataattttatttaaccagagctctatgatgcacatttagcttattttcattaaaaagaaaatgatcgaaataacttatcaaatatctttttagctaaatcttgacacatattcattcctgtttccttagcctaaagttgctagaaatttaatcataaggataaagaaaaaactcaggaatttaatttatatggaatggcattatttctttgataatagtttctatattatgtacaaccgattggtctttctgtctgaagacttttgatggtagagcagagttttaagacaactctcaatatttagctttttactatcaatatttgacagtacctgtgtctcctgtgtaagtggaagtaatcgaaaaggtcccttacttccagacgagacggaaatattatctttaaaacattttaagttcttagtgaaggaaaataactcatttaagtacaagatcgttcaaatagtttatttttgtaagaaatgaaaactgtcaagtgatttatgcagtatttccaaagttcatcatttctactcaacaagatgttatagtcattttttccaaagcaaagaggatgaatatgcaaacactctttatatttatggaattcatttgccagaaatttgaatatatttataaataggaaagtggtagctttcagattttttttttcttttttttgagacggagtctcactctgttacccaggctggagtgcaatggaaccatctcagctcactgcaacctccacctcccggattcaagcgattctcctgcctcagactccagagtagctgggattacaggcgcatgccaccacgcccggccagtttttgtatttttaatagagacaggttttcaccatgttggccaggctggt

SEQ ID NO: 74838 - DNA, 2980 bp, Homo sapiens
aggcatgaagcactgtccctggccccgcctgataaactttggtatttactgttttagtcctcaaacatttagaccaaactgtaagaggttgtagttataagaaaggccaagtttcagttgcttgtttatgatggttttattttgagaactaataatatgtgtttgagtgtctaatactataggattttattttgttgcagtaattacctaaaatattttggacaatgaactttggagaaagtcagcagagaataattacttttatttcagttgtagaacataaatctttcaaacttcttttcttgaataaagccctcagacagtaggtagtcattcgaatctctctagttttaagaattgatttaaaatgggaaccagaaagaaatattagaaccaaccattggaatagttggatttatctttttttccttcgcacaggtcctctggtgatgttcttgagacgttcaatttcttagaaaatgccgatgacagtgatgaagatgaggaaaatgacatgatcgaaggcatcccagaaggaaaagacaaacatcggatgaataaacataaagtaggaattacattttatattcttattagctatatattcatgtagttggaatgggaatttttaagatatcttaagttacattgggagtgattgatcatctttactttacatattggttaaaagttttatgtggtcagctctttttgcattacacacatagagtaggaattgtttgctatattattcactaaatgggcaagaaaaggtctgtatttataggactagtccattgattttgaaacctttttaaagcaatgccctttccacttctgctacagttgagaatcactgctgaagtctgtctcttcatgtacagcacaccagtgataaattaactgaagttgcaatgggaatacttccaccctgggtgagggagtaatctgtgaattataaataagtctcaacattcttgtattttagtaaagaataataaaaatttacttttgctcataacctaagaaacaggtttatctatttgagtggtttgaggggcttgctgtagaagccaaagtagagttgatcgtccattcgtggattaccaaagtagtgtacagcatttcaaccatagaaaaaagtgggtaggtttagttgttggtatttgagattttacggtaacataagaaaaaaatgacagtgttccacaaaagtctctggtctacaaaatcagttttcagtcttttttgacacattctatatgtataacgtagtctatttgggtgaatagagattttgatccttttaatttttttgttctggaaggtaaagcactattataattatcacagctatgaatttaaattagttactatgccatatctctatgagtgaaggacgaatcatgcagttcccatttatgaggtcaattcaagataacatcagaatgcaaataagtgactggttctttaatggaggactaactgtgaatgtactgtaatttaagaagttaactgttcttgatgattagcatttaaaccatttttagtgccacattacttagatcaatcttggcacagcactgttgaaccatttatctgaagtataatttgggatttgtgaattacataggagatctaaaatttttgatccaagtaattttaaaatgggtgtgtaaatgtagttatgtgacaatattaaagcatcccttttccatttaggataaaagtaattcttggtttatattctatttacagataggtaatgaaggtttagctgctgacctaactgacgatcctgatactgaggaagcactgaaagaatttgattttttagtgactgctgaagatggtgaaggagctggagaagcacggagttcgggggatggcacagaatggggtaaggtgataaagaaataccgggtgggaggaaatctagcccttaatgatgggttattattaaatattatatgtggaatgtgtgtataaatatatggtggcagttaaacggagagcaaggggaagtggttttgaataatatcaaggtattttgtaccaatttacttaaatttggtgactaaactatttaatatatatggcttttggtggattttgatttttggaatttgtctggatttaaagttgaaacatttaattgatttggaaatccaatttctttccctttagtcaatttttaaaaatttatgtattcagttttaaacattcccgttgtttaatttggtattctagatttaggaagatttaactctctgtatgtccatatagtgttatctgactaattactagaattagtaattagtcagtaattagaaattagtaattagaaagtaattagaaagaataaagctactcatcctgaattatagctctatattgagcacaatttaatgaagatactaaactttattgcctataatattcagtgtgcaaaatgttagggcctaaactttggaagtggtacattgtgctaataataattcagccataactaagagaaaaccattctctatctgtacatggttaaaaaccccattaggaagtaaaataagtgtaaaaatattttaaggtaatagctgacgtcatttatgtttttcctagtaaatacattcatgcaatcctcatttaatatcagcatgttgtgtggtaggtagaacaaagtgtgtttactgagctatattggagaaggttgttattattattgttattattattattttttgagacagagtctcgctctgtcgccaggctgcaatgcagtggtgcaatcttggctcactgcaacctccgtctcccacgttcaagtgattctcctaccttggccacccaagtagctgggattacaggcgtgcaccaccacacccagctactctttgtatttttagtagaggcggggttttaccttgttggccaggatggtctcgatctcttgacatcgcgatccgcccgccttggcctccca

SEQ ID NO: 74839 - DNA, 1101 bp, Homo sapiens
attagtgtgttcatcaatctctagttaacaaccccaggtttaaacttagtatgtctgtgtgctaagatgcagttctactcattctttactgctccttggaaattaaaaaatgtgtgtgtgttgtgtttgtgtgtgtgtgtgtaaattaaaaacaatgtgtggttgtgtgtatggaaatttaaaaatgtgtgtgtgtgtgtatataatcctaaaagcattttaagacactagggcttcttgggttttgagataattggctcttaatcagtgttaaccatactatatgctttttaatttaaattttggtttgtatttggtattgttctcttagaactggaactagtctgtagagaagaaagatactgagacaaagggagagcatattttataggattatgggtttttctaaaatttgatgtgattttgagtctggcacatgttaacagtatgtggattttaatatttattttctcttacaggtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtatgatttatacttaacatagtttatataatggatattatggatattgttattgttaatctctttagctccttgttactgccattaagaacttttttttttttttttttgacacggagtcttgctcttgtcgcccaagctggagtgcaatggtacgatctcggctcactgcaacctccgcctcccaggctcaagcaattctcctgcctcagcctcccaagtagctgggattacaggcacccaccaccactcctggctaattttttgtatttttagtagacacggggtttcaccacgttggccaggctggttgcgaactcctgacctcaggtgatccacctgccttggcctcccaaagtgctgggattacaggcgtgagccagcgtgcccaactgctattaacaatttttaaagcagatcgagttcagagttaaagacctagccacct

SEQ ID NO: 74840 - DNA, 1052 bp, Homo sapiens
taatttcaaaggcaatcgacttagcggaattctagtagttaaaaaaaattaaattgccaggcatggtggttcacacctgtaatctcagcactttaagaagctgaggtgggtggatcgcttgagcctaggagtttgagaccagattgggcaatatggcaaaacctcatctcttcaaaatacaaaaattagctgggtgtggtggtacatgcctgtggtcccagctactcgagaggctgaggtgggatctctggagcccagagaagtcgagactgcagtgaatcgagatggtgccactgtactccaggctgggtgacagaatgagaccctgtctcaaaaaaaaagagaaaaaatcagttttaataatattttatctcctgggcatttgattccttgatactaataaagtacacttgggttttccctgttttaaaatgggggacatagtacttaagtcattgggttattaggacaaacacatttaaaatgagtgacccacagttaatacttagatgaaagttaattttttcctgtcctttataaaataggtatgtttttatgggaatttatccctaagaaaactttggcaatattttcaggagtcgaaataaagtatgtaaaactttttttttcttaatttttagaagaaaccaaagacacagaggctcccacagcacctcagaatagccagttaacgtggaagcaaggcagacagcttttaagacagtgagtaattacttattttcaaccttctttaaggatctaggtatgaaagtgcttatactgaatcactttacaagtaaaaaatcatattgggacaatgtgtatgttttttgtattgctgctttttttgctgtgtagatgcttggatctttttaaaagtttgtttcctctgagtttcagggtgatgttgtcttcttacttgcagggtagaatgtccaaaagactggatgacttgagcagaacaaaaacaatataaaattcatacttgatagagccctccattcctttcagtgcagaattcacacatttcttttcagtgtgggtgtgaccgg

SEQ ID NO: 74841 - DNA, 1712 bp, Homo sapiens
tatttttctttcaaggttatgtgaaggtgaaatattaatattagggatcttaaggattataaactagctaatttatagttatctttattttaaaagggatgtgttagatctaacaaagtttggacattttatgagttttttttgtttgtttgtttgagacagagtctcctcagcctcgagtagctaggactatgggcacacaccactaaacctggccaatttaaaaaattttttgtagagatgaggtctcactatgtttcataggctggtctaaaactccttgtctcaagcagtcctactgccttggcctaccaaagtgctgagattacaggtgtgagccattgcctggcccgtttttatgaatttaaaatcttgatatcatgagtcaagtgcaacagtttgtgtttatcgttttccatttttcagtttcctatgtatggttaagggaaaatgtaaataaatgcatcttttatatttttaggcccggattgcatttctacaaggcgaaagaaaaggtcaagagaacctgaagaaggacttagtaagaagaataaagatgttagagtatgcattaaaacaagaaaggtatgtgtgcctcattttgttacatgaataaagtagaacaatagtatactcatgtataccattgtactctgtatttggcagctttttttgaaaggtacaaatccttgcccgaatacatgatgctgtcttgatttgattcatacttgggaaagaaaggcaaaagagattaaaataattcaattgaaatgtgttttgttacagaatctaaattttggaacttaaaaaaaaagacaaaggataattgatctttttttaacttttgggtatgtgttacttgggaaacttaccttttttttcttttacagcaatatagtcttcaatgttctttgcaaacaaagtttaaagaagcagacattcatattatgttttgttattggagtaatataaagcaagagtgacaaaaagaagaagttgtgattttactaatttgtgattaaattttcagggcaaaatatcacaaattaaaatatggcacggaactgaaccaaggtgacttgaaaatgccaacctttgagtcaggtaaacttgcttcttctgttactttttttttttttaattcattttttatgtaacagacatgttctctttacccgcattttggtttgataatattagagaatgactattgtaaactgtctagaatttgggaaaaaatattaaatgaataaaagtaaatagtttcatatacatcttaatcctgaggcaacttgtcttattatccttgagttgaaatctgtgtaaaagtgtggttgcatttatggtagtaatttgagctgaaaggtaacaaagttaggtattatagtaaattttaaaattttagttaattgtttttgagttcaatattaagtatgtagaacttggagaaacacacaccatacataaaatttgcagttgatttattttttagtctttaacactttcagtcttagcagcagaactttagagcttccatttgttgtcatacatataaaattaagagaccaagatgggagtggcataggttttctttgacctggcttttcagtggttatgaaggcttattctgatgccaagaaactgtattagaatctcctccttggaaaaagcaaaaatcaggaacagaaacatggaaggtctactttttccga

SEQ ID NO: 74842 - DNA, 1019 bp, Homo sapiens
tttaattatcaagactttttcatgaaaagaaatacatttaaacctttttataggcctttgtgtgtgggggggggttggggggggcggggaagatgccatggaatttcacagagctatccaagatatcttgcaatatcagtgtctgtgggccaaatcagacatcctttttgttgttgttgctgccaccatccccactctccttcccttcctagacgcaacctagtacctgcctctcagacactgtattttgcagaaacttaattgataagtaatgtctacatgagctgttaaagggaattttcaaagaatattattattttcttcatttactttttaaaggttagttagatatgtattatagagactgtgtttaggttttttctcttggaaattttacattctaggtttaataactacatttattgaatttagtactatagtaataaatatgagtataaatacctgacttctaaatttaggattctttcagcttattcatctttactttcttaactctcttaaatatttctttcattttgatcattaatatactgaattagtgtagagtagattaataaaatctgaggaatcacatttatttgatcaaagtgaattctccctttacacatgaaaaaacatctttgccttattttatttatttatttttgagacggagtctcgctctgtcgcctaggctagagtgcagtggcacgatctcggctcactgcaacctccacctccctggttcaagcgattcccccgtctcagcctccggagtagctgggattacaggcatacgccaccacacgcggctaatttttttgtatttttagtagagacggggtttctccattttggccagactggtcttgaactcctgacctcaggcgatcctcccacctcagcctcccaaagtgctgggataacaggcatgagccactgcacccggcctgccttatgttaaggtaatttcattttttgtagatgaagtaagttcttccaagcttgaggtattataa

SEQ ID NO: 74843 - DNA, 2207 bp, Homo sapiens
cccctctgtatctgtgggttccacatccttgagttcaaccagctgtgaatcataaatattcaaggaaaagaaaggactgttgcatctgtactgcacatgtacagacttttttctttgtcattattccctaaacagtataatataacaactatttacatgcacctacattgtattaggtatttaaagtaatcaagagataatttaaagtatatgggaggatatgcataggttatatgcaaatactacaccattttatataaagggcttgagcatctctgcgttttggtatcctaggagggtcctgaaaccgctccctcacagatagtgagggccaactgtattttaacagatgaaatctgtgctgtgtcagctttagggagacaagtcatggtcacattttttggcactcatatacaccctaaattctgtggtcttcattataagttaaggaacctgtctccccttttgcatatcaagtacatgccatctcttaaaagtcatagtgccctttggccgggcgcggtggctcaggcctgtaatcccagcactttgggagtctgaggcgggcggatcatgagatcaggagatcgagaccatcctggctaatacggtgaaaccccgtctctactaaaaatgcaaaaaaaaattagccgggtgtgctggtggcgggcacctatagtcccagctacttgggaggctgaggcaggagaatggcatgaacccgagaggcagagcttgcagtgagccgagattgcgccactgtactccagcctgggtaacagagtgatactccatctcaaaaaaaaaaaaaagtcatagtgccctcagaagactgctagaacactcttgccactctggtttactgttacttctctttaactccttgagtcattaggcccagggattttttcaggaaatgtgtataggagtccctctttcctgagtttatagcctcttgttctgtcccattccacatttctgaattgaaatgacacacatgctcttaaagtatctgagccttccatttttttgatttagtcttcattgtcaccattgtgagtctttcaataactgatgacagacaattcatattaatcatcccatttcatagatatggaaactgaggtaattaatttgcccagggtcacatgagttagtatgtgttagggttggaattatgcattggaatctcctaccgtctggctataaatcctgtgttttgtccgggcgcggtggctcacgcctgtaatcccagcactttgggaggctgaggcggatggatcacgaggtcaggagatagagaccatcctggctaacacagtgaaaccccatctctaaaaatacaaaaaaattagccaggcgaggtggcgggcacctgtagtcccagctactcgggaggctgaggcaggagaatggcgtgaatctgggaggtggagcttgcagtgagttgagattgcgccactgcactccagcctgggcgacagagccagactccatctcaaaataaataaataaataaaaatcctgtgtttaaatgactgttttgttgctgctgtctcgctacctcccaatctactacctttggagaaatagtcactatatcattgggctgccatgaagaggaaggcttttgaagtcaggcctaggtatataacagcaagccatctcttccaggtatgggtgccattgctgtgaagatagaggaagttcacggtgaagaaggtagtcagaatctgtttgtggcagggtccaggctgggcaggttactagaacaggggtctttaagtgattgcttagtgggccaaagaataaggtaactgacccctctctttatcttgaacttgaccagactactttctgtggatgattcaaattccttttcatatgagtctttttatttttgaaggttaagaatctacctggggtagtgaaggcattggaccctgggaagccagtagacttgagatctactgtcctgattcttctatcttactagccaagacagtgtccgtgagcaagacactttacttccagagggggtggcttagttgcctaatttgtaaaataattataattcattattggaagtggagattatagagctggaatattcacttcctgtggtataaatagtgtgaacaaaagttggatggctgtaaagtgcaaggtcttttttgaggaatgttgcatgtttcacttgtggtaga

SEQ ID NO: 74844 - DNA, 1284 bp, Homo sapiens
tatttttaaaaattgtcatacttttcttttttaatgaattagtttttctcatgagaaagctgtaaaatacagtattctcaagtagtggtatgtttttactgataataagatgggcaactcttcctaaggtgttttggaaaaactgagctgttttggttttaatttgtgtaaattatgagttaaccattttagtactagaaatatcatcatagagtcctgaaatcctaatcagaaggattgaaatttatagctagcagatattcaaaaggcagctaattcattcctctcatttgacaaatgaggaagctaagaacaagagagagggttatgaagctattagtgacaaggaaggattagaatgtaagtctctaaactcccaggctagtgtcctttataataatttataagaagggagttcttttgttttttttttcttttgtggcctttatagccatcttgctgctcccaggaactttgttaaacaatatgcagatgcttcagtaacaacaagaattgtaaagttaacttttggagttatgtcattttggacagatgaatctgatttatttttaactttcgtggaagatgattcacagctttggaaacgttttcctgatgactgtgggttatcaggtaatggaaacttcattatttatttgctggcaggatcatacaatgaacacggtattttcaagtgagatctgaaagtgctctggcacttaaacatttagtattttatcttaaacatattctagatcatttgactcataactgtcacttgaccctggggtcaaaatttgcatttgtgtttatgtttttagtgatgccaagtaaatactgttttggttgttggggactaatattaaggaaaagaatagagatgttcttaataagatggttttgagttaaatgaccaaattattttgtaatatgtggcattaatgtcgcataattgaaactaagaaaaagtgcatgtcttattatgaggcactcagtagtccagtcattccaaacttaaaagatatcttgtggtgcagttggtacattttcatgttgtgagcagagatttaaattcagcaaaaccacatcacctgtttttttaaagtgtaacttgttaaatttaaatttgtttggaagttttatatttagtttttagtttatttggttttgtgtttatattgttttatatttagtttttagtttatttggttttatgtttttagtttatttggttttgtgtttatataagatccctatgcatacagtttatttctaggtttatgt

SEQ ID NO: 74845 - DNA, 1171 bp, Homo sapiens
aacatgccagttggaagctacagcatttagcagaagttctaaagtaggaaagagcttcatttaaactgtgaactggccaggtgtggtgtctcacgcttgtaatcccagcgctttgggaggttgaaatgggaggatcacttgagcccaggagttggagaccagcctgggcaacagtgagaccctgtatctaaaaaagaaaaaaaaaaaaaagaaaatgagtgaactggactataatgattcaaaaggctaagtaatataggtaacatcagtatcctaaagtatattctaattcactgatgcttgattttttgggggattgtatagtcccctttgcatatattatgaatgctgtggagcctcttctagttttttttcaaaaaaggtaagaaaattttgcttagaatgcccatgaagcctgactgctgatctaaggaagtaactgattcaatctgtgctttttgtttctgtactaatactgccttagttcagagtactcctcctgccagaattctttgagataatctcctgacaggtttgtttcatccattgcccctcttaacagtttatcctttttatcataaagacaattgtattatatataaccctcctttaatttttttatgaaaagtttcaaacatgtaagaaaataatatagtattgtgacctcccacaaacgtgtcactcatcttaaacagcaacgactcatgatcagtcttgttttacctgtacttctatccattcattgtccattccaaattattattttctattattttatttatttttaagagacagggtctcactatgttgcacaggctggaatgcagtggtgcgatcgtagctcactgcagcctcaaaactcttgggttcaaatagtcctcccacttcagcctcccaaatagcttggactataggcacgtgctaccacgcctggctaattttttttttagtagagacagggtctttctatgttgtctaggctggtcttgagatcatggcctcaagtagtcctcctaccttggcatctcaggagtgctgggattaaaggcatgagccactatgcctggcatgcctcagcctccagagtagctgggattataggtgtgccaccatgcccgactaattttttgaattttagtagggatggggtttcaccatattggccagtctg

SEQ ID NO: 74846 - DNA, 1213 bp, Homo sapiens
tcttttgcttccgctctgtttttcctgtcatccacttatcacttttcttcatatgttttctttcttttgttcccagttgttattatgtggggttctggttctattttatgttctcactgtatattcagaatcagatttttagctaccatgtaccatcttaataatacctagcatttatttactctttcctaattgttatttcagtgcttcagtatttcagtattcatttaattcattcagtattcatttaattctcaaaacaactcagtgaggttgatacaggtataattggtgtcttttttttattttttctgacactggcatatcgaggcccaaaggttaagtaatctatgcaactaggaggcagtagaactgggatttaaacttagactgcctgtagaggccatgttcttaaccactactagatttttggcgtccagatgtcccttgtatttctaacttccgtttagtttttctacctcaaattcaatacatccattcagttaatctcaagtgcctgcctctttcccttgacaaaacacacttgctcattctttattccttgccacattaaagttaacactatcctccccatcgctagtactatagaggtcattgaaccttccccctgcgtatggcctgtgagttttattgattccagcatgattatttggtgatatttgagtgcgattttgtgctagatcctgggtgtataatgatgtatgagacacagactttgtcctcagggagcttatactctagaaataatttttttttttttcaagagagcgtcctactctgttgccgaggctggagtgcagtggtgccaacatggcttactgtagcctcaggctcccgagctcaactgatcctcctgctgcagcctcccgagtaggtgggactacagacatggactatcacaccaagctgtttttatttttagttcaggtgggttctcagtttgttgcccaggctggtcttgaactcctgggctcaaatgattctcccacctcatcctcccaaagtccaagtattgggattacaggcatgagccatcatgcctggccaataaaatgttacaacaaattagcagaatgctgagagaataaatggtgataggaaacctgtatatgtaatggagtttcagataatacctaatatttattgagcactttctttttttttttttagagacagttttcgctctgtcact

SEQ ID NO: 74847 - DNA, 1031 bp, Homo sapiens
ttagtgactcatcaacgctttcagcactgaatttttctttttacagtactctccactagatctcctttcccccatccgtttctttatctataaaaaaaccaaaccagacgatcgatgctgtatttatgaaacgactgaagagatttaatattcccttgaagtgaaacgtagttatatcatgttacttactcttgcaggagaagcaaagtgagatgttctcggaacccttcatagttgagcttgactcgatcctcataatgtgaacctttgataggctgcacatttggaagctgttggtagttaacagctcatgtcctggatctcaaaattgctgcatctttttgaaagggttatttaactttcttgggtatttgtgtttatttttaaatacctttccagggcaaatttaggcttagaaggaaaaagcgtgtgtctaaatagtattgcacctgttcttcagactgttgtgtatttagggggtaagcagtatttgctgtcatatatgtcatatgcctatggtgaatcgttaggcaaatgtagtgctgaaaggaggaggattggattaactagaaagggtgtcctcaaatatgcatctctttagtttggttctgaactagtaaacttttatatgactccacaaagtgggtgaagttaaacttttcaaaagtaaaaaatacttgggtattttgacactgtatgaagtcttaaaaaaaagtaacacttgttagtcatttcagtgctttacaattgtgttttgatataatattgggctttaaaattacataactttaaaaaagctgaagtcaaaactggtttaagttgtgtacagtctgctttaacatacttaaaatttatagaattctgttggtatacagctttctactacatactgcaaacttaattttctgtgtgagtaaagtaagtaaggcatttgtttttaaaatttggattgacaaatgcagtaaggcctaagctcactaaataatacttcaccagtccctgctatggtttcttagacctttgtactgttg

SEQ ID NO: 74848 - DNA, 1021 bp, Homo sapiens
aagcaagaccccatctccacaagaaaataaaaaagttagctgggtgtggtggtgcatgcctgtggtctcagctacacaggaggctgcgacaggaagatcccttgagcccagggagtcaaggctgcagtgagccatgtttgcaccactgcactccagcctaggtgacagagcaaaaccgtgtctcaaaaaaaaaaaaaaaatacggtgtagatatgctggacaaaggggatattcacatcccaggcacagcagagcaggatggcacaaaacttcatcatgctactcagaacagcgtgcagtttaaaacttaagaattgttgcaggcactgtggctcacgcctgtaatcccagcactttgggagaccgaggcgggcagatcacctgaggtcgagagttcgagaccagcctgaccaacatggagaaacactgtctctactaaaaatacaaaaaaatacaaaaatctttatctatttagatgttcactttgcatagttgtaatccatgtgaatgtagaatttggcattttgattttgcgacttaacattatttatatacatttccccattcttttacagagtttgcgtattcaatttatttatttatttatgagacagagtcttgctgtgtcacacaggctggagtgcagtggtgtgatctcagcacactgtaacttccccctcccgggttcaggcaattcccctgcctcagcctccagagtagctgggatcacaggcatgcactaccacacctggctaatttttgtatttttagtagagccggggtttagccatgttggccaagctggtttcaaactcctgagctcaagtgatccacctacctcagcttcccaaagtgctgggattacaggcatgagccacgatgcccggtccatattcattttaataattaaaagacatggccgggtgagatgactcactcctataatgccagcactttgggaggccaacgcaggaggattacttgagcccaggagttcaagaccagcctgggcaagatggca

SEQ ID NO: 74849 - DNA, 1040 bp, Homo sapiens
cctagcacttagtgaagctgaggcgtgtgaatcacttaagtccaggagttcaagactagactgggcaactggaaaccccgcctttacaaaatatacaaaagttagctgggcatggtggtgtgcacctgtagtcccagctacttggggggctgaggtgggaggattgcttgagcctgggaggtcaaagttgcagtgagctgtgattgtgccactacactccagcctcggtgacagagtaagaccctgtctcaaaaaacagaacaaaaaaaagcttaagtgaacatttaatgacactgatatgtagagtgaggcaatgtgatagattaaagacagcattgtagtatgagtcaggggagcagaattcaggacttcactctacatctctgatcagttttcccatctacaaaatgaagggaatacacctcagggatgacaaatataaggtgcatatgttgccactccctgcttcctaacctacaactgacatgccatccttttgttttgaacctggaagcagctccagaatccttcccaaagcagctattaacagttagtcacagttgacacccaagttgaaacccatttgccatctttggatatgacaatctgtaaagactctcctaggtctaactcccagaaatacgccatcagaaatataatacctgctcaattcaatgtgtacttcgttcagcctcttcaatctctcttttctctgggcattaagtttacatcatgtggttgctgggacatggatctgagcatattctacttttatgttgttttggtttattttatttttattttatttatttattttttggagacgaagtcttgctctgtcacccaggctagagtacagtggtgcagtctcggcttactgcaacctccgcctcctgggttcaagtgattctcctgccttagcctctcaagtagctatgattacaggcacccgacaacacgcctggctaatttttttgtatttttagtagagaaggggattcacaatgttagccaggctggtctcgaattcctgacctcaa

SEQ ID NO: 74850 - DNA, 1603 bp, Homo sapiens
agcttggctttgtgatgataattttccagatgatgaatctcgtcacgtaagaatatttctcattttgtgacttgagttgtgactctgctttcaaaagtgttaaaaataggttatgtgttcagagcataagccaggtttctgactctacttttattattgaataatcttgatgcaattaaaatagttctaaagcgataaaatttagtcaccaaaagctatttaataaaattatatacttttagatagccaaattcatgaagatgtttaatgtttatggatttttttcttagatgatgataggcttagtttctattaacttttgtttaattttatttgcatttcaccctctaaaaaattaggttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttagggtaagcattatatgtacattcttcaatccaatgcatgaataagttttaaagcttttgtttctttgtcgtcactgatttgcaatatatgagtaaatagtctgtcaaaaacagtaatatgctgtaggaaatattgatgatcgacttgaacctttgatttaatattataaagacaacactcagaatactagaatattagtttattaatcatcaaacctttagaagattacctgacttagccaatgtgaatttatatgcctgtgtaaaatgtccagagccaacaatattttgacaaattcatctgctaatatatgattcactttgcaaagctcaaaaattggttggtatgtcagctttatcaccaaaggctgtagcagttgagatgctgcagaacttttgataaaactctgttactttatgtacaggtaattatcatatcttcagctgtgattttaggttaactgcaaggccttttttttttaatgtttgctgataatgttggtaaactgtgtttgataaatggttatatattcaaggttttttttaatatatatttttgtacacagcgtgattgacttcagtaaagcaacagtttcttcctaaaagtcttacaaacatgttgctgtcataattcattgc

SEQ ID NO: 74851 - DNA, 1048 bp, Homo sapiens
tatttgtactactttgaagatagtccctctaatcatggaagaagtaatttaccaaaaaaaaaaaagcatttaaaaagtttctgttttcaggctgggcacggtggcccatgcctataattccagcactttgggaggccaaggcagacacatcactcgaggccaggagttcgagaccagcctggccaatgtggcaaaaccccatctctacaaaaaaacacaaaaattagctgggcgtaattccagctttttaggaggctgaggcataagaatttgcttgaacccgggaggcagaggttgcagtgagctgagattgcaccactgcactccagcctgggcaacagagcaagactcattgtaggtgctcaataaatattttgttgaatgattgtttaccttaagtactcttccaaaatagttgtaaaaaaaaagttataatttaaactgtttgttttcttccctgatagttacatttttgtaccatttaatgccatttacaaagcatttatatacatagaactataggcatgttgtgataactggcattgattataatttgttttataaatgaggaaattgattctgcacgtacttagctgatttgcctaagatcatgagaaaatagtagcacacatgagagtagaaccttcagcttcttattcctaattgtcggttcttcctcccaccataaatggattgttattaaaaaaaagaaaatgtggccgggtgtggcggctcatgcctgtaatcatagcactttgggaggctgaggcgggtggatcagttaaggccagaaattcaagaccagcctgggcaacatggcagaacccccatctctactaaaaatacaaaaattagctgggcgtggtggcacacacctgtaatcccagctactggggaggctgaggcaggagaatcacttgaacccgggatagggaggttgcagtgggccgagataatgccactgtactccagcctgggtgacagaacaagactccatctcaaaaaaaaaaaagaaaaattgttttaaaattataattaccgttttgat

SEQ ID NO: 74852 - DNA, 1101 bp, Homo sapiens
ctggaaccaaaactactattacatgtatgacttttagcaattacttcatctgaaaattagggctaacaataaccctaaaaaggttgttttgttggaaagaattagttaatatacataaagtattaagaactatgctggcaaggcacagtggctcatgccaaggcaggcagattgcttgagcccaagagttcaagaacagcctgggcaatgaagcgaaatcctgtctcaaaaacaaaaacaactctagcacttagttagtgatcattaagcgttagctattaataaactactactgctgcatctactaccacttctactactactaaaactacaaatcttagataccatatattaaccattttaatgtatgtttactattacccaaagcaacgtaaaggggtttcaagcattaaactcctgcatgcattatgtcacagcaatcatggattctatatagaatatgaaacccaaccagtaggggaagtttctttgtgtaactgtttggtagctccctcctctcaccccttccacactgcacatttttgtaggcatttaggttggtgctttactataaaagggaaaaatatacatatggtagggaagataaacatgaagatattacctgctccccaataggtcggctccctgctccagcaggtacctgtggtagctgcgaggtaacagcatgatgcgttacatcagagcgggagccagctcgacgttgcagggatgggcgtctcagaatctaaaataaaacaatcccaagagatacatgtctaattatttgacccatatatgccccctttcagccatgacctgaatatattaacccctattaacaaaagtgtcactgaaaactttttcattagccaacttcagaaaagttatgagttcaatgttttaaattcatcatgcattttatactaacctccttcataagaagtattgtgttttcttagcaaccatatactaaaagcattttttaaatttctttactccattaaaactcaacttatcaatttttttgaaatctagtaacattttataaagagaaattttaaatttacagttagttacaataaagggtattttttaggcaca

SEQ ID NO: 74853 - DNA, 1002 bp, Homo sapiens
tcaatatttaaccactaggattgtcttctaactgaaaattgtgcctaaaaaataccctttattgtaactaactgtaaatttaaaatttctctttataaaatgttactagatttcaaaaaaattgataagttgagttttaatggagtaaagaaatttaaaaaatgcttttagtatatggttgctaagaaaacacaatacttcttatgaaggaggttagtataaaatgcatgatgaatttaaaacattgaactcataacttttctgaagttggctaatgaaaaagttttcagtgacacttttgttaataggggttaatatattcaggtcatggctgaaagggggcatatatgggtcaaataattagacatgtatctcttgggattgttttattttagattctgagacgcccatccctgcaacgtcgagctggctcccgctctgatgtaacgcatcatgctgttacctcgcagctaccacaggtacctgctggagcagggagccgacctattggggagcaggtaatatcttcatgtttatcttccctaccatatgtatatttttcccttttatagtaaagcaccaacctaaatgcctacaaaaatgtgcagtgtggaaggggtgagaggagggagctaccaaacagttacacaaagaaacttcccctactggttgggtttcatattctatatagaatccatgattgctgtgacataatgcatgcaggagtttaatgcttgaaacccctttacgttgctttgggtaatagtaaacatacattaaaatggttaatatatggtatctaagatttgtagttttagtagtagtagaagtggtagtagatgcagcagtagtagtttattaatagctaacgcttaatgatcactaactaagtgctagagttgtttttgtttttgagacaggatttcgcttcattgcccaggctgttcttgaactcttgggctcaagcaatctgcctgccttggcatgagccactgtgccttg

SEQ ID NO: 74854 - DNA, 2551 bp, Homo sapiens
tgtctctactaaaaaatacaaaaactaaccgggtgtggtggcggatccctgtagtcccagcttctcaggaggctgaggcaggagaatctctttaacccgggaggtgtaggttacagtgagccaagattgtgccattgcactccagcctgggtgacagagcgagactccatctcaaaaaaaaaaaaaaaatttattgttagatgatgaaaaaaattaatataatttttattttagattcaggggatatatgtgcaggtttgtcacaggggtatattgtgtgatgctgagatttggacttctattgatcttatcactcaaatggtgaacatagtacccaataggaagttttcagcccttgcccactcttgcactccttttggagtcgctagtgtctactgttcccatcttgatgtccatgtgtacccaaggtttagctcctacttataagtgagaacatatgatagaagattttcttttttatattcttaaagctggtagatactttaagactgctggggtgaaggatcagagtaacatcagtttataccatttgtgtatgctgtgcaagcttttactgtgttttgtggtttttctcttaccgcaggcacgaatactataccatgttgtgttttgaagagacattttattctatgatgtggtcaaatctgtgaaatacagagctttttaatgctggtaaaaaagggaagatgagaaaaaaaaagggacatcagtcagttgtaacataccggagatagaatttcaatatatgaagttagattatgttctttaaaagacaaatcaaagtggaactggtttattttgtgtaccaccacatcatgttaatcacaaccagttcctaaattgcaggtggctccttacaagtgttaaagggtaacatattttatcaaatttaagatgctgttgagtgttaagacacaccattttttttctgttactaaggttaaaaatgttgcaatttaattctgacttgccattgtttgtaagatacattccgatttcaaagcattacaatgttttaaaaatgtagacctttcaacctgagaaagttgataacagcaaaaaaatgtggacccttagaaactaatgaaatataatggcaggcctcttctactggccatccagtaaaaggcactgaatatttagtcctgtgtaattattggactaaaaaccatttggttcagtggtctgcaggtgtaagtttctgagcaattataaattgtcttctggatgttcttcaggaatataaagtattttgttttctatcctttgtgcaattctgatattatattttactattttttccagatccagtaaaaacttctgttataatccctttagtcctctttttttcagtttttatgaagaacagtttgtcagcatcttcatttatgcaggacaatgtaatttgacccagtctccatcgaaggcaagagattataagaaggaaggagataaaaatgatgcaagttgttttgaacttccttatgtgctagataatatggataacatgaaagatgccacatacattattccgtagtaaataggcattatcttaagtagtcattgtttttaagtaacctaccaggtcacatatctaagccccgtttttcactgattgacttaattctgtttttcctcgtaagatcttttacatgttgtaaaggtttgtttttttggttattgttttttaaatagccccacatggttatccatttatattatgattttgtaattcaggtttagtttatggttgtcctttatcacttgtttttgtcatgcttgtgtctgtgctcatcttgtatgtggtggcagaacgcaacagttgtcccttttgaattttacttttgttttgtaaaaacctaaaatgcaaagttcctttgttatgctttcttaattgtgttgacataaggttgtgggttttgttttcaagatttccttgatagctgccgtgccagtactctattggctgagctcgatgatgatgaggacttacctgagccagatgaagaagatgatgagaatgaagatgacaatcaggaggaccaagaatacgaggaggttatggtagagagagtaccccattctctttacaaagataggatgttaataattgaaatgaagaaaggaaaagctaagtcataatcaaactttgaagcaaggaaatgtggcaccagtataaaaaatgtagttaattaagaaaagcagttttaatctgagcatttatgattctccacttaaagaaaataagttgcttatatttgaaaaattttagaatgtcacatgatgttttaacaggcttaaaagggtgtgaaattaggctgggtatagggctcatgccctgtagtcccacactttgacatttgtagtcctggctacttgggaggctgaggtaaaaaatcacttgggtccaggagttgcaggctgcagtgagctataattgcatcactgcactccagcctgagccacagaatgacacaaacacacacacacgtacacacgtgtatgaacttagtgcagtggctcgtgctgc

SEQ ID NO: 74855 - DNA, 2090 bp, Homo sapiens
cttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaagtaagtgagcttttccttctggaatccgatgctttttccacttggagggatgcaaaatagggtctcttgttctggctgcagtttttaactagatcattaaccatgttagataaagctacatcaaatttagcagttcaggaatatgaagttctctagaatcataatatttgcagaattcagactaggtgtgataaagaacctcttattttagaagcataaaacagtacttctgattttcactcctttatgatacatcattaagcaaagttgcatgaggaaatagatgactattaaatattatcatagtgcagtgaaaccaaagcatcatataagtatagcttttgtttagactctacattgatcttagcttctgaaagttaaattccaatttaagctgctaacaggtcaaagtaattatataatagtgctataaaaagaatttttagttggatttcagttgggttcccaaagttgttgcttttcaggaaccattttattattagtgtgttttatgacctcactctttaaaaaataaaaaacttggtttttctgaggtttctacaatctcacctatttgtactgatttgcttcatttttgtctttagcttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatggtaagttgtaatttaaaatgaaagtatttagatactttcataatgatgcttttattatgttttctcctgatattttaaacttttgtttaaagagaattattctctcttcttataaatatgaaatcttcgggccaggcacagtagctcacacctgtaatcccagcactttgggaggccgaggcaggtggatcagttgaggtcaggagttcgagaccagcctgaccaacatggtaaaaccccatttctactaaaaatacaaaagaaaattatccgggagtggtggcacacgcctgtaatcccagctactcaggaggctgaggcagaagaattgcttgagcccaggaggcggaggttacagtgagcagagatcgcgccattgcactccagcctgggcaacaagagcgaaactccttctcaaaaaaaaaacagaaaacaacaaacaaatacagaatctttatatataatatgaaaaaactcagtaatacgagagactattaaaaaat

SEQ ID NO: 74856 - DNA, 1917 bp, Homo sapiens
aatttctcctactctttgtaaaccatcctttttttttttttaaggagaatggggtcttgttatgttggctgctttctaacttctgggctcaagtgattcccctcacctcagccacccaaacaccactgcacccagcattttgtcttttatctttgaattatattaatcataaatcattaatgttatgagtcaaatcaatagcgtacatttaaatgtttcgtttttaacttgttctcttgactactttttttcctttgatttcttgattcttgtaatgaactgttgagttaatatgaaagttagtttattttttctacaggtctctgttatataaaaaatctttcccatcttgaatttctttttcatcttttaaaatattacataattttttctctaacatattaacaggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctaggtaaagagatgatacgaggcttttctaacttactaaaacaattacttttgtaaaaagtgatttggtttttatttctccaatttctacctgacagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggtgagtaggtgctcagcacttttgtgtagaaaatgggtagttaaattttttcttttaagataatttataaattgcataaatgtatgagcactgtttagaagaactgttgataccacattacaaatggaaaaaaggtaaagaaaataagggaaaattttaagttcttgggttttgactagaaacttactggtagtattttggaagtgatcaagcctagtgtaagttgagtatcttcaagacacacttccggttttttcccctagtttattttcaagcttactgtgagttttattttaatttcttatgtttttctttatcttgttagtctcacaccataatttttatggtatcataaatcatatagaagaaaaaggattaacatttttactgttttttaataatgcatggaacaagaaacattgtctctttatctgttagtagattattattatttcaaagtgtttcttagcctacctgctttttggggaggagtttatcatgttttctaaatattgctatgtgaatcaagtttctttgatgctgcacagtttagcaaagtcatccacttaataaattgctattaactttaaagcaattatagtggctaattattttcttcaaactataaggctgacttattagcagataatttgcctaaatggcagtgggtttgttttcatcaattttgtatcagtttttggcattaaaaaaagtaaaaatgtttatattctcaacttacaccacatatatatatccacatatatgtgtgtgtatatatatgtatttttttttttttttttgagacagagtctcgctcttgttgcccaggctggagtgcaatggcgcaatatcagctcactgcaacctctgcttcccaggttcaagcgattctactgtctcagcctcctgactagctaggattataggcatgggccaccatgcctggctaattttgtatttttagtagagacggggtttctccatgttggtcaggctggtcttgaactcccgacctcaggtgatccacccacctcggcctcccaaagagctgggattacaggcgtgagccac

SEQ ID NO: 74857 - DNA, 1110 bp, Homo sapiens
aaaaaaaaaaaaaaaaaaaggccgggtgtggtggctcacgcctgtaatcccagcactttgagaggccaagaagggtggatcacgaggtcaggagatcaagaccatcctggctaacaaggtgaaaccccgtctctactaaaaaatacaaaaaattagccgggcgtggtggtgggcgcctgtagtcccagctactcaggaggctgaggcaggagaatggcatgaacccgggaggtgaagcttgcagtgaaccgagatcgcgccactgcactccagcctgggcaacagagtgagactccgtctcagaaaaaaagaaaaaaaaaaagaatctttgatagaaaacagacatttgttcatagttctattatgtttatagttaataaatccaaatctcagttgttttagggtatatcattttttacaattctgagacagaaaccaagacgttttccagagtattttgatcgtttttgtgtagatacttacaaggagattacgatttcggttggaacgtgcacctggtgaaactgcattgattgacaggactggcagaatgttgaagatggaacctttggctacagttgaatctctggaacagtaccttttgaaaatggtgagtttctggcaagggcacggtgaaataagcattctgagctgtggtttagccttttaggacaataatttgggaagtatatatccagagttatggtaatacagtttggcccagtaattccattttagaactgatttctacatgaagatgtttattataattttgtaatattgaaatagtaaacaaaaaccttaattccaatcaataaattaatgttaaatagataattcatattaaaaatttaaatttaattgacaaatgtgtgtgataattatttctattaatttgagtatcatatagccataaaaatgtataaagactaatgataacagaaaaatgtttttgtacagtatgatcaagaatttgttttatcctatccattgaaataataaactaaagaaatactctgtgattattaatagtgaggtgctttggttgtgggactttttatttttctttatatttttaaatgagcatttgttttttgtttttgttgttgt

SEQ ID NO: 74858 - DNA, 1049 bp, Homo sapiens
ggcagagcccccccagaagttccaccatccaacaccactgcactggggattaagttttaacacatgaattttgcggggacacaaacattcagaccatggcaagtcccttccttatcactatattgtaaacataagaaaaaaagtcaagatattttaagcacaatttttttcgggtctttatgtcagtggttagagtcagattgcccaagtcttcactattcctatcaatcacatggtttcatagcctcttttccttccctcctcctccccatacagatatatatatatatatatctgtatataatatgtaacttcctatttacattctcattcattcaattattcttttctttagtagctgggatctagatgcaaacaaacaatacattttactaatgtcctagcccagaactttatcactttttttgtgggttttttagtgtttcctagcaaggccttctgctttgaattttgcctttatctaaactgttctgcattctactgcatggaatagtttcttttgaataatagcctttaatgagtgattgaggatctatatatgccaaagcaatgcaaagctaacaaaacttgccatacctctgagaacccaatactgttatcagtgccactagactcccaaactagagtacttatttagggagttttacagtgcagtagttgcacctgatattctatatgtaaaagatgtggagggctactttgtgttttgtttcagacagaataacaggagtaatggggactgtttggtccattgtttttaagctttattcctggtaagtggatgagttggagataagtctcaaagacagtgcaccgatgccttttattatgcatttttcacttcaggagattgtgcaagatccaaagagaggaaggccaggaatgtgctctctggtaattttgctgtctaaaactaccgaaatgcacatataaatctttaattgtttttataggaattagttaagatttatacagaaatgaatctacctaaaattgctagtcctgtgcttgttgcttactaaaatgta

SEQ ID NO: 74859 - DNA, 1062 bp, Homo sapiens
gctcaagcaattctcttttctcagcttcccttgtagctgggactccagcatataccaccttgcccagctctgcaagacgatttttgaaagttcttgattcaaattttcacattgttttccggaagtgtcattgcagtttacactaataatgagaaagtatatgttgtgataccctagccatcaaatattttttcaaaactttgttgctttatattcttttttatttatcaaatattatccagtaaaattatttaaactttaaaaataaatcatacatctgctttaaatataattaagtttttattagaaaaatgaaatgttttattcttaagtaaaggaaattgagttgtgagagtatttctactcagacataatctaatacaaaaattaaactgtagtcatgaaaaagtaggggtatatattgaagttgattaccatattttctgcatgaacatttacatgtagttatacaaaacctcttaataataattatttcttcgcagtcgaccagcagttgcgttaattcgaaagttaatagctgtactagaatctattgaacgtctacctctccatttgtatgatacaccaggatccacatataacctccaggtaaccataaaaaatgtagtagctagtattgctgaatgcatctaggaacagtgtgacacttttctttaaaaaaaattattttctttcacatcggattaaaataaaaatgattctacttaatctttaaagattttagcttatatgccatttgattgatcttaatgacttgaagtctgttttgtttgatcaaatcactggaaaatgatgcattcatttaatatttgttaaaagcattatatttcgtagatcataagtggcaaaaggtatcagtggaaaaagctgagaaaagggttcctcttattctacaattatgagtcagttctgtcttagtccatttgggctgctgtaacaaaattcctgcgaacttaataaacagaaattcattgctcacaattctggtggctgggaagtccaagatcaaggtgctagcagatttggtgtctcgtgagggcc

SEQ ID NO: 74860 - DNA, 1032 bp, Homo sapiens
attcactggaacttcaatgagtcccatagtcccttcataaactttactatttgcatttattctcatttattatagtgatatatcacattatatcacttagtaatctatgaaatagttttgatgtaccagttttttcctaatacttattaaagtaaatagtactgttaaaatggaaaatgttcattcctatattaatatagtctgaaaccatcttgtatacttggggaaacactgattttgcagcataattggtgagtatattataacattgaagaaggaaaaaattttgtatgttagccatggcctactagtcacatactaaaaataattttaattgaaacatgaaatgatgaatgattttattcacattgtagtgatcattgtataacaatatgttaacatttgtctcttagtttttgatgaatttcagtaagatccttaaattatttttttttggactttatactttttgttttctttagagcatggatttggatatgaaacaagattgtagtcaactggtagaaagaataaatgtttttaaaactgcctttagtgaaaatgaagatgatgaaaggtaaaatctcaaatttctttgaatttgatgtttgtaatgttcacacagttggtatacttcctctaaaataagtctagtgtaacatttatgcacacaaaagaaactcttaataagaaagtaacatattatacatgtataataagaggaaaatttttgaagttttttttaatctaatggaataaaaagaaacattgaaattacatgtctggtatgaatgcagctgatcacttagtttacttattcatgataattattattttgtaaattcagacaagattttgctctgttgcccaggctggagtacagtgatgtcatcttggctcactgcagcctcaacctcctgggctcaagcatttctcctgtcttcgctgcccaacgtgttgggattataggcatgaaccaccgttcctagcctgatcacttagtttaaattacatgcctgtttaagatagttg

SEQ ID NO: 74861 - DNA, 1726 bp, Homo sapiens
taatactgttttataaagagatagtttcttcaaacttgtcttatatccatgattgccatcttttaattctgaagggcataccaaaatagaatagaaagtattattaagtagtttagagagatacgtttttttctgttgcattagagttatgctgggtttgtttgggattaaaatggcattaggtgaatcctaaatttacattacttaagcatatatttttaaataatatcatgtactaaatttcatcagacccagaacatacataggttgtttcctcaaataactgtaacttcgagagctcatttgtgcccaaatgacagtacatacgtaccttttcgtggtgaaatatgtaaatacgagtgtctataaaagtgaagatttggtaaaattattaattgtaaaaattcacatttgttgtgtttattttggtaggtacgaactatggctcgagatttatacgatgaccattttaaagctgttgaaagcatgcctcgtggagtagtggtaacactcagaaacatagcaactcagttagagtcatcttgggaacttcatacaaatagacaagtatgtcatcctctagattttaatgatatgtagtgaattttagtttgatgtcttcccctctatcctttatgtcatgggtattgagtagggggtcagcaaattatggcccaggagccaaatctggcctgctccccattttcgtatggctttatgaggtaagaatggtttttatacttttaaatgattgaaaacaaaccagaaggacaatttcaagacacatgaaaatcagatttcggtatccatataatttaatcacacatagccatgcttattcatttacatattgtctatgactactttggtgctacaggggcgtggttgaatagctgtgatgtagactatatggcctgcaaagcctaaactgtttgcactgggccctttacgaaaacgtttgctgacctctggtagacataatttgtgttaataatttgaacttttaattttgcttaatatctaaattattgtcatgataattgatgttctgataagttattttaagagctatgtttatgtttttgattgccttcattaaatttttttttcttttagtgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaatgtaagtttatcaagtagtaaagaacaaaaatacagttttaaaaattatttgtagttactccttcggtagagtggtttttagtttgttttgtcaagaaatatttaaaagctgaatgatgttaatatttctaatttcttcagcctttaggttttatgattagtttgagccaaatgaattaaataattgtttattttgatttctaagttcccagttataatttgctaaaggttttgttgactaaaaacacttcagcttgatttgttattattcactcctctgatttttacataagttatataaaatagaatatgtctgtagaccttaagtacccaagttatatgcataatgtgtgaacaatgaaagtttaggaagtttatgatggaaggaactctccacagggcttgttttccaaagaaaagtgttgtttggaggagcaaagttataagcctacctaagcatatca

SEQ ID NO: 74862 - DNA, 1025 bp, Homo sapiens
tgtatcagtagagaaaaattattataccatgaaaatatttcctaaatgtctttttactgcatgggacaaggaacaacactgtatctactttttaaaaaatatctttacaaatatagctcctttttttttttttttttttgttttggagacagtgtcttactctgtctcccaggctagagagcggtggtgtgatcatagctcatggcagcctcaaactcgtgagctcaagtgatcatctcgccttagcttcccaagtagctgggactacagatgcgtaccaccatgcctggctaatatttccagtttctaatttagttttattgtttaaaatttatattttaataggtctttttttcctaagagaaaatacatgtcatacttgaaagaaataagattttgaaacaagtattttgtctttatagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggtaagtatgtagatatgtaagtttattgggtacaaataaatgaatatgttaaattgtaacaaagtaagctctgtgaatattcttttttttccccccaaggttcagaatttgtgactggctggactggcaaaagaggcagaaaactgaaatctaagttagaaaaaacaaagcaaaaggtatatctgttggatgtgctttattcttgtcttttatactgatttgttaaattttcagtggtaaagtataagcactgaaaaaaattgagccatagaacataagcagccctaatataatatatttttagtttttctattttctgtgttttcttaaatatttatt

SEQ ID NO: 74863 - DNA, 1113 bp, Homo sapiens
atgtaatgagttcaccaaggttttaggttattatgttgttgtgtgtagtgctctaatccattagtctttaccccactacacctggacatgatataatataggtcattatttacatgaatttcttaatatttttaacacttatttgtaagatttagttataggtaattaattagtcagaattgagagccaggtgccgtggcttggacctgtaatcccagctacttgggaggttgaggtggaaggattgcctgaggccaggagttagaggctgcagtaagctatgatgacactattgcacaccagcctggatgacagagttgagaccatgtttctaaaaggggggaaaaagattaagctacaggcaattgagtattatgttcagagtatttaaatttgaaattaaattagattcatgtttttaaaatatgtatgaatatttgaaattgaaattattttccatgtttaattgaataattctacacatttaggaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcaggtaatattttgtttcaattaaaatattttcctagtttctacagtttggtttttttctcatatttttgctaccattgtcaaggtattttatttttttgagacggagtctcactctgtcacccaggctggagtgcagtggtgcgatctcggctcactgcaacctccacctctcaggttcaagcagttctcctgtctcactctcctgagtagctgggactacaggcacctgtcaccatgcccggcttatttttctatttttagtagagatggggtttcaccttgttggtcaggctagtctcgaactcctgacctcaggtgatccccctacctcggcctcccaacgtgctggagttacaggtgtgagccactgtagaaacaaaaatatttgtttctttatttttta

SEQ ID NO: 74864 - DNA, 1366 bp, Homo sapiens
ttgtatttttagtagagacggggtttctccatgttggccaagctagtcttgaactcctgacctcaagcgatccgcctccctcagcctcccaaaatgcagggattacacgcgtgagccgctgcactgggccccatttattttcttagtagttgtagtactttttacttgattttctaaaattatcatgacatgttaacattcatgctagtaaagtgtagaatatagaatagaaaagtgcatttaagaaaattataagtcatttttggtgagctcaatatatttataatagaaaataaatggaattatttcaaaaatgaacatatagtgctgagtcccaattttttgtatttttttattaagtgtatttttttagcagagtgtataaaatgtaacattggatattttactgttcattaatgcatgcattttgatttattttaacttcatttggcttcatataattctatttttacttttcaaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggtccgtttctttttcaaaactctttagcattaatttcctttagctagtagtctgaaataaaatttttgttttaatttcagtaaatcatgttgtgcaaattactgcatttctctactcctggcaactaaacttatttttattttttatttttcaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagtgagtggtcttaattatagaggtatcaggaagagttttttttttttttttgaggaaaatctagtttcaatttttgatggtttttgacaggataatgacaatatgaaataattctgtatattttttaaattggtcaattttcttttaaaacattttgatcaacaattttaaacatatagaaatgttgcaaatatagttaaagaatatcagaatactctctatccaaattcactagttattaacattttgccccatttcctttaacattttttcagacacatgtatctgtttgtgtgtgtgtgtgtgtgtgtgtgtgtgtgtgtactttttttttgagatggagtttcgctcttgttgtccaggctggagtgcaatgttgtgatctcagctcactgcaaccttcacctccctggctaatttt

SEQ ID NO: 74865 - DNA, 1051 bp, Homo sapiens
aaacacggcaaaaaattaatatggaaaaatgtatttcctagctgggtgtgttagctcatgcatgtaatcccagcactttgggaggctgaggtgggaggattgcttgagtccaggagtttgagaccagcctgggcaactagtgaaaccctgtctctacaaaacacacaaaaattagctgagtatggtggcgcatacctgtagtcctggctactcgagaggctgaggtgggaggattgtttgagcctgggcggtcgaggctgcagtgagctgagattgtgctgctgcactccagtctagatgacaaagtgagatgctgtctcaaaaaaaaaaagtatttccttactagtaaaaagcaaaacattttagaaataagtaaaatttggtatcatttttacctattagacagttaagaaacttaaaaaatgagaattttttttaagtaaaaaggaatattgtagatattcatatttagtgataatttaaggtgttaacaaccttttttgaatcagtttgccaatatgaatgcagtactcatacacattcaatacttaatgaaagtgtttaggctgttagatccaagaatccctctgtactgaaggaatatgaagaaactgtttacacaaaaataaatagtgctatttttaatagaaaagactgtaaactaaatgttcaaaatttatataatagtgttaaacaggaaaattttatgttgtgagtattatgtatcatctaattaagagatagaatttgaatacaggctctgtaatttattagcttggtgatcttagtagactgacttaactatcgctcagtatcttcacttgtaaatttgagataataaaacccacctcataggttttgttgtgtgggttaaatgaattatgtttttaaagtacataaaaaggttactgctcatgatggctcagtatacgagagagagatagataaataacatataaacattctaatacattgttaattgaaataagtcatgatataaaactaatagttaaattctggtatttacagtggaatataaataaaaactggg

SEQ ID NO: 74866 - DNA, 1078 bp, Homo sapiens
gggttgatgaatccagaagctctgtgaaataatttttggaacgaagtggagtatccaaaattatcttcttaatttgttattgagcacattgaagttactagtgctctttagtattcttataagcatcattgaaacaatgttctaatttcagtgtatttgttaattagagataattattatttgaagttggatatatcttaaggtttttttccttgaaagcaaaagtttccaaaaaagtatttctttaaaaaatatttgtctgtaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggtagttattcatactatttgatgtgttagtcaaattacaccaattatatggttttatttatctcccttttccagaagtatttgaggtttattttaatgttaaaaaggtgtggtaagaataaaatttagatgagaagtgggaaagccctatcttttcttctgacgatctgaacgaagagaagttttagaaaagattactagattcttaacaaattttaggtagctctctgaatattaaatctctgtttgataagtattgcaaccacttattgagctttttagaagcctgttggtagggacggtatgagatggccactggaggagttatacagataaatgagatttggctcttgcttactcttccccttgcgggctagtaaggatgtatgtgggtaaaacatagagtggtaaatggtagattaggcacatattcagggttctctgggaatatagataatttaacaactaattgggctgggcagattggagacagttttatgcagaggtgagatttaaattgtggtttaaaggatacttaggagttttctaggcagacagatttggaagcatgagtgaagaacagtatgtgcaaatgcatgaaggtatgaatccatccatcaggaactccttgtggctctc

SEQ ID NO: 74867 - DNA, 1050 bp, Homo sapiens
atgataaataaccaagtacaattaattcataagtttttcaagttacgataggctgctttgtattgttttttgagatggagtttcactcttgtagaccaggctggagtgcaatggttcaagcgatcttggctcactgtaacctctgcctcctgggttcaagcgattctcctgcctcagcctcccaagtagctgggattacaggcatgcgccaccacacccggctaattttgtatttttagtagagacggggtttctccaggttggtcaggctggccttgaacttccgtcctcaggtgacccacccacctcggcctcccaaagtgctgagattacagaataggctgcttttaaggtactaagtgcaaaggcagagatatggattgccacctgcttgattaagtaattctggaaaatctttagtttacatagttggatgtcaaagaaataaagtattgttatattcaaattaaatgcttttcttctctagactctgttacggcatggtgcaaatccagatctgagagatgaagatgggaaaactccattagataaagctcgagaaaggggccatagtgaagtggtagctattcttcagtctccaggtgagagctacattctttcttttgaagccatctactgttatttttcagctttcacttccatagctttctgtagacacattaaccttatataaatgaactattcctatgaagtcaaataattatatatgtatatccttatatttaataaacctgtttaacagcttaattttctatgttctttgagattgtgactgcctgattccagaataaccaaaatctaaagttcaaggaatatgggaatgtcagataaagaatactttggtattgtttagataggtagtttgaccaaaaaaaatttttttttttttttgaggtggaatcttgctctgtcgcccaggctggagtgcaatggcgctatctcggctcactgcaagctccgcctcccgggtttacgtcattcttctgcctcagcctccctagtagctgggactacaggcacccgccaccg

SEQ ID NO: 74868 - DNA, 1052 bp, Homo sapiens
gggacagagtctcgctctgttgtgcgggctggagtgcagtggtacaatcttggctcactgcgtcctctgcctcctgggtttgagcgattctcctgtctcagcctcccaagtagttgggattacaggcatgtgccaccacacccgcctaatttttgtgtttttagtagggatggggtttcaccatgttggccatgctggtctcaaactcctgacctcctcccacctcggcctcccagagtgctgggattacaggcgtgagccacggtgcctggacttaaatactttttcttagctgatctcaagtttgctgattatgtactgctctatagttgacctaaatatttaaaacactctcttggctctttatttagatgatgactaatgacgatcttaaaatggttcagtctttagaaaagtttagtattttattggctttaaaaatacgtttctttttttttccttcaaaatttcagcctttgaagtaaattttatggatgatgtaggtcagactctattaaactgggcctctgcttttggaactcaggaaatggtaagctaataaataaaagctggtatttaaattaaggatagaaatattaataaaaagcagctttatgattcgttatcattttacaggtagaatttctttgtgagagaggtgcagatgttaatagaggtcaaaggtcatcatcattacattatgctgcatgttttggaagacctcaagtagcaaaggtaaagtctaggttttaaaattactaatttttaacatttacatggtttaaaaattagaatgatataaaaccttttatttccatgccatctccatccacttcattcccccttactcactgtaagtgtttttaattagttttttctttttagtgtttcctaatacagattcaataaaaacaaatatatatatatgtgttccctccttttcttatacactcacctgtactttgtttttttacttaataatataaattagagatctctccctgttagcatgtagagaacttttttatatctgtatgcatatcctgtactac

SEQ ID NO: 74869 - DNA, 1086 bp, Homo sapiens
gcaatgggcgataatggctcactgcagccttgacctcctgggctcaagtgatcctctcacctcaacctcctgagtagctgggactatagcacatgccactactatgcctggctaattttttgtatgttttgtagacatcaggttttgccgtgttgcccaggttagtcttgaacttctgggctcaagcgaactgccaaccttggcctcccaaagtgctgggatcacaggtgtgagctaccacacccatctaaaatgtattattaaaattaatttcatttgtttcacttttctgtttttaatgtgtcactaataaatttggagagcgcattgtttctgtgattcttgaaaatcaggcttgcattctttcgttacatttgttttactattataggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtaaataagttgctgttacatactttccattttcagaaagtgatttttttagtgttcccctgtttataattatgatagactgtaatttgtgcttttcacttgatgaaatcgaggtaattccatcctctttctctaattttatctctgcatgtggtaatctccattttgggaatgaaacttttaagattataagtgtgatatatgtttattcttaaaatttaaatatcataaaaatgtttttacagctgtacttgtactgagtgtaattttgctgacttggtgcaattttgttgacctgattttgttgacttaagatagatctcatttaaataagacggtattttttatttttattattttttttttgagatggagtcttgatctgtcacccagggtggagtgcagtggcatgatcttggctcactggaacctctgcctcccgggttcaagcgattgtcctgcctcag

SEQ ID NO: 74870 - DNA, 1944 bp, Homo sapiens
tataggcatgggccaccatgcctggccattttttttttttttaaacatgctttcaagttaatgctgctgttttaaaccatttacaccttggtattctcagcagcgatgaaattagcatgtgagtattgttatggaagcaaaaacaatgtgagaaatattacctaataaacattcagacacagtattgagcacagtgtgttacattataactttttattttctattattttgttaatattttgctgttaagaatttaataaccctagatgtaatatgatttctttcactacagatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtaagtattacttattggctcattacttatttttctcagacctctcagggatgagtattggctcatttaaacatcacttagagactgaaaaatgtatttactaaaaaaaaaaaatttctaaaaaaaaaaattcttcctatcttcagtcttactttattgagagtagttgagaacagtggaaatcacaacacttgtggcaccaaaggaggttccatgggacttgcgaaaagaaatcttatcttagaaggaaaactgtaggtgattgctatgttatgtgctgcttcagtgcacttcagttcctggtagtcacttagagataggttatccctgttcttacccaaatcattttgtattataatagtaacaatcaccaccacaacaaacaccacccaccagtgctagacattattctaagcactttaaggtattaactcatttaatcttcacagcaaccctatatgggataggttggtgccaggaatagtattattattattattattattattgtttttgagacagttgctgtgtctcccaggctggggtgtagtggcacgatgttgactcactgcaacctccacctcccagttccagcggttctcctgcctcagtctcccaagtagctgggactacaggtgcccaccaccacgcccggctaatttgttttgtatttttagtagagatggagtttcactgtgttggccgggctggtcctgaactcctgaccttgtgatccccctgccttggcctcccaaagtgctgggattgtaggtgtcagccaccacccccagccgaatattatcatttctctgttacagatgaaagaaattcaagtatgctgaggttaaggaacatacttgggagtagtgagcagaagagtcaagacttgaagtttaggaatttgaagattaggaagtttggttctagggcccagggatttaactattttgctatattccctgtaaagtaagctgttgtctttatgtaactctaaaagcattagtgctagatccatacttttttggaactatttgtggtgaatacattgagattttacatgattttttttttttttttttttttgagagatagtcttgctctgtctcccaggctggagtgcagtggtgcagtctcagctcactgcaacctctgcctcctgggttcaagcggttctcctgccttagcctcctgagtaggtgggactacaggcgcgtgccaccatgcgcggctaattttttgtatttttagtagagatggggtttcaccatgttggccaggctggtctcgaactcctgacctcaggtgatctacctgcctcggcttcccaaagtgctgctgggattacaggcttgagtcactgtgactggcccctgattcttttttcttttcttgtttttttttttttttaatgatttct

SEQ ID NO: 74871 - DNA, 1748 bp, Homo sapiens
gctgcgttacgtgggacccaaagctgtcctccagtcagggcgcttacggggcgcttttgtaatgacttacctgttggggttgcttctcggttttgtttttgtttttttaaccaactgccctatcttgtgaagctggggaaagagggccctaggttggcctacattcgttcggatccgtaacctgctggtccattgcatttacttttagcctttccttttttaatttttttatttttttaacttttaagaatagttgccaagactgccaaaattcctaaccaactctttattcatagataaatcttgtatataattgtcgtttgtatttggatatctttaaaatagaagtaaattgagaagtcagcagaatatgtgaaattggaggtaattttgaaggagaaacaatttggagggggattggatcaaggtgtttagagtttcctcaaaatactgaatctaacccttatctgaagatcagttttgggtagagaaggagggggatgaagtttgctggaaaaaacagaacctttagttaggtgttctttgccttttggcatagactttagtgatagcagtagtgggacctgaagcttgactgactgtctttgacacagacagctctggtttctagttaagcagcaacctaatcagcttatatactcttgtgcaaaactggttttcatttggtatgatatctgtacgttaaacctggcggataaggaaagttgaaaaactgcattaagcactcttacgtccaaacgtacttaggagtcttttttaattgctaggaggacactatgaaaatttggttctagcagatgtaaaggaagaaaaatttaagcccaagctgttcagtcccggaatttaaaggacttttctccctttacttttcaaatttaagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacgtaagtacattccttcatcatgttcctttgggttactgtagtgacatctgttttcaaccatttgctgacttcagtttgtgtagaaatttctctagtgaattttaacacgtatctttaaaaatattcctgaagagttttgtgtttacacttttccaagaaataaaaattggtaggtgaagaaactctaggactgatgattacgatgacacaaatacatatttgttgaatgaatgggaattagtaggaatattaattttaacccatagcttggttggttcattttcaaaatatgtcatgaactggggaaaatacaaatatttattttcttaaaggtatctatttctgtaccatgaaattgatttatggaataagagatgataataaacatatgttttgaactgcccatttcttcattgatgttgtcatatgacagtacttttgttaaagccgattattggtttgtaaatttcagtttgggaaggtataaattggatcttaaccgtgtagcagaagagtagaaaatttggagtagtagaaacattttgaagtttggggagtttaaacagttttattgggaggttataacttagtatatatgcaaaaatataaaagagaattcttactagatagaccttacagccatttttttccctcttatataagtcataacttgtccagtcagaata

SEQ ID NO: 74872 - DNA, 2026 bp, Homo sapiens
acgaattgttttctttagtggggaaaaatgtatacagatcaagtgcatttgcaggcttttgttagaaacatttatgtcactgaacttatattatttgtttactttctaggcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtggctcatccctgtaattccagcactttggaaggccaaggcgggcggatcacgaagtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaaaaaaaattctgccttattcagtaattgtattaaactttctctgatttctccaagaagataaaatgattggagagctatttaggaaacctggtctaggattatccagtatacaatagtacaaattacttacagccttacagtgcaacataagatttggtgtctatatcatggttttccaccatcttttggtttagtttatattgggttcagaaattgagtcttactcattttaaatagaataagccatttccactatttttcaaatggatttttctgtttacctctgttcttaccaattttgttcattttcatttgtggcaaacatttgtatcaatgagttttaacctaggttcatatctacattgtatttagatcaactatgggtttatataaatgccaaatttagtacaacaaatttaggtcatcaggtgaatacaagtattttttttaacaggaaacattttattatagaaaaaagattaatgataaagtcatattggttgaaaaatattttttaactgtgttcatgattgttgattctccttctacttcagtgttatactgtgtgaatcaagcactgtgtcaaaacagagcatttccctcttaaaaattacaaaccgaagtgatagaagcatgtcagaattgagaagacattttgaagcaagaacaatgtgatgtacctattttattatgtttgtatataaatactattgtaaattgttcagagtgaaaacatttgacaaactctaacactacaatcattttttctaaattacataaataaagctaattttcattatcattcttgtatttttaaattattttaccaacaaaagatggcaggttggtttctctcacatggattccagaaaatcagccttttttctcagaaga

SEQ ID NO: 74873 - DNA, 1062 bp, Homo sapiens
cagccctatgacctatcagttgtactcccagtaaaaataagaacattgataacaaaatactgataacacagcagcatgaatgaatctctaaaaatgttgttaggttattttgttaacaatatattagtcacaaataagtacatatgtatatgtgattctatttatatgaagttcaagaataggcagaactaatctgtgctgataaaaactagaaagtagttgccttagggtatagggaactgactgaaaaagggtacaagggaactttcggagtgatggaaatggtctatatcttgtaacagaaaaaagagaaaatatattggaagttaatctcttatttttcctgaaactgtttgctttaggtggtgctttctacacagcagagactagtgaaaatgcaaaattgcattattacaactcctgggcacttatcctccatgctacagcattgtggcttacaagcacgggttttgttgttgctgacccagatgaaggagcatctaatctctccaggcctgtaacaccaacttccatgtgtcagggttcatcatctggggctaccataaagtcccctgaggatgtctacactgatagattccatcttattttaggtcagttaaaccacttttacaagtttacaaccttaggggttttttgtttttttttttttgagatggagttttgctctttcacccaggctggagtacagtggcacgatttcaactcaagctcacaattattgtcaactgaaaataaaaatataaataaattacttaagctctctgctcatttatgtcagaattagtgtcaataatagtgcctactttgtcaactattacgagaatttaataaaaagatgtatgtcaaagcacagtgatacttggtaatcacccagtaaattttagccaaagtaaagttatgaaactccatatgttttccggtgcaattttattgtaatttttgcagctttgaactgtttcatagcaactaagcaactagtgcacaagcctagtttagattttttttttttttttttttagacagagttttgctcttgttgcc

SEQ ID NO: 74874 - DNA, 1050 bp, Homo sapiens
agccgagcgtggtggcgtgtggctgtagttacagctacttcaggttgcagtgagccaaaatcatgccactgcactccagcctgggcaacagggtaagaccttgtctcaaaaacaacaacaacacaaaccccacagaaatctgaatcatttcctaagtctagaaaataaatgaaagaggttatatatattatgaaaattaacctttatttatttatttatttatttagagaaacgttgtgtttaatggtaaagcttagcacaccccagcaccaggaatggcgcggagttgcagctgcagggacaggcaggtgaccctcacggagcctcacatggcgaacaggatgaagaaggagatcatcaaacagaagagccccatggcctcagacagggcaaagcccagaatggcatagaagaggagttgctgcttgagagacagcttcctggcatagacaataatcaagctgccaaacaccgctccaatgccagcccctgaatcagccacaccaactgtggctgacccagcaccaataaacttggcggctgtgtcagtgtcccgggagacaacactggtctggaactcccgtctggccacctggagtggggagctgctgtaggaaggctgtttagatgaattctctgggctattcaaggagaaggcagacacaggcctgattagacccctggtacaacagcagatcagagctggagaaatgagtaataccccggtggtctgcattttttcagtctcccagctttagcccttggtctcagcactcagcttcccccacccggaaaatcaacctttaaagttacaaaacacttgtttttttatttttgttttctttaacagggccattttttttccccctctctggagatggaggtctccctatgatgcccagactggacttgaacttctgggctcaagtgatcttcctgcctcagccttctaaggagctgggactacaggcatactgccctgcccaaaagacatgttttatgtactttgcttttacttgaagctttataaaatattagctgaaagatttc

SEQ ID NO: 74875 - DNA, 1043 bp, Homo sapiens
actgcatgctctttaacttccgttctaaacttggccttagctacactagcaattctgaatactcttagttttaaaacttggcttctaagagttaaactataattaacttctgatgaggtaaaccattaactttgcctcttgctggacacctgttcatgtgaatgcaatccagatcactcctctcaacacttatgtctacttgattgggtttgatactgaggcttaatcagagattctgaagaaaaacctaaaattaatcacatgtacattttaaaattatatatttacgtcttagagttcttgagttgactattttcaaaaacttggctcaactcattttgttggaaaataaaatatttgtggcaaatttttaagctgaagctaagccaatttaaataataactatcaacatttatattttaatgcttagctgactgttgtcaaagtcatcctaatatttatcttttggttttgtcatgactggtgtgtcatttgtttttgtgcaggagatcttgttggataattctgtgttggtaggtccctgacccttgattcctaactttttttgagttttgcggtgctgtttctttgtgtcattttttggttgtagatgtttgtttcctctgcatctctttttttaagcgaaccattaatgctaagtccagtatgtgtagcatgtttcgtggtgtttatttgataccagtataagcaaatccttcctaaccttctccagctggtgcactcactccttgcactaaatttggtctcatttttatttaatatattcatttcagaaaataattgtagttacagtttaatttaatttctgtattttgcctgctttgtttgtttgccttaagccactgtattcctcttcccaatataaatgctggagaatgacatggagacattaagcctcccattttactttgtgtgacagccttcaatcttttttctaccaaataagtaaagggtacttccaagcatgctttttctaaaagatgtttgactagcctgaataaatgctgcacctgctttgtatt

SEQ ID NO: 74876 - DNA, 1079 bp, Homo sapiens
gcaacaagagtgaaactccgtctcaggaaaaaaaaaaaaaaaaagatttaccatgtcaccagtttctatctggacttgcctcaaaaactgagttgcatttggaattataaattggcaccatggcttttcaaatttttctactcctgcagtattcgtagcacactcccattagtaacgtgactgttgaaaatcattatatagacctttcattttcaagcttgaggcaaaatatgcagcatttcagagcttgaaagaacctcagaatcttaaaaatctgtcgtgtagattatccctacttttgtagaatggtgtttgcattattaaaaccaatcttctcagtaaaaagataaactgaagaccgaaaagttaaataaagtaacacatctagctcacctaagtggtggctaaatctacattgtgggtttctggactcctccttcagtcctcatttcattattccatactacctttgtagattttatggatagatcttatctcaactctgccacctcctagctgtgcacctttagggaagtcccgtaatctcttctagcctcagctaccttgtctgcaaaacatgaggattacacaaaatgctgcttgtaaaggcaaatgtctcaggcatttagttagtactcaataatggtagttgcctttgctgtcttgacatgtgtcttcaacatacagtatattattatattaattattgatactgatagtcatataaaactatttatttatttattttagaggcacagtctcactttgtcaggctggagtgcggtggtgcaatcatagctcacagtagcctcgaactcctgggctcaagtgatcctcccccttcagcctccgaagtagctcggactacagtaaagtaccaccacacctagctaattttttttcttttttgtagagacagggtcttgctatgttacccaggctggtcttgaacttctggtctcaagccatcctcctgcctcagccccacaaagtgctgggattagaggtgtgagccaccatgcctagcccaataaaactttaaaaagagaatttgactgactttctgatagaaacttttg

SEQ ID NO: 74877 - DNA, 1043 bp, Homo sapiens
aggcatggtggtgtgcgcctgtagtcccagctactcgggagaccggaggcaggagaatcacttgaacccggaagccgggggttgctgtgagccgaaatggcaccatcgcactccagcctgggcaacggactgagactctgtctcaaaaaaaaaaaaaaaaaaaaaaaaaaagaataactaatctaacaatctgtaacttagattatccctacttttgtagaagaaattgtacatcacagatttgtagtgactgtaaattttaaaacctgtaatatatgtttaaactggaagtaaattttaaaacctgtaatatatgtttaaagagtaatgtttttataggccaattattaaaagctttctgctttttattttaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgagtatagaattgtaaacgagctcttagtttcttttatttgaatcttagatttattccagtacacattttaattatactctagactatgtacaaagttatgtgttatatacgtagctatttcccctcagttctagtctttttcgggagtagggggcagctttcatgcaatcagctcctaagtctctcttctattaatttttctcccattgttgtacttgatatttggaatatttattcataaatcaatgaaaacatattgtgtgcttataatgtcccatgtactatataaatgctgtaggacatgcaaaactctatgtggtcacctgtctttttttcttctttttcatctattctaagttctttgcatcccagatggagaaataacacttttccttaatattccagcaacatatgcatcaatatctggcttctaatattgtatctactgaatgtagaaagataaaggccatcaaccagaagttcctttgaagtggtt

SEQ ID NO: 74878 - DNA, 1018 bp, Homo sapiens
aataggagctcatttttgcagcatttaaagtactgtaagctttcttatacatccattgataagaggaataaaactttttcagttcattttctgaagagagagcttttaatttacttcttgttatagaacattaaaacgtacacaaaattagaaagtatactgcaatgaatctattatactcatcacctaacttcagtggttatcagtatatgaccagtcttttttcatttaaaccattgtgtgtgtgtgtgtgcgtgtgtgcatgtgtgtgcgcacctgccataaatgcacatatctatgtacaaacagtacattatgtaaccacctcccgaaatcaagaaacagtccattatcaataccccatacacacttctcatactgtcttctagttaactacctgcccccaccaaggataaccactatcctaatttgcaacagcataaattagttttgcttgcttctatactttatgtaaatggaatcatacaacatatattcttttatgtctggttttcttcactcaacattatgttcaagagatttgtccatattgttgaatgtaattgtagattttgttgaatctttttaaaaacttgaattttcattctttctatagattaaacaataaacaatttttcaacaaactagatttgattcaaactgttagctgaagtaccaactattacttgcaattcttaatgatgaactatatcattctaaattggatgattgcctctgagttggaagtcctccatttctctttccacatgagtagtagcattcacatttgctgttactttatcacttgcttcaacaaaagaacaagttaatttattttatgtttcttaatgctgctgtaatgtttttaattgtttttctttgtcattacagacctgggcattacattctctatcattgatcattgattctgctggcccactctattatgtgcatgtggaacctaccctttctcttattataatgttgttgttaaatgtgcctcctactcatgctgaag

SEQ ID NO: 74879 - DNA, 1035 bp, Homo sapiens
ggtaaaacactgtctctacaaaagatacaaaaattagccgggcatgatggtatgcatctgtggtctcagctactcaggaggctgaggtgggaggatggcttgagccggggagacagaggttgccataagtccagattgtgccactatgctccagcctaggcaacagagccagaccctatctcaaaaataataataatagtaataaataataataacagcatctactattttaaagagcttaataggtaccaggtgttacgatacattcttctaagtctcatagtaattcttttagtccttgtaataatttattagggtgtatatagcccattatggggaaataaaactgaggcttaagaagctaagcaacttgctcacaactgaaaagctaataaatcatggaatcagatcaagaacacaagtcatagactccaaactcctgttcttaaccactttaccatatcgttgtacatatcttacctatttctgtcagtaaaatcatcattctcctatcttaatcaaatatggaatgatttttatttctcccgttcttttactccccttctgtcgtcttatctgtctcccttattaatgtgtgccaaattactgtcatagcctcctaattcgtcacatttttaggtccttttctttcgaactctctctagatataaggctaaattcgttttcctaaaagattttcatcttgccactttcctgcagaaaagcttgacaaagtgcttattgcttcttgaatcaacttctttattccagtcccatcaactgaccccacagatgttttctgttactacctcaaagtgttgacttctacagatgatttatccacatgtcattctcatgtctacatttaccttttctttttctcttctctccttacatgcctatttgatattccacatcttttagtcttttaagatccagtataaccaccatctcaccaagctttaatccagttagctttccccctctgaattaccatattactactcgcctcctccacttcatctagtacttgac

SEQ ID NO: 74880 - DNA, 1034 bp, Homo sapiens
gcttattttgtggacatctctgttaatgttctttcaaaccatttataccttaatgataattgattaccgtattgctgcctggaggtttaaaattctaaagtgctttgtaaaaaaaaatgaaattatatttgtattatcagtgtggatttttgtgttcttatttgtttttaagtagtaatccaagtatgaacatatttggatttggttaaccagaatgtacattcctaactggatatgagaatttactacaattgtaagtttgggttgttctttacatatttcagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaagtaagtgaatttcttatttaatattcagaggctatgtttcaaaactgggtatagctttctggcttgttggaactagtaagatcttcattctgagatttaactaagaaaagaaaaattgtcaaatgttgactgctaaaggaaagaaaataaaaattggccggctggtcttggcacataaaacaactactatttcagctatagtctttatataataagaaagatcagaatctatatgagtgatgtaattgatcatcaatgggatggactctaggatagtgaaatatttatacagttttataatgtaaaacatatatgataagtaataagaacaaactacaggaaaaagaaaaggctgtaggctgcagatgaggaaacaaacggtactttcatgtcttttttttttttgagacggagtctcaccctgtcgcccaggctggagtgcagtggcgcgatctcggcttactgcaagctccgcctcccaggttcacgccatcagcctcagcctcgcgagtagctgggattacaggcatgtgccaccacccggctactttttgtattt

SEQ ID NO: 74881 - DNA, 1010 bp, Homo sapiens
aaaaaacatatctgcttttgtaaatctttttttacatctatttttatattttatgtcatgttataccttaaggtatgtacacacacacacacacacacacacacacacacacacactcttacactttgagatgttcttttagtatccattcttaaccttgttactagcaacacgtagttgagccagtcatttctagggcagttttcaaggatgagaaatacagtcttttggctgtgatatgttaaagttggccagtgggtgcattaaagctcaacctgagttttaaatcccatactctcaccagataattaatagtactaattgctctttttctgtgactcaacaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacaggtatggccattttttactcttgattagattcaatctgtgatcagtgattttaaaaccttatatactttttttcccttttagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggtaaatatcttcaatggttcagtgaatggataatagagaactggtgggtaagaagaatgttgccagagatctcattagcgtaaatgatttcttataaataacaggtgaaggtgaaatataagtttttgtttaattattcacttggctaatacttaataagaaatgattaaatgcctaaaaccactagaactgttgtggatacaatactttgctcacagcttatcatctagctgaaaatacaaa

SEQ ID NO: 74882 - DNA, 1113 bp, Homo sapiens
ctccagcctgggggacagagaaagaacctgtctcaaaaagcatgcaatgttgtttgttactataataattgtactttgcatttatgtggtccattacagcttttcagagtactttaaagtgcattctatcatttggacctgacaagcccttaaagacaagcattacagggggctttagcttcatttaatatgtagacgaaactgagtctcaaagagcacatagcagtagtggaggagctgatactagagcccagcctgtaccattagttctttgtttttcctctctgtactccagcaccttcagataataattcattcagtaataatttggaacctgaagataagaaaggggacaaaatgttgcaataatgaattaaaatgtttaggagagaagttgctgcttaataatagagttttaaagagtgacaaccttggattctcttacaagtgacaagttgaataaattacaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtggtaggttggatttagtcttttctctccctttcctttggctttttacccaccctttgtctttaacatgtacttgtatgttttatttaacacgaggcagggggatatgccactaatgatttttttttgtaactgaacaaaaaaattataaccgattagttggtaatgataactggtgtatgttataataaaccagatttgagagttcttaagatacatgttttattaggtccaatccagttaaaactgccaacattgttttgtcttaggtgagcattcattcctcttttcagaaatactaaggtttggtttaattaccattaagaatcgtttccatttagcctatacagttgacccttgaacagcatggaggttagggatgccaatgcgcctcgaagtcaaaaatctgtgtctagcttttaactccccaaaaatgtatctaatatcctactgttgaccagaagccttactgataacataaatggtcaattac

SEQ ID NO: 74883 - DNA, 1039 bp, Homo sapiens
attaatttttcaagatattgttagctgctatcatttagtaatttataaactgatatgctttttttaaaacttgttctatatgtaaatagattattatgacattagcagaggatttgctgtgttctgctgctcaaaacagtcgcctttcagctcagcgcacacaagctggatggttgctgatttctgctctgatgacattaggtaacagtctgtagaaggtttacataccttgaaatactttgtgttttctgagtgaaatgattcttatatgtgatttgatgaaatgaacttttaatacataccagaatttaaatagccacacaaacatttttcttgtagtagtcaccttaaaaagccttttactttcgtcattgcttaaaaccttttgagatctctcttgattttctcttccgggctagatgataagcctcaagtaggataagccgagttactaatcatctttcaggcttaactctgaacaactgtggctttttcaaaaatcattgacatccatcttcagaaaaaaacatttccacaatataggcaaaagaacatacccatagcttgggaatccagttctataattgtttgaggattcataacagccaataaggttgctacattgaaggggatgaattttacttaaattatatttattaaaaaacagtaattgttttacagtcatgactatttatatcctctaaatttttgagacagggtctcactctgtcacacgagctggagtgcagtggcatgatcatggctcactgcagccttgacctcctgggcccaagtgatcctcctacctaagcctcccaagtagctgggaccataggcatgcaacatcatgcctggctaatttaaaaaaattttttttgtagagatggggtctcactatgttgcccaggctcgtctcgaacttgtgggctcaagcagtccttccgccttggcctcccaaagtgttggcattataagcatgagccactgaaaactttatttatttattttttgcccagtcttatggtgctaatgaaactta

SEQ ID NO: 74884 - DNA, 1530 bp, Homo sapiens
gagttattccagggagctgtagttgcaaagagcctagctggacatctggcagggagtgagaagcagtgcctgccaaggaaagccctcaggtgaggctccaagaggttagaaatttagctaaattttaggttaggtagctaaattttatgaggtaggttgtgaattaaaagtaggaaccagccgggcgtggtggctcacgcctataatcccagcactttgggaggccaaggcaggcggatcaccaggtcaggaattcaaaaccagcctgaccaacatggtgaaaccctgtctctactaaagatacaaaaattagctgggcatggtggtgcgcgccttaatcccagctactcaggagactgaggcaggaaaatcactggaacctgggaggcagaggttgcaatgagctgagatggtgccactgctctccagctggggcgacagagtgagactctgtcacaaacaaacaaacaaacaaataaataaataaatgtaggaaccatgaggaagagccaggacattagaccatagtgtggattaagggtgaatctgtgaattctaactgggatgtaagagacatgaacaattagaggagagggaaaaggaagattccaaagcaggtagagtctaatgcctaaacttggaagtcctagatagcagattgcacaagcaacagatgcaaggattgactcatttttaaaagggggcaagaatttctggcctctcctgtaaaccctgatgtgctggaggaataatggcatcttgtacactttgcacctgtattaagtagccctatattgctctgcttttaaaaatatctatattcaatattatttgtctctttcatcactgttagcttcctgctcttagtgggtttgctcttttacttttaatgtgtttctctatctagaatccaaataactggattattagtcatgtctaaactaagaatgaataggctttgatggatttatgtcagtaaaatccacgagttctgaaacaattgctctatagactttgtttttttacttcctgttactggaatctcagttaggtaccaagtagtgtgattgctagctagtgactttcagaagagtgtggtgggagatacaagaaaagtaaaacttcttaacttaaaatctgcctctggcattcctaaaggtccagaatgaaatcccccttccatggagagatgggagaattggtgtgtggaatgaagcataataaaaatagtcaagaatagccaaagactaaactaatacttttagtacttattgatttgccgtctagatggaaagggctctctgaaagctgatgtctctggaagacataacactaacaaaaagcctcaaagtactggagacataaaagtgaagtgatgagaaagaacaacaaagttagaaggactggatgcttcaccagctatggcaataactgtattagtaatagcagtgattactgtagagactatatgaagtagttgaaagaatgtggacgtttagacagacagacatggacattaccttcttcttc

SEQ ID NO: 74885 - DNA, 1062 bp, Homo sapiens
ccattatactgtctaagccctgtctctactaaaaatacaaaaattagccgggcttggtggcaggtgtctataatcccagctactcgggaggctgaggcaggacagtcacttgaacctgggaggcagaggttgcagtgagccgagatggcactaccgcactccagcctgggcgacagagcaatactctgtctcaaaataagaaaaaaaaacaaacaaacaaacctatatttgagtcttttcataaagcaaactttctatgatgcaaaaatatctttattttgtttacaaatatgaattttgatgaaacaagatttattaaaacccttctatatttaatcacaaaataaagcagttatgtgggatacatcacaaatagccaactttaagataaatatgaccctacttctttttactggacttttccatgtgaatgaattcttcacactgggttagtcagcatttttctcttaagaagcttaataaaatttgacctattacatcagccttttatctgaatgtgaaaagaagaatttatgtggagaatgcaccacaccctgtataacagtatctgagaaccattagctattattgccataaacatttgaggttgggaaagtaattgtgggctttttttttgttttaagggaaggtatggagtttttttagaaaatgtctgatcatactagcgaaaatgtaacccttggctccaactttgagagactgtttacttcaaccttgtactaatgtagataggctaaggcacactttctattcctggcattcttctgatttccttagcagccccaaggtatgtctatgagcaaacatgaccatcttttaagtttagtttgctcaatgcctgcattattttttcttctgattacattctgaaagtcctcggggcttttatttcttttttttttttttcttttgagacacatttcactgtcgcccaggctggagtgatcttggtgcgatcttggcgcgatcttggcttactgcaacctctgcctctgggcttcaagcgattctcctgcctaagcctcccaagtagctgggatt

SEQ ID NO: 74886 - DNA, 1047 bp, Homo sapiens
aagactccgtctcaaaaaaaaaaaaaattttgaaattgatcttgataaagacctagcatctctcaatgtggatcacttgagaaagaatagccaataaattggtttattttctaaattaggagcagacaggattgcacctaatttaggtgctttctgcctctgttttcctaagattaaagcatgtttcaaatagaatatctaaatacaggtactattttatctgccaatttagaaacctctggattcaattatagaaaatactatattttccattgtgtataagacacaatggatatggttgtaatagcttgagtactttcatataaagtaaaatcaaacatacttttaccattctttcatgagttcaagtcataaaagaaggtataccatttatttctgaatagtatctgtactagtgatgatttcttgactccataatgaaagaactaaatttatcagatatcaatatcaatactataaaatccttcatgccacttgttttagaaaagaactcacattgatgttataatagaacaatgtcatgtcagatttttactatctgtgattaacattgcagaggacctaatttgttatattatagttaaatgtatagcaaaaaaaaaagataatgaaattccaatgtccttagaagggtcttgcctattaatttattgaaataagactagtttcttaaagggaagaactactagaaaagtaacattttcgttttgaagtcatcccttggtgatgactttaaacagttattttgatagtttcataactattctccctacctcctgtttctcctatccccattccttttctgcagaccatctccaaggttatattcccagaacatgtctttctctatgatattctacttcttagaaacttctataactcctctttatcgacaggacaaagtctaatcttctgaggttggcatcagcattctctatacgccttaggagtgaatgaaatcactcaaggagatctgtagaggactaaaatcagaatcttaagaaataacatgtaaagaaacggcaa

SEQ ID NO: 74887 - DNA, 1051 bp, Homo sapiens
gccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaa

SEQ ID NO: 74888 - DNA, 1090 bp, Homo sapiens
tttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgt

SEQ ID NO: 74889 - DNA, 1063 bp, Homo sapiens
agttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggg

SEQ ID NO: 74890 - DNA, 1053 bp, Homo sapiens
agcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcg

SEQ ID NO: 74891 - DNA, 1047 bp, Homo sapiens
tcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattctt

SEQ ID NO: 74892 - DNA, 1074 bp, Homo sapiens
aggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttga

SEQ ID NO: 74893 - DNA, 1100 bp, Homo sapiens
gagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcc

SEQ ID NO: 74894 - DNA, 1052 bp, Homo sapiens
gactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttc

SEQ ID NO: 74895 - DNA, 1084 bp, Homo sapiens
atatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactc

SEQ ID NO: 74896 - DNA, 1009 bp, Homo sapiens
tagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgata

SEQ ID NO: 74897 - DNA, 1100 bp, Homo sapiens
acagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcct

SEQ ID NO: 74898 - DNA, 1021 bp, Homo sapiens
catagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtga

SEQ ID NO: 74899 - DNA, 1017 bp, Homo sapiens
ttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtt

SEQ ID NO: 74900 - DNA, 1603 bp, Homo sapiens
acaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaa

SEQ ID NO: 74901 - DNA, 1046 bp, Homo sapiens
attacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacat

SEQ ID NO: 74902 - DNA, 1181 bp, Homo sapiens
aaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgcttta

SEQ ID NO: 74903 - DNA, 1051 bp, Homo sapiens
atgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaag

SEQ ID NO: 74904 - DNA, 1100 bp, Homo sapiens
ttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttat

SEQ ID NO: 74905 - DNA, 1034 bp, Homo sapiens
gaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactc

SEQ ID NO: 74906 - DNA, 1059 bp, Homo sapiens
gggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctg

SEQ ID NO: 74907 - DNA, 1061 bp, Homo sapiens
ttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcc

SEQ ID NO: 74908 - DNA, 1848 bp, Homo sapiens
gataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctata

SEQ ID NO: 74909 - DNA, 1006 bp, Homo sapiens
atgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtccc

SEQ ID NO: 74910 - DNA, 1072 bp, Homo sapiens
agaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaa

SEQ ID NO: 74911 - DNA, 1308 bp, Homo sapiens
atgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctcta

SEQ ID NO: 74912 - DNA, 1074 bp, Homo sapiens
acctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattat

SEQ ID NO: 74913 - DNA, 1016 bp, Homo sapiens
attttgaagatgtgtgactatcttgttacagtgaatttggggtggggaaaagattcctagtcagaatttaggccatgccacttgcaggtgatagactcatagaattctgctggtgaccaccgtgcacagtgagatacaggctcctatgctgagggattgagatgtgtttttctaataaattcttcccagtccaatgtgaattgtttccaggtacttaaatgactcaacgacttaatatttcattttaaaccatgctctgcacaggaaacaaggttgacattattaggattttcagatttaacatgtgcctcatccaggttattttcaaaccctgaggtggcattacagaaatatttcttataaatgctaaataactcacattgttctttagaaaggcagaatcagtcttttcaatggcttgaaaaagccttgaaatgaggagagtatggagaattttagcactcttcagacataaatataatccctctgaatggggagcctcccgcccattttgtcagctttcatttgccagaccggaagttcccttaattcctgggaccctttagcttgtaattttttcaatagccaaatatattcccttttatgaggatcccaataatctcaacaagctaacaagctttcagtccctctctaatcttgatgtggttgtgatctccaagcagactctattatctatcattcagttccaccaatccggctgtggattcctatgctcagagctctgagcaggcgtaggtatgccaagaccagctgttgtggcttaaccatgagcaaattcaggactaagcatgtgaaaggtccatctgattcaatattcttgcctgacagacagtaatctcatctctacttgaaatcctcactctttgataagcgagtctgcaacagctggacatcactaattaccatacaggtctcccacccctcacccagtggctctccttctgtcatctcatattcctcacatatccctggtgcagctctctccatgatcatca

SEQ ID NO: 74914 - DNA, 1040 bp, Homo sapiens
ccccttatggtctctgagcattaaagaaagcaagggaggaaaacatgcgcccaagctcgttcgcaggaacatgttcgcgtgtctgcgcctgtgtgcgcagccagttttctggctgaggatcgctcgccaactacagacatcacccgcccaggacccggtgccacactcacccagaagacgaaactccacaggagcgagaagaggagtccatttctccgtcggctcggcacggcacggggatgcaggcccctgattcagtacgttctgtgaaagtggagcgagaagccaagacgtggatcgagaagccccgtggggcgggtctcagggtggcccaaaagacccctgttcacgccactaccagcctaactttaggaactgtcgtccacctggcttttattatactgccttaaacatattcacttttttgagactctagaaatttcacaagttttggggtagagcacactgggctttgggtgtgtttctcatgagggcactgacgctgaatggtgcagtgagaaaggacggtagaaaccactgcctttgcttttaccattgaagaaactgaggtcctgtgactttcccgaggtcatcggaatctgccttgcacaggagacttaaaatagttgccagcagataaaagaatgagcaaaaccacatctactccaatttgttaagtctgaaagaaagtaattgaggggggattcctctttggggaaatatttatttcctgcattgaaaatagtttaatgttagtaaacatataaaaagtattttaaattcaagttattctttatttcttatgttacataaggtactgaagttagccaaggttgcttttgtgttataatgatgcagctgctgccaaccagaagtacatttacggtctgtcagtaaagaaaacaaaaactgcctgttggtaaaaatctattagaaaatatttgtcagtaaatttgtcacaatattccagcagaagttctgttcgtttttccgtcttcctgcccttcatatttctcaaaggtagacttaataaaggtaga

SEQ ID NO: 74915 - DNA, 1666 bp, Homo sapiens
agaggggaggtggcggtgtccgttggccgggttgctgctgttaacgagttccacctggaaagggtacacggggcgggtgcagattcgcggaaacacagtctcggttgcaaacttaaacgccttgtaggggggatcggccctttcactttccctcatctcctcgactcctccctgggttctcttcaccaattttccatctgctttgaagcttggagtaagatatgagaagttgcactgcgcatccagagcccagagtcctatgggctgactgcgactgggttgaggctttgatactgagttttcgctagaataacctccagattcttcctctctttccactaaagaaaagtatcggggtgggggtggggagccgcgcgggagcgcgcgcgcacttatccacacagaaatactccctctcaccctccctcttcagcgttattagaaatgcaagagagctggaggctcggggtgtagctgaggttgaaaggtgcacggaagtaagggcaaactgttattaggccgtttagtaaaatcccgaaaaagttgtaggggagacgcttatacttctaccatgtgatagaaattcggatttggccatcgcttaataaatgggaattcaaatattttgagatagagcaagataggcatatagatgggtttgtgcttacgttttaagtttaaattcttatcgatcatttattttttcctttgtgataggcaggaaactgaatttttttttaaatgttcaggtgtaaaacagcaaaatgcttcgctgtatttactagtacttgcttatgttgctttctacaggtaggggcggggggcgagtttgtcaattccacttaaatccagaaccagtattcagttagaatgttaggtggtgtttatccgcatgaaggatctcgttcacttcatgggagcttgctctacatttccacttaaaatggttctcctaacaaaaatttcatctagatgcagcgattagacatttggaataatgtttggtttaaaaatacgttaatgaaaccttttgctgtcaattctagtttatttgtactgtaatacgataaaacggtattcttattcagtgtttgtagataagtattactaaccgtctaggtaacctactagatagtttcttgagtaagattttgctttcattttaaattcctttctcattttttgctttcatctatcctttgtatactaattgacctccattacctttatctgtagtacaaagagcggtaagtatgtgtcaccaaaaacttgcaaagacactggagcaatttatgactaaacgcactggagtgaaaggctgcgcatacctatgcttgtaactttcaagaaatagcactattgatctaattgacttaaagcagaatcagacggtacagatgattaaataactattgatttggttgtcttgtgtaggctgtgtttttaaacctagatcaacatgtcttattttgccattctttgtacattaattattaagagtactggggagtgaggtgggttacactttgatgtaagaattgcggcagaattctgttatctttatgagttttgtagtgtccctccccatttaaacgaccttagcaatttttaaaatgtgttgcaaaattattaccttaattctgtcacaagatacttatcctaaatg

SEQ ID NO: 74916 - DNA, 1002 bp, Homo sapiens
ttttaattgaagaaaaagttaggtctcataaagactttactaaactttaccaacattggcaggatgtaagatgagtgttggcctttagtggtcacttcttaaatatgaaatggcataatagagattttcttggtagctacagaataagttttgtcgcaactgtagtttccatagatactattttaagaactatttatttgggttgtatggtccacagttttttctttgcataccaagaaggtgtgtagtaatataattggctgaagaagcattgtacagtgttgttttagtgatgtctatgttcctaaaagatacttgtattatatatttaaagtacaccaagggaatttaatttctaaaagacctgtgaagaaacatcagtagattcatcattcagtaatttgagtaatcaggctcttgttttaagtgcaggcttttgtcgattattttattgaaataggaaaaaccatattagaaattaagaaaaatgcttcaatgctaagaattttaagtatgaactttaattggttttcaaactctgttccttggattcctgtgggtttttttcctagatgccttgagacttcctatgacaacccaccctcccaaaccaggacagcttctattttcatgtattaagtgtattgtatttaaatataagaatatttaacttaattaaatataagaaaaatatttattatttaaatataagaaaaataactaatgggtactaggcttaatacctgggtaacaacaaacccccttgacatgagtttacctttaaaacaaacctgcacatctactcctgaacttcaaagttaaaaaaaaaattccccttaaaaaaaaacaaaactgatctgcattaattttttttaagtctctgattcgttattcattagttcagattacttttatttagcacttactatgtgcctagccctggaaataccaagataaattagatataggtataatagctcaagctgtataaaggagtaaata

SEQ ID NO: 74917 - DNA, 1890 bp, Homo sapiens
atatctgtgttttacttcatagaattattacttgggaaaaagagcataaccttgtaattttgtggttaaaatgactagtatgttacttgcttagagtctcaagcttttcatcatgaagagttaatggtaaaaatggatattcatttttctagtgttagattagatttagcctattttattatccctgaccaatattttattgagcagctaggcactgagtgatacaaaaagtataaaatattgctcccttaaaagatcttttaacttctgtggagagacagcaagcatgacactttaagaatttgaggtatatttagggaagtacatactgatttaaaagttagtagaaaggaatttagctaaaggaagtgttacttggattacatactgatttaaaagttagtagaaagttatttagctaaaggaaagtattacttggaagtagcatacaattgggataatgaagggggaaaaagacatttagggaagttaatgacagtgtggactgaaagcacaggtaagtagaggacagattagcagatgggaagaaaatataaaaatgtgtagtcctagctacttgggaggctgaggcaggagaatggcgtgaacccaggaggcggagcttgcagtgagccgagatcgcgccactgcactccagcctgggcgacagagcaagactccttctcaaaaaaaaaaaaaaaaaaaaaaagatgtaagagcatcagttttgtaccttatgagccagagtgaaagatttggagaaggtattaatgcaagagtgatagaaggggtgatgtagaaataaacacgtaacgttggcataactatttgtctagttactgtatttggtttgtcaaacagccttggaaaaactctcaccttggcttctgatatggcataatttgttcattttctttctgttgatcatgttcttttactgattcaaaattgtttctttttatacttaccttttcagagccaaggtaatatctcttttagagaactagtaaaaaattaacattactataatctagagcagcgatcctttttggtaccagggactggttttgtagaagacagttttttcacggaaccgggggcatggttttgggatgaaactgttccccctcagatcatcaggcattaattagttagattcacaaagggagcaagcaacctacagttcttgatcctctgagaatctatcgctgctgtggaggcggagctcaggtggtaatgcccgctttccaggccacccctcacctcctgctgtgcagcccagttcctaataagccacagatggttaccagaccggggttggggacccctgatctagagaatttaagatctagatttctactcttctgtattaaccaagtatctaattcttcatatgttttctttagaaaataagagtattacaccaaatggtctcataggtaattttctgaagtttatgatgctgaaatttatgttaataatcctgaacttgccttgtttcattaccgaggtttcatttgtctttggaaataacacctgaaagtgaaatgaaccaccatctattgctgaaactgattagtttttcattaagaaacactggcttaatgtgttgccttgtatttcttatgtctagtagccagttaccaagctctctttgtcttgcattgctcttttattgattaattaattaattttttttttgagatggggtcttgctctgtcacccaggctggagtgcagtggcactcagctcactgcagtccgcctcctgggttcaagctattctcctgcctcatcctcctgagtagctgggattacaggcacacgccatcacgcctggctaatttttgtatttttagtagagatggggtttcaccatgttggtcgggc

SEQ ID NO: 74918 - DNA, 1060 bp, Homo sapiens
aatctctgacaaagttaaactgatagtagctaagcacagtaaataaatacttatagttgtttacctaggttgatgaacatgggatgacctttgatccttctgtttcccatacagaaatgaaagaatttagaatgacttgcacaccaaggcctcagggaaataacatgttatcagagtagggtgtacattaaataatagggtagaagttaatgtgtttgggaatagttttggtcattggtttttcacatattttcagcagtgaagtttttttcaaacaaattgaaatatcagaagataaaaatggttaaaagcagaattacctttgctgcgtgggtttgcggagctcccagagtactgcctacttggaccctccttgaagtactacacacctttagacttactgtttatatacccctattgtgtgttaatgatcacattatagtcctggggaaaaaaactggactttttatgttagtatattttgctgtactagatgtaatgggcccaaagcagtacataatttttgttaattgtgtttacaagtgtgacttcaggattacccagcggtttggaagctgattattcttagtctggagattgagtcatttattcatgaaatatttactgagccctcactgtgtatcaggcactgttgctggagatttgattccaaaacaaaatcccaatgcttctacgttatttagtcaccacgtaaattgttcaaatttttaataggttggttctctcttcatttgcctgattatattcttgtttcaagactaattcataggaataatgactttttagggctcatttcacatacaaattgtgtgctttctggtataaactgtggttcaaagatgaagtattatttcgagtccaggactttgagaccacaacatagtgagactctctacaaaaaaatttaaaaatcacctatgtgtggtggtgcacatctgtagtcgcagctgcttagaaggctgaggaaggaggatcatttgagcccaggtgtttgaggctgcagtaagctatgatcctgccactgtactctagaatgggt

SEQ ID NO: 74919 - DNA, 1378 bp, Homo sapiens
tctgtgtgattaggtcttggaaatataatttcttatcataaattttgtgattttactaaagtctttaaacagccaaaaattttgaattaactatatttggggttgtactcaacttcacttttgaaaaaaaatttttttaagatgtcataaaattagattgttatgctggctaagtacattattatagattgtagttagctttcattctcatggtttcatttttgactaaatatttgagtttaaattaggatttatgcatttaattagtagctgttatgtgggaggcactgttgtaggcttttgatatactggtgaaataaagatttgtgccttgtgactcttttattaagagtgggatgcggagagggatagagttaatgacataaataaggtgtatagtaagttaggaaggtaaagagttagcagtggggatctttggggatattgtgaaaagttaagtgcaaagaacatgccttagcatgttgtcttcctccagtgtgattgaagcagaatgagaaaggtagaatagtattaggggaggccagagaggtgagagagggttggagaagatcttgtaagccattgacaggacttgctttttatttttagcagtactcgagagttttaaacaaaagaatgggaagctctgatttatgttttaaaaggagcactctggctgctctgatatgaatagactgggaaaagggagcagaagtgaagcagaggagttagtttagaagactttggagtaatcttgggccagagatattgatgggtgagagcagtaaaagtagaaaaaactgaaaagttaaggatatattttaaagataggaccattaggaatttcctgacatggtataatttaaaagcataaaatatttttaaatatataccttttattaatgaatgcatcaattttgtgaaaaggtacatgttttagttctgatttattgagattttatttttttagattccttgtagaactttttttttcttgatttgcaaaggaggatgcagtgtttgaatggtctagtaaaataccttagaaaacttagttgtgaacatagttttgttttgacacaattttaatttctataaggatatagataatttctataagattatcctaaagacaatcttaaaggcagaatgagagactgcattgcaagctattaaaagcagcactattgcttaaaaaagtaaaagattgggaatgaagagattttccttctaaccttataatttctagtaggttattgctacttttgtcttggtttcttcatcagtaaaaataaacatggtgctagatatcataagaacaagttgcatgaaagtaagcctacatcaaaaatagatgtgcatgattgacatagatatt

SEQ ID NO: 74920 - DNA, 4664 bp, Homo sapiens
tttgtatattctaaaatcttatcaaattcttatgaaattctgttttaaggaataagttttaaggaaccctataatgtaaaaagcaggttgttttgtatttttaagttgtgagggagttgcaagtcaactagtacattttagttatcaccagcatcgcctccagtgacagaaggcaggaaaattaagggagtggaaaggactagctgtttcttcaaactcataggaaggggtaattagaggtaaaatgcacatttggtttaatagaggtttattttaaagtttgtgagacattatgttagattttgtattttgttaggtttgccttaaattttgaggtcatcttgtatttataacagtaaatcataaactgtttatgtagttacctcttaaaatacatgtatcattattattaatttgtatggtgctttgttgtaaacatctttattgtaattcagtgtatgtaatttgtgattaagatttgttctttttctcccctctctataggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaaggtaaggttaacttaaggtcagtgatgtttataaaaatgcttgttgttacttttttaaaatactgacatcagtgttagaatttagtctcattcattccatacataataattagtagccctttttaattttctgagtattctgtggggataagtgattttttgttatttttgtgctttattggggtagagtttgatttcatattcttcagcataaaaattcttggtgaatgtgttttttctttttacagaaacccagatatgaagtgattttgttct

SEQ ID NO: 74921 - DNA, 1032 bp, Homo sapiens
cttggcctcacaaagtgctgggattacaggcgtgagccaccgcgcccagctgtaaacttttaaaataatactgatctagacttacagcacatactcaactcataacatgctactctcttgcatctcttcacacttaacctgttatcactagtaccattttatcactgacaaaaactttaatatttttctctttattggtttatattactaaaactacttaatgtttattaagaaaaaacacagcctttccatttttaaattgcttttatttttgtgtttttttttccatttttgttcacaagcctaattgctttggtaaccttttattttgatgtaatttcaatgaaagttggaatagtaaaaggggaatccatatatcctttacccatatttgccaattatctacattttgccccacttgatggagctgtgtgtgtgcgtgcgcacgtgtgtgtgtgttttcgtgtctattggtttgtttttttttttaagccctttgagattaagttggagatagtggactctttttgctattaaatatttcattgtgtatttcctaagaacagaaacattctctttaatagcagtagtacagtcatatttttccatactgctgcatagtctttctaattacagtattagtataattttgtatacttttagtcaggaggcagatttaggcattcagttgtaaagtggtagagttacagagaccgtatgaaaagtaaaggctaaaagctgattatttgaaaagactaaaaaatagaatagacaaacctctggtaatagtgatgtgagaaaaaaggcataaataagcactgaataaaaaggagaacataattacagatagatcagattaaaagataatagagaatactatcaacaattccgtgccacaagtttgaaagtttaaacaaaatgaacaaagtcctggaaaaatgtaatttacctaaacaaatatgcttcaaataatcctgtaaatattaaataaattgtgaagtagtagttaaatttcctaccaaggaaatacta

SEQ ID NO: 74922 - DNA, 2945 bp, Homo sapiens
ggcaggatgtagtggctcacacctgtaatcccagcactttgggagggcaaggcaggcagatcacttgaggtcaggagttcaagaccagcctggccaacatggtgaaacccgtctctactgaaaatataaaaattagccaggcgtggtggtgtgtacctgtaatcccagctacttgggaggctgaggcaggagaatcgcctgaacccagaaggtgaaggttgcagtgagccaagatcgtgccactgcactccagcctgggcgacagagcgagactccaaaaagaaaaaaaaaagcttactataggaaggcaatacttacagatctgatgggataggcttacactttgttgaatgagcaaagattctttattcaacaaagtcttgaagtgcttgaaagtttcacattttcttttttgtacctattttctgtaccttgcttaatttcttcagagttgatgtggaatattcattttatccattgttaccttgaaaacatccccttaggggagaaagtgagagtcacctttgtacaggaagtgtgttcaaaagaatgagaaaggtttttttctagacccttcaaccagcatcttttctagtctgccttgagttaggtcctgcacctgttcctaaccaatacagtctgtccagggtagtagaattatccaactgaatttaggtctgaccagcctgggcaacatagtgagacaccatccctacaaaaatgtaaaatctcagctgggcatagtgatgagccccgaaggatcacttgaacccaagagtttgagattgcagtgaactgtgactgcaccactgcattctggtctgtgcaacagagcgagaccctgtctcgaaaacaaagaaaaatgagtttaggttttagtctttatcctgagagctctgagtgaaattggctttctgtgaaattaagataatttctaagataggaaaaccacaatgtctactgcaggcaagatttgtatcttgtttatagttgatctccatggcctagcacagtactctgtgtcatagtgtgatcagttgaagtcagcataaatgtatggcctttgtttttgtaaaagaactgttcatgtgtttaactacaatttattttgactcaggaaaactcattttattcaacaagcattttggtaaatgcctactgtgcctgaacactgttagaaactaatatggggatgacttggtcattcattggctctgctttcaagaaattcagtctaataaaattgattttgctgaaaattaaatatgttttatattttcaacaagtttagccagacttctggttctttctcatatttcatctcatctggaaagaatttacttaggctttcttcagtaccatttctattgctttcttcctgggtaactggctaaattgatctacctggttaactagatctgtgatgtttctataatttctcataaagttaaaatttgtttcttcagcatttttggtgctggctacaccaatttatgataacataagtgtggatatgtagtgcaagtatttctggcagtattttactatttgccatttctttgaattctgtgttgtccatttgatcatgatttattgcttttcaaattcagattgaaatgtaattagatggttaatttttaaagtatatttctgatttatatattttgttaagacttaattggaaagattatgtcagtggcatacattttcgctaatttaaatttggctttctatacaaactttttcttagtgtttatagcagcgtactgaatattttgtaaaagcatagtacagattattgaagttactcatttctgcagcagattaatagtaaatgttaagtatgtgtcaaggaggcacttctgtaacatagataattgtgttcttatgttaatggacagttgttactattgcaagactataggtaaatttataggtttgccaatttatgtacaccaaaattttgtatactacaaattgtgtcaatcctaggagaggttttttacagtagatgcagtgttatgatttcttgctctgtaatgttttcctgtcatctcagctaaagtgtggatggagtactcaagtaaatagggcttaatctgtgacttttaaagaagagaaaccccagagcataggagggttgctttttaaaaatagtagtaatttttgatgtttagaatccttacaacaaaatataaggatatgacaaaagagatcttatgattgtatcgtagtcaaaataaagggtacaacttgcatacattgtataacaattgttttgaactttttggaaattgttcttagcctttgaaaatctgagtcaaggtttgggtattttccctagaaaaatgcacatgcacaaaattttactggagttttaacggtttcaaatactttctaaaggcctgtggatcccagtttaagaaactccttgtataagatgagagggaggaggaagacactgaaatttggggaagctgggtagaaatccacccattcacttgaatagttagttgctttgctagaactttctccaagtgactccaggtttattttttgttaagttgttaatggcattaataaaatatctgccacatatataatatatgttgaaatgctttttaggaagatgttatcttagagaataaaggttcctgagtcaaggttaaaattagtttgcctgataagtatgtacaaaaacctagaccacatttatttactctgttgttttttatttcctcttttcacctagtgttagcataaagggtgtgagagagtcttcacaatgtaagttttctgaagtgtgtttggactttcagccagcacttacggcttttataggcttaaaaaagggattaaataaacctttagagtgctgggtcccctgaaggcttctttcttacaccagtgtgttaaactataatgtaatgctgcttctcactgcc

SEQ ID NO: 74923 - DNA, 2844 bp, Homo sapiens
atgtgttgcttccgttccattttcatactagttgaggttgtcattatttcttacctgcattatcacaaataccttttttaaagaaataaagattctattttgagctaattgttgattcatatgctattgtttttttttttaaaaaaaagagagaccccatgtgctctttgcccattttcccacaatggtaatatcctgcaaaactatagtacaatatcacagccagggtgttgacattaatatgatctacagatcttattcagatttccccagttttacttgtactaatttgtacatgtgtatattttgttctttgcagtttttcatgtgtataggtttgtgtgtccctcccatagtcaagatgtaaaacagttccatccactagcaaattaacttgttttgtctttttataactacatgcttttccttctcctcacccatccctaaccactgatagccactactctgtttttcatttctataattttgtcatttcaaggatgttatataaatggaatcacagggcatataactttctgggattgactttcatttaccataatgcccttgagattcagccaagttgttgcgtgcatcaacagtttgttctttttattgctgaataatattccataatatggatacatcagtgttttaacctgttgaaggacatcaggtcgttccagtttttgtccatcttgaataaagttgtcatgaacattcgaatacaggataagaaactgccaaactgttttccagaatgggtatactattttatttatttatttattgagatggagtctcactttgttgcccaggctacagtgcagtggcgcgatctcagctcactgcaacctctgcctcccaggttcaagtaattctctgcctcagcctcctgagtatctgggattacagatgcccaccaccacacctggctaatttttgtatttttagtagagacgggctttcaccatcttggccaggctggtcttgaactcctgacctcgtgatccacccgcctcagcctcccaaagtgctgggattacaggcatgagccgctgcactcggcctgggtatactattttaaatccctactggcaatgtatgatggatccagtttctccacatcctcaccaatatttgtggtgcagcaactttttaaattaggtttccgtgttccattcaccatttttttcaaactgttatttatgttgctttctggggggcagtgctaaaatagaagtgcctgatccctgtccgtacaaagtgtatttgtaacctctgtataaagttccaaatacgtgagttaggcatctaaagccatttgcagtatggcctttgctgaccttttaaccttattcattcccacacgtactcttaagctccaggtacatcaaaatagatggaaaatagtagctggctcagagctgttgtgaagattaagattatgcacatagtattaacaagtgcctaatagatagtaagcagtaaataaatggcagtttctggtgatttcatagtcttcatcccgacatatagtaggcacccaaatgtttagatgagtaaatgacttacgcactagatcctttctaacttctgaaaatgtccctgacctcatccattcctatataagttctaccctttgaatccagatttaagtcttaaatttagttattttgacatttaatcgcatattattttgtatgtgctattaatgactggtagcgaggtgttttttcattataacagactatatgtttctcaagggccttaaattccactgatttttaatatcctttacagcaaactaacatgctatgcacatagtatagtaatttcttcagttcttacagactgttgaaagtacaccaccttttttccaagtgaattcacatacagttggctattcttcctgtaacttgatgatgtgagtaatcattatttcatatgaatcctgattaggttaggatgcttaagcttagacatacctgtctagtaactcctataggaatgaagaattaggtaaatgaaactgttaccataaatggtatataagccaatagtacttcgtatattaacagaaatcttatgtgtgaaggctttcctctggtgcctgtttttagttgtttgcttctgtcaatgtttactgagtatctaccatgtgctgtatatattgtgccagttacaggaaccaaaaggaaatgtgaccagattttaaatagtattttggaagttgtaccaatagggcttgtgatatatttgctgtggagagtaaaggaaaagagaaaaccaaggttgactcctaggtttatggtttgagcagttgggtagatttactaagatagcaaagactaagggtgaaaggattcagactagaaagaataaagacaactgctttttatgtttaaaatatctgtgttgacaaatgagtagaagtatcaaagtctaaaaattagatgtatgagtctggtactcagaggaagagttatcaggatgtataaaggatttaaagttttgggattagataaattcacataagggcagagtacagctagagaagaagggagaactcacaactgagtttgggtagaagagttgttggtagatgaaactgaaaggaaatccttagtgggaaaagagaaaagctagtgaagagtatgatatgggagctaacagatcaagtgtttagggaggaagttcaagaaagaatgttgctgagagatcaaggatgaagaaaaaagtttcttattcatttgatagtatctggtcgtgacaagcggtttaagggaatggtagggaaagccagatggaagtgggttgaagagttactggaatgggaaaagt

SEQ ID NO: 74924 - DNA, 1478 bp, Homo sapiens
catgcagattgtacatgtctattcaaggagccaacattctagctctctgtagagaatggcctgtagggaatgatggtagaagcaggggatattaagcaggtgatgcagtaatccatatatgtgaaatgatgatagctttatgggccagggagttaacaatgaagatggtaaaaagtaagtagattctgtatctctccatttgcttaacagttggaagtagggtatgagagaaaaaggagatagaggatgactccaagatttgtattccaagcaactgaaaggatagaattcccaaaaacagatggagaaggctgcagatagattacattttaaggaaagcatgagaggtttttcttagactttaaactgatgttgttagggtgttttacattagtttaggcttcaggagaaagagctgcgctggaagtaataatttagcttatcagcatatagatgatgttaccaagagggtgagtatagatggaaaaaagaagacaatcagagcctggggctgtggctcaacctgtaattccagcactttgggggaccaaggcaggagaattaaggccaaggtgttcaaggctacagtgaactataatcgtgccactgcactacagcttgagtacagagcaagatgctgtctcaaataacagcagcaaaagacagtcagagactgatgaggatattcacaacattacagtgttgatcaggagggaccagaaaaggagactaaaaaggggagagcaagtaagataacaggggtggtctctttagaagtccagtgaagagactgactgctgaaaagtcaagatgagaactgagaactaattatagaaaacagtctttggtgaccttaataagagcagattgatttagtggagttttgagggtgataactaatttgagtgcatttggaatgaatggaaggagaggaattggcgacatcttctatagattatttgtatatagtttgtctgcaaaagggagtataagattgagacttcttttttaaatgagggcaaaacccagtgttttgtggtgtgtataataagaatgatatagcaggaaaaggaactctctgatggtcttttccattttattttgatcttttcaattatattgaatcttttatttgctacttctaagcaggtttttgtttctgtgatgagttttttctttcagtttatttacatttcatctgttgtcacgcttcttctttgatttttttttttttttttttttttgacagagtctcgctctgttactaggctggagtgcagtggcacgatctcagctcactgtaacctcccgggttcaagtgattctcctgcctcagactacaggctcacgccaccatgcccagctgatttttgtatttttagtagaggtggtgtttcaccatgttggccaggatggtctcgatctcctgacattgcgatccgcccgtttcggcctcccaaagttctgggattacaggc

SEQ ID NO: 74925 - DNA, 1035 bp, Homo sapiens
ccttgttatatgtatggattataatttgactgtcagagcagttctttatttctaaagtatcccttttgaattggccagaagttccttatataagctacttagcctttcattacattagattgctagctctgaatcttggtgtaactgcagatttaaataatttgcccttataactttatggaccttgggacgtatttactggcataagccagagaatctataattttgctttcctgtcacaacccccaattttattttaattaagtattcagggctgtctggataaggttgagacttcactttttcctctttcctgtgaccccacagacagggataggattatttcagaatcattggaaagtttaaattgactcctaaatgctagtgctaagaaaaggagttaagaggtgattggaacatttagagttggctagctagtttgtttttcttaaaactttatattcctcagatggtattacagactgttaagatcccttccttcctgttgttcccaccatagtctaggcattgccattttcattaatctacctaagtgtaggccaggcgcagtgactcacgcctgtaatcccagcactttgggaggccgaggcgggcagatcacgaggtcaggagatcgagaccatcctggctaacacggtgaaaccccatctctactaaaaatacaaaaaatcagctgggcgtgatggcacacgcctgtagtcccagctactcgggaggctgaggcaggagaatggcgtgaacccaggaggcagagcttgcagtgagctgagatcacgccactgcactccagcctgggccacagagctagactccgtctcaaaaaaaaaaaaaatctacccaagtgtaatctcttttaccactgcatttatctccaaacagaaaacatctgcttcagttttcatttttctaatcaaatgataatatagctaatagttggtaggctgcaatgcacctttgtgttcctgagaaagaaaagaactcagccagtgtacccctgcctcaactttgaggtta

SEQ ID NO: 74926 - DNA, 1889 bp, Homo sapiens
aggagaatggcgtgaacccgggaggcggagcttgcagtgagccgagatcgcgtcactccactccagtctgggcgacagagtgagactccatctcaaaataagtaaataaataaaataaaaataaaaagcatcagtaggcaggaagaaaatggaaaaataagggacaaatgatggaactaacggttcatggagttatatagcatcattatgcaatcaataattagagctcttacgttcttacaaatatagatagacacagaaaactcactcggacctgcttcaagagaccaaatgaaattaatatatcacacctaaactgaatcaggtattgcttgcccctagtttgtcccttgtgttggcattgaaaagtgatattttctattctctcctgacctatcaagtctgttattttccaaagagaatattttctttcaataagccatttttttttctgttcacttatgtctccaatcaagttgctacttctggcaaaatttatttagcgagtcatattggtggacatttaggttggatgtggctataaaatttttcttttgatccgaaccgtgtatttacattgctcattactattattctgaaattaattttaatagtgttaacttaaatatgttttcttatagcagaaaaagaaaactaagaacttcaatccaccaacacgtagaaattgggaaagtaattactttgggatgcccctccaggatctggttacagctgagaagcccataccactatttgttgagaaatgtgtggaatttattgaagatacaggtaggatagaagaatcattgcaagagatttgattttaaatttcacttttgatacaccaacagtttgtcaaatgtttgtgatttgttaatatagttctcattattaggattatttagtattaactccatctgatcaggtaaccatctgatatttgaaagaagtttttgttgttgaccagtaatgcttttattggacttctcttgaagtaataaatggctaagttgaatactaaaatgttaaacttaccttattctggaatttagaataactttattaagttatgctatttagtgaagagatatagttatggtttgaatagtgtggaagttttccatatttttaagtgcaatgctgtttactttcattacccattttacacatggatttttcttttaaaacttacagcaatagttgtaaatgcgtaaaaggcagcttgttctatttgtgatgctactatttattcagttctagcttgacatggtttatatgatttgagttgtatttttaaagaatgcatagatatcctcattattttaaaaacaagcctgctcttatgtttactttgcctaatgtaatctcaaaactaaacaaaataggcaagttaaaggtggaaaatagggacagaatattgttgtttttgagtgcatttaaaatgaacacgagttaaccatgaaaccttagtgactgaatgtactacacattttaatggcttgaaaacatgagctaagtcagttttggctttgttactaatgaacccttgatagataagcattgtttaaaaaacaaagtaggatactcttgttctcgctaaaaaatcatgctcatttttcacatgtacaccttgcccttcggtttatcagctaagttgtatatatattgagttatctatttggtaaggaatgttgacactttcagtcttaatgagagggtagaatgtgcagtggctcatgcctgtaatcccagcactttgggaggctgaggcagtcggatcacaaggtcaggagatcaagaccatcctggccaacatggtgaaaccctatctctactaaaaatacaaaaattatctgggcattgtggtttgtgcctgtagtcccagctac

SEQ ID NO: 74927 - DNA, 1770 bp, Homo sapiens
tctgaatttttattggatgatgttattagtgtttctttaaagaatgttagatttgctcggtgcttctccttggctggtggagaaaaagaaaaaaatagttaagaatgtttgatttgttttttcatgtgttaagtaccttgtgaatcagtttggtcctttctaagatggattgtaagtttgtatggcagatctagagcagcctttattctgatacttgtttatacctacaataaaattagatttgaccctgtgccccatttatattaaaagatcttctgagaataaaacttgaactattctcagctcttggcctcaagaagttttctctcatatatgtgcagtattcaaccaaagaacccagagactcttctgcatatccgatactctttctctgtgtatttctccatctttttggtattctaccccacaaattctagccttctcagtctttctgaactctcttctctcttcagctctcatagaccattgtgattccacctcccatcactaactaccacctcaaaactctccagacactacgttggggcattcagacagcttgcctcatttgctgctttttccctcatggatcatggttttgaactgtgattaatgttcatgttcagtgatcagtgttcagtgtctgaaaactggtgtttcatataatttttcgagtccttagttttttactatgggagggcaatttccacagcagttaaccagggcatcatggtggaagcagatgtccctatttttataatagtactatcttaataagttgtgctaggttccagttgggaaatgacccttgaaatattaatatgtttacagtagacaaaaagggatagtgcagaagagagtaactgaagagaaagggaataataggtctttttgaggagttaataaggatgataaacctgatagatattgggttgaaagagagggctcagaagtgcctctcagattgctctgttagggtgaccgtagatggcattccattaatgaaaatagaagttataatgagaaatggcagtttcatagtacattcatgtttggacatgttaaatcttccgaggtgcctgtgggacatataaaagcctaagacacagttgtatatatggctatggatctctggaaagtggtttggtctttagatatgattttggtaattgtcagtgtctagatattaatgtaaactatatgtgatataattcagggtagacatctagggtggtaggaagaaaagttcacagtgcaaacaggctatacaagagtggagccctaaaacactagggagaagaaaaattttactaagaagcatgattatcaacatttgaatgagaatgatttttttacattgctttttctgaggtgcaattcataaataacataaaactaaccattttgaaatgtacagttcagtggcaggtagtatattcacagtgttggataaccaccacctcatctagttccagaacattttcatttaccccgaagaaaaccctgtacacattaagcagttatttcttatttccccactactccagtccctggcagtaaccaatctgctttatggctctctgaatttactaattctggatatttcatatcagtagaatcacacaatgtatgaccttttcttctgcttcttagcattattgttttgaggctcatctgtgttgtaacatgtatcattatgtgtatatacatacatacatgcacacacattttgctttttcaatcgtttggtggacatttgggttatttcca

SEQ ID NO: 74928 - DNA, 1144 bp, Homo sapiens
tttgtcaggagctgaatgtcctaaatggtttaaaatagaaaacagtccactaagaacttacttttttaaaatgctcaaaaaatattttattcttacaaatattttaccactataaatttgtaacgaaattgtacataagattaagtacatttattgttatagatgtatattggttttttgtttggttggttggggtttttttttggagacagggtcttgctctgttgccttgacctcccaggctcaggtggggagcctgagcctcagcctcctgagtagctggggctacaggtgcatgccaccatgcccagctaagtttttctttattatttgtagagacagagtctccctgtgttgcccaggctgggctcaaactcctgggccaagcagttctcccaccttggcctcccagagtgctgggattacaaacatgagccactgtgcccagccgtgtggatatatatgtgtttattaaagtatgcatatttctttattctcttagggttatgtaccgaaggactctaccgtgtcagcgggaataaaactgaccaagacaatattcaaaagcagtttgatcaaggtaagaagatgattatgtgaaataaaaattgttgttttatgttttccttgttagaattcatggtgagaagattgattttcatttgaaaacttcctaaggatatggatgttgaggagagagggtttcaaagtgagattagaagcactaagtaaaatagataccacagtaaaggtacaaaacagctagggaaagcctgttttctttacattagcaaggaagtcactgattacttttagagcctttgaattaaggggacttggtactagggatttataagaggaaatagatgataagaaacttctaaaatacaattgcaatagaagaaaagattgaaaacgaggcagttgagtcaagaaaatacaatattgtataaatttttaatgtaagtatgaagacagaagaggatttggtaaataagaaaggaggtactggaaaagcaggcattcagtattgaagcaaagtccatcaggcctggaaggaatggaaagcagtagaataaattttgtttttgaaataacaagaaactatctcttacactaagactgaagggaatactgtacaata

SEQ ID NO: 74929 - DNA, 1524 bp, Homo sapiens
aaattttgaactgtaagcttaaaaggtccaaattagaatttatacaaattgagtaccccttattcaaaattcttggggcccagaagtattttggatttcagatttttttcaaattttggagtatgtggattttacttagcagttatcccagatacgaaatgttccagtgaacaagtttcagatcaacctgtatgcatatttattttttctttctagttacttatggcctcttttttttttttcctcctccaaagaaacagggtctcactatgttgcccaggctggacttaaactcctgggctcaagtgatcctctcaccttagtttcctgagtagctgggactacaggtacgcaccacctcacctgcctcttgtggcctcttttaaatagctgtataaacaaaaaaaaaagatagatattagtaaagttcctcaatatactaataagcctaacagcatttttttattataacagaaaaggcttattgcttggttgtcttttccctgatctgtgtagtttgtaagcctgaaaagaaaagtggggccaggcgccgtggctcatgcctgtaatttcagcactttgggaggctgaggcaggtggatcacctgagggtcaggagttcgagaccagcctggccaacatggtgaaaccccatgtctactaaaaatacaaaaaattagccgggcgtggtgacggtcgcctgtaatcccagctactcgggaggctgaggcaggagaattgctttgaacccgggaggtggaggttgcaatgaggtgagattgtgccactgtattccagctggggcaacaaaagtaaaactcagtctcaaaaaaaaaaagaaaaagaaaagtggcccaagacttaaagttatcttttgatctaaaagtaaccatttagcttgcttctataataaagttttattatataatttaaaatgttaatttttgtcttgtagatcataatatcaatctagtgtcaatggaagtaacagtaaatgctgtagctggagcccttaaagctttctttgcagatctgccagatcctttaattccatattctcttcatccagaactattggaagcagcaagtaagtataaacctcctttttatgagagggatgataatggcagtttttggatattgattgctaagtgttaaaatcatcatgtactagaatatgtagctaataaaaattaacttaactagaactctatttcttaaaggcattttcctctaaattaaaatcagaatccctggagatggcctccaggaatattctgttttagctagccccctaggtgacttaaatgctcctagaaattagaagatcattgtactagaagtttgaggtttgtgtttttaattcaaacttaagggcattgtaagaaaattaaataaattcttcaaattgtaagtcaaagaaatttactttggctttgtcttacctgttttatgttgctgtaacagaatactacagactgcataatttataaagtaatttatttcttacagttctagaggctg

SEQ ID NO: 74930 - DNA, 1051 bp, Homo sapiens
tccaacccctaggccacacagcctggcttgttaggaaccaggctgcacagcagaaggtgaggagttggataagggaaaccgggctccaccttctgtcagattaggtgcggcattagattctcctaggagtgggaaccctattgtgaaccacgcatgcaggggatctaggttgtgcacgtcttatgagaatctaatgataaatgtaatgcacttgaatcatcctgaaaccatccccccacccatctgtggaaaaactgtcttccacaaaactggtccctggtgccaaaaaggctggggactgttgctttagaacattttctttgattttgtttacctatcctaatatgctttaaacacattcttgactgttatagtaaatatagcaggaagctttatcaaatatttttaaatgtgtaagttttacacagattcttcactgttttaattttacagaaatcccggataaaacagaacgtcttcatgccttgaaagaaattgttaagaaatttcatcctgtaaactatgatgtattcagatacgtgataacacatctaaacaggtatttttatttttttagggttttttggcaaataaaatgcactacacatttcaaacatgtaaattttataaattggataattatcagatagaaaaggggactcagactaaacatatagttgaattttgtttttctaatttatatctaaaaagatatatgattagttttgtaatgtaattattatataaatagtaagtgtggtaagtatattttcctttttaccacattctctgtaaaatcttagaattttagatatgaaatgacactcagataactaaccagattgacctatttggagttggaacagggtttggtttgaaaaattactagttctgtgaccttgggtaaatgacttattcttcctaagtcttgattgtctcaactataaacatgaaaataacaacacttcacaaagttgttctgaggactgaatggaactattttagtatatgtactaattttttgaaaagtctcctcataatattttctact

SEQ ID NO: 74931 - DNA, 3500 bp, Homo sapiens
aggaaaggttttttgttgttattgttgttgtttttgagacggaatttcacttcactcttgttgcccaggctggagtgcaatggcgcgatctcggctcaccacaacccccacctcccaggttcaagcgattctcctgcctcagcctcccaagtagctggaattacaggctttgtcactacgcctggctaattttgtatttttagtagagatggggtttctccatgttggtcctgctggtgtcgaactcccaacctcaggtgatccgcctgcctcagcctcccaaagtgctgcgattacaggcgtgagccactgcacctggcccaggaaaagttttttacatacgaattaaagatgcttctttatgcaaatttttaaaccccaggtttgaagtaggataaaaggtaacattaaatctgagatcatttctagctctggaattctgtgattgtaatgagttttgatttctaaatgttttttcctttcataatttcagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattag

SEQ ID NO: 74932 - DNA, 2443 bp, Homo sapiens
ccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtcaaaagtgcttttgtttctttgtttaatgtaatttttgtgcttcacctacaggatgctgcagtaaattaaatatcagtgaagcttctgatgtataaagaatgctatgaataaaacattaagaagctgtgtaattttaagttatagttgcctctatttttaccatttcattggtaaaaattagctaatttttttcaagtgaaatgaaaaataaaaatataaatttatcaatatgatggaaatcttattaaggagatgtattattgaattttcactgtacctgaaaaggagattcaaaattttttctggggatgtatataggtgaaaatttgattttttaaattatcaggaaaacaagataatgcacagatttctaagactaagatcttacctggatgtgatttttgagctgtggctagacattctttagagccactggaaatattttgaaaactattctagttatagcagagctgctaatattaacgaatatatttgtgtcttcatggtttgtgactattaggccaaattttgtggtatatgttgtcagtctggatctggtgaggtctgttcaacatgaatctttgtgttatcttgaatttagtagtttcaaggtacttaaattcttaacagtttctaatttgtttcaatacatatgggacatggttgatttttttactgtattagaactcttggaagttcttagccttttcaggttatgaaatacctgaaagtaaaattttctaagatttaataagggaagatactattcaaatcattttcttaggatagcatctttacatacaatgagaggattgtacaagcattaatctcatattccaacatccagttacttgatgtgatccaagtaccctggtctttttgaagcagttaaaatctaattaattaactttgggagtcttcactattcaattgatcctcatcattgtcctatttgcatgactccattttttcctccactatatgagttttctttgtcagggggagaggagtgggaagagtcacagaatctcatattcacatcttaattaaattgtgtgaaattagtcttttgtggaaattctgtaggcagtatgattttgaaaagctaaccaatgataattagcattttagttaatactaaatgcataaaattataacccttgaaattaatttggtgctggcagttctggtttagtcatttttaccagtagttagtagtattaagacctgcagtatatgcactttttgagtagctgtcaaataattgtagttgagaaacaacttgtttattctcacaattcagattttctattcagttttgtctcaaatagtaagttattgtgaacaatttaataacggccctcctgttctagtttgcctaatattttagttaagatttagtgttttaacctatttttttaagtttattttttgtattagattttatttgaataagttatgtgggtttagtaattgacctatttattcattgcttcactaattcatccagattagttttaagtgtgtatatgtatttgctcaccagatcattttcttgggaccttgaactgtgaatgttttgtcctaaccatttaatattttctaggtacttgctgcaagttcttgaactattttaccagctttaactttggggctcttagtttcttttctccagattcttgttattttattttatccaaataaatatttaggtgttctaagaagtagacttctgtttaattccgtaaaataagtaaaatcagaagctgtacacactatcatactgttattatttgggattgtttataaatgtaggtgaaaggataaaaaatacctatctgagagaatacagtctttagatatccttcttggaaatttgacttagagatttttcatttgttggcagtcacaggcatagctgctgaatgtcttttggtctgtaatatttgaagtgagaaacattaccagcaatgtacttttaaaatataaactaaagccaggcatgatggctcatgcctgtaatcccagcactttgggaggctgaggcagggacatcacttgaggtcaggagttcgagaccagtctgccaatatggcaaaaccacatctactaaaaatacgaaagttagcctggcatggtagtaggcgcctgtagccccagctactcaggaggctgagg

SEQ ID NO: 74933 - DNA, 1053 bp, Homo sapiens
tccattcacttgcctgagacctccttctcctaattttgcaaagctgacttggtcatttcagtaactcacaattatttactctgacattttgggattacatcagacattctatggtacagttattttccaatgaccaaagtcatatcttattctatctgcctacttgatagcaagttagtgtgagtgaaaagccttggcaaatacatataagtatataaaagaaagttaatttgtttaggatggaaattcttttaccaccctagaactgcattagcatcataattatttcaaatttgctttcatttttaagaagggtgcccaaagtaaagtctacttagaaaaaacaattttttagattaagataatgatcatttttctaattatgtacatctttaatatatgctccaataactatgagctgagagttgtaatgttgtctccctataaacttgaagaagcttttaacttctggtatgttgtttttttcttcagtaaagtaaggataaatactgacttcaaaaaattcatgagtggtaatgatgttacctaatttttgcagatgacagaagctgtataattatatatgttgctgatgctatacttagttttatatattcttaggaagttttcctatattatttgtaattgtaaatgtcgctgaaagtattattagtagtcacaataggaatgaagaaaatgaacaacataaagagttgattaccatacaaagttattattttttacaaaagaggttaaggagcagaataacatctttgcagacaataaaagcatgccagaaataaatgcccacaaaataaatgaaaatgatacctaatatttccaactgagccaaaaacaattgagaaaatgatagaagctatgaaataaaaacatgaatcagaattttaaaaactcagaaatatgataattgaagagaaggaagattttaacagagaggtaaagtcaggaaagaattagaaataaaaggaaaaaagaatttcaggaatgaagactatgctagaaggaaggaatgcaaggacaaaataatgcaac

SEQ ID NO: 74934 - DNA, 1034 bp, Homo sapiens
tttctgcatcctgcatttgccatgatataatgacccattaacagaaaagaaatgaaaaataaggagtcagcatggttgatggttgttacctaagcccataataacattttaaattgcttaaagttgcagtctcctaaagagaaaatatagttgttgagtggcccttttggctacctggcaagatgtataattcaaaagattcaagatttaattcttctggaatcttatttcagatttcctatgtaaaagagtcagagcattttatatattacagaggagtatgagacaattaaggccagaaaaatataggcagagaaatataagaaaacatacttctttccctgtttcacaatactttggtagagtgctaagtaagacaaacaaccctataattaggaagaaaattatgagaagttatttttattctcaaaaatcacattaatggctttgtctgcagctcagttattaccaattgctattaacttgttggcacaaacaagcttaaaatttattttatattctgtagtcctaataatttttttgaaaaagtgtgacattcaaatcgtgtaattaaaacaagtagaataataaacatatatttatgaagggtttgtgtgtgtatttgttttaagttgaacagataattcctagtgattttgtgagtcatacagtgaataattaaaataaatttaaattcaaatattaacatttcaatttccagtttggtgaacataagcaaattattataagtttgttttcaattcctgcaaagcatattaaaattaacttttcctcaatttaagtaatgtgtataagtaaacttccttcccactgtgaaaaggtttcatttattgctatttgtaaactgcctaggatagattcagagtggattgggctggaaactccttgaacagtttcttttgaaataacactacatacgttaagctcaattacacatccaaacagccacagctcacttttggtaatttattcattgatttaacatagtacccagaagagccatgcctgctgtc

SEQ ID NO: 74935 - DNA, 1045 bp, Homo sapiens
gccaaaataaaacctttgccaaaatatcaatgcaattgaggcacatttcttgctctctaccccattctatttaattatgtccattattgtcttaattcttcaacaggccacttcacacaaccattgtgaacctggcctcagcattaatattatccttgatcacactttagcatttcaattttaaagttccaatttgaaagcctgctatttctgttaaaagtttttccatgaaaagagtaaatcttggctacaattcaacggtaattcagcttaaccaagttaagaaaagccttttattcacagtgtttatttagagacagttaagtacagaaatgtgggttctagagacagaaaaatacaaacttttatagagagccatttttttcctttaaagaagacagtgctaataaatcttgttgaatcaagaccttgaaagaaactgaaaatatgtacagatctcaaatatacccaggaaaagtactttatattatcttgctgctgctgcttcataatgtagttttagttgaatgtaatctcctccactcaaatttatttttgagaaattgccacactgaaagttaaaaccatttttgtcattcaaaagaagtagaagatcaatactgaagctctcctatttgttggtacagtctactttaatgttaaaagatttatgataagaacacatttctaaatacatattacataccagtggtacagtcaaacctcaaaataaaacattgttttttaggagaaggaggtggtctatttattattgaaatgctatactaaacgataattcagtgatactttattccaattaaattctccttagtagtaatccttttttatgataagcaaaactgaataatacaaggtatgttccctccaatgaattgttgtgtaacaagacttgatggtaattctaccttttccaaaatctgatatcaggcaatttatcttctaaataatactcctgagtaccaaagctgaaatgttttggcttcaacccaaatgaaacttgaggaagcagattctccagagcatt

SEQ ID NO: 74936 - DNA, 1050 bp, Homo sapiens
cacaagatgtaaatgaaaattacatcataacattttctgtcacgaacaaaagagtggtagtccttcttttccccccttcctctctacccaaaaccttttctgggtaagtttattttcaaaattattgagagccaggtaacattgactattctttaactgcttcaaattgttcatagtcaaatacttctcagtactttaatttttaatttagagcaaaatataagaaatcaattttaaagcataaaatgacactgaacagagatatagagtatttcagtgtgatcttaggtcaaaccaattcttttaaaaaatctgtaacatatcatctgctgtcactggggctatcacatgctcaaaacaacttctcaggatttgtttttgcaaacttaatggccaaaattaatttgtcaggtgggcctattattgaatcttttaaacctgggcttcatttcaagcttttttatatctcttgctttcttgtaacagttttacaataaaatgccacatgggttaatgtaaacttttgaaattccactgatagttaatgagtatgtttaggttagaagttgaatacaataatcaacatggggcttaaaaatcacttaaacaaggggtaaatggttaattataaatagaactgttggcctacagaatttaatgagagatttgagtatacatatactttatatataaactatgtatactttatatagtttgaatataacacagagaatgtgtttaaataaaatcttattaatgcagctaaataaagttcaaaagtagaacttaaattatttgaaagtattgtcacttaatatgttgggctttatgaaatattaagtaaacttaaaaaattagaaacatagaaattagaaaaaacttatctgagttttttttttttttttgagacggtgtcttgctctgtcacccaggctggagtgcagtggcaggatctcagctcattgcaaactctgcctcccagattcacaccattctcctgcctcagcctcccaagtagctgggactacaggcgccgaccaccacgcccgg

SEQ ID NO: 74937 - DNA, 1072 bp, Homo sapiens
aagattttcctttctgggctgcttcataaatagttaccagattgaaatactgtttctaacatattttcctgctcaaaatcactgactgctccatctcacgtcaagctgtctgtaatcttagcttagtgtttaaaacttaccagtgtagctccattctgcctttcagcctccctataacaccagacatttcttagcgcgagttctgtgctctgtccatgaaacatttccattcattcttgttaggcacaacacatgcactaagtccctgcctttgcttgctcctttgtaaagtctttctaaccttgttttatccacagtggtttctctcttctcttaacacattaattgagtaccttctataaccaggaactattgattggtatatatcagtggacaaaggccataatctttgttctcaaagttggatgattctcaaagttggatggcattagaaacagccactaaacagcagatgttaaaaatgaaggaaatcatatagtctgttacatggcagtcagtgcagtggaacaaaaatacagaaggttaagaaggatttaggagtcctggggtagaagtgagtcattgtggttataatagatggtgaccattaaaagaaagatgacatttgagcaatgactgtaaggaagtgagggagttaggcattcacatagccaggcgaaaacattccaggtagaatggacaaccactacaaaggcgctgaagggttcctaatgtgttcaaagcacaccagggaggccagtgtggtgggggctgaatgagcaaggaggacagtggcaggagacaggtcagggaggcaacagcacacgggatgctggcgggccagggagggacttcggcttttgttccactcgaaacagagtcttgggaggattatgaattgaggagaaatgagacctaactgattttagtatcagtctagttactggctgagcatatgcttcagggggctgagggtggaagcaggggacttagctcagaggctatcagcataatcaaggtgtgatttgtaccaagacgaagtggataaagaagagagagagaagtcgatatt

SEQ ID NO: 74938 - DNA, 1048 bp, Homo sapiens
tttcacttgcttttgctgtctaaatactatttcctgaagtgtttcccagaggccgtttgttaataagtgttatttgggaagtaggttaggtgatttggtaaacacttggttaaataaaactagccaagttctttaccagcaatgtacatcactaataagctgatgtacaatgtgaaatgatgagggaagccttgctgtatagtatttccccataataacgtttgtccatagagctctattatcagatgatattgggcgtgttcagggtggtatggccgtagactagagctctattaccttaaatcattgcaccaaggactagtgttccttggagcatactctgcaaatggtagatgagaaatcacttctctcatttcagaaccttgacaataaaaatctagagcagtctgtgtagacataagaattgaaatatctatctggtttaagagagaggaaaagagaccaacttttttttttttccccagcttattctcaagtactaaagtgtgtgtgagcaatcagctgccaaacaggaagagctgttccacttctaattttagcttgccaccttgcattgctgtaggagtggttcccacatgctgcaaagaggttattttgtgtaaatagagacttcttctatgtcgtcaagtgggaaagaatcatcattaggcctccccaccatttgcacagtttctgcatgttgaagatgatctgtccaaacatttagacctggtttaattcttttgcattcataatttaaactggatcaaggattcctgctgtccaggatcagtgaactgatgcaacttatctctcctctttattccccagaactggacagcatttgctgtctagtctcagccaaaaggaaccacttcttcacagctctgggtgtccatgaatcaatttgtattgaaccactttgtatgacaatccttggggcacacttgtatattttgggttattttggtgatagcaaagtggaatgccctggacggcaaactaacattgttatcttaggctgatttataggacttttctcctggac

SEQ ID NO: 74939 - DNA, 1055 bp, Homo sapiens
gttggttcccatcgtgacagtaggcaaaaattagctagggatagaacagagtacacaagtaaggattgattttgaatagaaaaactagggagaaagggggaagccttggagaaaactgccttgccacacagaaccatatccatagtgattaagacttctgactcatagaacacctgggttcaaatcatggctcttttgttagttgtgtggctgtgagatctttgcttactatttagaaccttggcttcttcatctgttagaggtagatgaaaatagtaactcattcatatagagctgcttaccggactaagtaaataatcatgtgaagtacctggcatatagtaagtgcccaataaatgttaactgtttgtattatttttattggagtgccgcctaggaataagagagttaagacaacatcatgagacccctgagtagcgaaataggaaggatgcaggcatataatgaagctgctattgccagcatagctaggaatgggaatggaagtgggaagaggggaaggaagacactgactatgtgaacaagtggctgctgaagacagcagttgtcatgcacttacagatttttctaagataggctccaatttaaaccaaaacagagaaaattaccttaattatttagaagtttctggttctgcctcaaaaatcttatttaccaaggtaactgcttaagttctccacttttttatttgtgttaacacaagggtttttttgcatggagaactattaccttacagtatagcagtctgcaggcatttagtaagtgtctggttcctttatttgcagatgggcatggttttctactaaagttggtggtgactagtggtaagtttataaggaatttaagttaaaagaaaagtatacataccaataccttatgaggaatgtgttttgtgaatgaaaattcaggtaaagtattgggaatatggtgtgacttctgcatgccctgattcagtggtcctgcaaaccaggctctcatgacaaatagatgttcccacctggggaccggccatagtcagtagaagccctgaccct

SEQ ID NO: 74940 - DNA, 1029 bp, Homo sapiens
tgtctcctgttctgcaactcccctgagatcactctagtgcagtgtttcccagctagggatggttttgtccctagggaatatttagtcatctctggagccatttttggctgctacaactggggaattgctactggcatctagtgggtagaagcctggcatgctgctaaacatcctccaatacacagaaatgctcccacaacagagttaaacagcctaatatgtcaattgagacaaggttgagaactcctgctctagtctaaaccagcatcctggatttccttattcctgaattaccacaacaccctttgaactggtcttcctccacctagtacttaaacaatgcaaatccaccttctgtgccctttggggcttcttactaccattagaataaagagcatcctttctcagaatggtctgtaaggccttatagggtcttgcctgtggccacttttccaatgtcaatcaatcttgttgctttctgactttctccattccacagctgtattggcttagttctcatctttgtctgtaccttgttcttcatgcccatggggtttcatgcacactaccctcacctgaaatgctcttctccacacctttatgtaggtaatttctcttgatcattctttagttgtaactggaagattattgtgcatgaggagtgctttttgaaccctgctccagagtaatcttctaatgcaaattctgatagctctggacttaaaaaaaattatgtaggtttgttgtatacttgtttccctttttaaaaattcagataattctgccaggtctggtgatgcctgcctgtagtcccagctactcaggaagctgagacaggttgattgttgaagcccggagtttgagactatagtgtgcagtgatggcacctgtgaatagccactgcactgcaacctgggcaacatagtgagaacctgtctaagggaaggaatgaatattttaaaataattttaattagtatttattaaattaagagattattaaattaatatctattaaatatttatgctg

SEQ ID NO: 74941 - DNA, 1115 bp, Homo sapiens
agaagcattgctgtaaaaggtatcttaacaggtgactcttctctaaactctgtcacatacacttgcttttcattagtgagaatgaacttttaaaataagtgtattgttcatggagagagtctgacattacaggcagcatgatcaaagtgatcatttttttttcttaaggaacatggagtgcttgcctcttccggtagaacaaggtaaggcagatgtccctgaaagtatgcaggctgtttcctaaagagcaacaaggagaatgaggaaaaagcctccattaaactttcaaagagacatatgtttcaaacagacttgttcagcacttactccctctgtaaaagtgtgggaactctatagatgcctctttcctgtggatagaagaccactgcatgccacaaggaagtaaacattacagagatcaacaattcatttactaagtcctttctacaatattgtcctgaacccttgattagttgtagatgaagctgggttttttttttttctttatgccacagaaataagccatttcctttcctttctacgtggttatttttacgtattgtgatttttaatctcactactcttaggtcaaggagctttctttatatttaatgtaactctaatattcaaagacaatatgagtagtgtttaagagtgtggattctggactctgatttcatttaaaattcaataccagactcaactgttaattagctgtgtgatcttgagcaagttgctttaactctgtacttcggtttcctcaactgaaaaacagaaacaaaactcatatttaccagacacataatcaatgcactgtacacattatctcactagctgctattataataatttttttacccaaaacaatagctttggctacttaagaagtttttgaggcttatcagccaaaaatgtatttacagcttctgataattaaatgttacttattattttccttcatcttttaacattgtataagaattttccttacatttttaaagatgcttttcaagttcattttatactaagtgcctttttaaattcatcatacacacttgtgattaaagggattagagaaatacccacatctatgcacttataaaccccagaaataa

SEQ ID NO: 74942 - DNA, 1059 bp, Homo sapiens
attgcttgtgggagtaaatggctaagcgtattaattgataagtcagaagtaatggcagtatttgcatattatcatatatggctgaaagtgcttgtgagtgtgtgtatgtgtgttttaattatctctgctgaaatgtacacatagccaaatgtatggtatgtgcagacaaacatccaaattgttgaccgaattctttttcacccagatttattgaaattgggtaagccattcactcttttgtaccaaaactactgaaattgggtcaatgaggctacagtttgagtttttcttgaggttatgtcaagatagtcctataatcaaagtgctatgcaaacattcagagatgttcacaggcagggtgataatctcactcacttagggatctatgctgccttcaatacagatgtgtaaccccattaacattaataagacttacgctcacatatcgatggagagtaaatccctaattagcagtgagaactgttaacacccccactgtggtaatacctctgaaagattttcatgttgctgtgataataggcacatctgtaaaaaaaagaatattttaaacaatgtggaagttgacacacaatcaagcctgagacttatatacctgtaactgtcacaggtaacatgcttttactaagggagtctgggcctgaatctgataacagcaggcagaggaagagattattctttgcatttacttaggaggacatgaatgtttctctcatgcaaagaggagaatcgcttgctctttctcctacccaggatggtaattattctgcaaagatgtgtagaagatttcatcaaaggactagtattcaaagcagtggcctttcatcccatttagaatgtaatatgtaaataggatacacattggacatggtttggctcctcttggtaacggaaaggacatggattgaagcaaggagcttcccatccacagcgatgtgttattgatgagctggcatttgccctgtggccctcccagaggattgcttacatctattactcacacacatcgattggttaatttgataattctatcaccaatca

SEQ ID NO: 74943 - DNA, 1049 bp, Homo sapiens
tttccaagtttcatcaatgccctttttcagttttaggggttgtggggtgatatacaaagtaaatatactctaagtaaattaagcatttgttcttttatgagcacacacacacacacacacccttaatcaaatgcaaaccaaatgctctgcttgtatgctacaactttggctaagtggttattctatcaaattctagacagtgataaggaatctgtaaagttatggaccctcctttcctttccaaatagttttgttaaataaagacaatgtgtaactctgtcatcaaagacttgtccagtgaaattgttcaggaggactgtgagcatgtcagtttgttacagagcatagctatgtctgtattgctaactctcaagatatcccttcctcagttttattttctttcaatgtgtacataaatgtggtggctttaaaacagcttatgctcaggatagaattaggattcttttttggctcacaagaaaacaagatagggaaacttctactgagctctgttgtgtagcatggggatagagacagccagagcggattttctctttgactctcccttgggtgggacagctcctggtgtccagggcatgtgcatgccaggtattctctttaaagtattctcatcttgttgtaattatgggaatgagtgaatgatgatgatttctgaagctcctcaacagtcctcttgactttgccagatacacatacatacacacacacacacacacacagagagagagagagagagagagagagaggagagatgtatatatttaacctaacaacatccaagaactggtttcaggttatagaagtatgcactgttgacttgctttcctgtgtaaaaatgatgcccagttactcaccaagaggccttatcttaaaggaagattcccacatactgatgctgagtttggcttgcatagagactgaataacttgttatacctgatgatggcattcagagctgttcatgacagctctgctttctagctataatggaacaggcagaagtgaaaatgaattaagaaaacagaatgg

SEQ ID NO: 74944 - DNA, 1040 bp, Homo sapiens
tttttagcaattcgcatttttggacacagtgtgctctgagtgtctgttaattaattcccttgtttctaatgtcttaagtcaacattttaaaaattatagtctgaagaccacctgcatcaaaactattagttttaaaatgcttatttccaggccccaacccagacatcctgaatcacaagctccccaggtgattcttatgaataccgagcttcgagaacaactgttaaatgaaaagaacccactcaggtatggctaaagttgacacgcttaaactcacatggacttggtcaacacctagaaggtcaccaactagttctttaagaagggattacctttgccttcttctgctagttatcagttacacagataatatcgtcaattacagcttgcaagactaaccggtctttcacaatctattttcaacgtgaaatcgtcataagagataatgtctatgccaaggtctcagatcatattcgacagattcactactactagctgggcagcaaggaagaggattcagtgccccaaagagacctttttcatgcaacacatgcaaatgaaggatgcaattaattaaatatttctttgacactgcccaaacgcaaatgtatcctgctgctgagccttcccttagcttgttgccacgaccatcaaatacaaacacagtgtagggaagggtcactgtaatatgcaatacaataaatatatcagtggaagaccaacattaaaagagttatttgctaatgggcaccatgccagggttattcaggcaatgctgcctgcagaattcctaagctgagttcacaagatacagatcgatgcaccgccaaagagagtctatatcaatctccatttcattcattagctcccacttcgagctggttggctgctagttaactctttaatgtgggagaaactgtcagtgtaaaggccactgggacacgtgctcttcccagctgtacttgacctgtcaatatttcttgcagcagactgtttaaactggtacggctaatggcaaaatggagacctatggggttttg

SEQ ID NO: 74945 - DNA, 1044 bp, Homo sapiens
aataaaaaattagccagttgtggtggcgtgctcctgtagtcccagctcctctaaaggctgaggtaggaggatcatttgatcccaggacatcgaggctgcattgagctgtgtttgcaccactgcactcagcctgagcaacagagtgagaccatgtctcaaaaaaaaagagaaaagaaacattgttttgtggcacatgactgctgtatataatctgctttctcccttcagagccaatttagtttccagagaactttaaggggatgtaacaatgcctgagatttcagaaatagcttatttcttccctggaaactcgaattgggtcaaaaccacaaaatatgttggttcttacagggtgccttgcactttgccaggcactagtgctagtaaaattaaatacatggtgtttctaaaacgtcagcattacccctaatacgtgcactgtctattggcattaggggagccactaactctaacaggttgttcagggccaaaggaacagatttgctgtgggtaaatcagtagcctgcattttaggggttctgtgaggatgcgacagaaaataaggttacacacagtgaactgctccaagtgacatttaaggaagattatttctgagagcgatgtggaggatagatttttgaaagatgatgctggaaccagtgagatcatttaggggctgaggccatagtccacgtataaaaaagaaggcgggcagggggtgcccagatgtggacagtaacagagagcaccaggagtagtatataaatcagagaattatgaaggcagcaattcctaggagtttgcgatgtgaggtgggaggtacttttctccaaggtagtgaatttagttgggggaataggtttggggatacggggaggaaagaccaaaggagattcagttaggctgaattgggttaagttttcaatgcctgtggaacattgtggtagagacttgggaatgtccacggctgtgaatcatcagtcttgctattagccaaagccacaggcatagacaagattgtttaaggtggtggttctcaaagtg

SEQ ID NO: 74946 - DNA, 1022 bp, Homo sapiens
gataaacaagtcaaaacggaagaaaaagtgagtgaaaacattttgcaagaaaagctatcaaactcacaattatgagatggtcatttaaaaattttccttttcattagagaaatacatgtttgttttaggaaatgtacaaactacaataaagtatacagaagatactaaaaaatcacccgttatcctatcacacagagagaactgccagtaacacttgggtacctttccttgcaggaattttctctgcacatacatatttattaacaaaatttggatcatgcagtacctataatctgatatgtgtgtcaaaatatatttaaggaaaaatgtaaacaaatactattttacatctacatctatatacttctatcatgctttgtaaatgtgtttcatgtttgagtatttgtacaacgagattttcaactcccagacagcaggagcactggtttccagattatttccctgtcaatatacttgttctcccccatttccccaaagtttctgggagtatttgttggtacttggtagaccgctgcaattgctcattggacaaatgaatgaatgttagtctgcccttgattagaagtttaaattttcatgatcaatttatatatagatatcatggttgaaatcaaatggagtttaaatatttttataagttttttttcttctggaaactaagaattgtgaattttaattattgaaaaagatgtgcattttaaacttttttttgagatactcttcaaactatagccatagatgaataaaagagtctcagaaatgtcagaacatattgtgaagatgatcactgcatagacttcaggtagatcttccaggaaaatattacaggccacttgcctgatgggtacaatgtgttttactaaatctgatttgcctgagagatgggttcaactgacactcttttctctagggagcaagaagagggcatcaaacaagagtcacgtttgtaaatattatacagataatttttttttttttcaacagggggtctcgctgtcgcg

SEQ ID NO: 74947 - DNA, 1033 bp, Homo sapiens
gtataaattagtagaacaagaagaaaggttctatatcagaatgatgagatagaatgaaaaatccttcctgtgtcatcaaataagaacacgaatccgctctctttttacagatatgttaacagaggcttcccttagaagaattttagctagaagataccacatcatgtgtttattttatcttcaaaaataaacattttggctcccatgggaatccattaagtacgttttttgttgtacgtacatttttctatcactccgggagtgcctgacttgaaaattgcaaccgcagcacccaaagagacactgcatatgggaggctgaggcaggagaatcgctggagcctgggaggccgaggttgcagtgagctgagatcacgacattgcactccagcctgggtgacaagagtgagactctgtctcaaaaacaaacaaaagcaaacaaaaaacccccaaaaaaacaaacaacaacaaaaacaagagatactgcataaccagttctgaacgttaagatgtgccagaagataattccaggggatcagtgggtctcctagttctcagagaagaaaaagaacaaagcagactgtcggggaaatagagtcaaagaggaaataaagaagaaaatgcagctactaattgagactcattgggcccagttatttggaagtgagcatgtttaaatacttctagaaatagcgtgtgtataaaacaggtccacaaactctttgaagatctcccccatttttgttgtttaagggtaaattatacgctgcatttcattttttcttgtaatcttagatcaggtatacctccatcacaccatactatgcaagcagtggttttagaacagtattcatgtgtcaatatccttttcttttccttaagagacatcagttaaaagaagaacctagagaatgccttaatactgaggggatattacatcacaggaatgagcccagggatttgtgaaagtgactaaaccaagaaattttaaaaccttgttttacaaggttcccatagttttgaatttttcaagt

SEQ ID NO: 74948 - DNA, 1047 bp, Homo sapiens
tcactaatgggtttcccggtcctccggagtgcaatggtttcaggccagctatgacgtaccatggaagctgccagagcttcagactgtcacaagtttcttggtggatatttacctagaacccctgcctacctcacttccctttccaggataatttccagcatccctccagattccacctgcgtgcctgcaccctttcatgtcaagagggaagactggcggtggaaaaactgtcacagagactgtaatactcagagcaattcttgtccccagaactccaagtcccggtaatatgatcacatctactcccagactccatttgattaacatcttaacaggctgcagatcttccacatctatcagttaacataggtatagtcagaaaaacaggaggctaaattcagtttggttaatagctattcctgaaaaaggctcgcgtaacttttacggaaaattaggcatttttctcttgctattaaattgcactctcctcctgtatcacccaaccactgactatatcattttacaatccccatttcctccatttgttattgctacagagcgtaaatcgggattcacagtgatcagctcttaccctctgggagggggggattacatggaaataatccctttaatgtgcgccttgcctctaagcacttcacacagtaataaatgggtaaactgactttgagcaattaagaaattaaatggaactaataaaatgtgtgttttaatatttcttgatgatggttattttgtttggagattagtgaatatgaggaagtcactctcgttttgcatggagtccaattgtagcactttcgtaaatatttctgtcacttttctcaaactaattttttcctttaatacttcaatgtgcattttggcacggaccatagattgtgataggatgacaacacaaatggcagataaaatagatttttttaggggagctggttattgaatgttcatgtaagccagtcttatagagagcagaaataggccactctctccacatcctgatttgctcggatgtgcagatacttcctt

SEQ ID NO: 74949 - DNA, 1015 bp, Homo sapiens
attacaccttctgtttgacatttgcagtacagcagaaagtgctgtagatacagtcacattgtctggggactggggttggatgtggggttagtaagatggtttcccttgcctaacttctaaattcagttcattgatagaaatcttgacccaatacaaaaaatatcccttcacaacaatataccagatggtaaataattcacccatagaagtacaagtatatgtcatatccaagccgtttttttatacaaaatattgatccgatcctcagataaatttttacgttctttatggttattcctagacatttgttagtctaattataccgcttactgtgaaaatcatctaatgatgtcagaggaattgagctcctgtttctgtagaattaggagtagtcagcaatttaccatagcacagaggcataagttgaaactgaagtttatttgcattcaggcaagtactctactgtttccattttgctggccttaaaaacattcgggacatagcgtaagtataatagcataaaaatcatactactataatgatgatcctaatgccacaaaacaggctagattttgcctgaaaatttagacaaaacatgataacccatactttacacaaccaatgggttagccatgcagctgtagttattcatcatccaaagtactgcctcatgcattttgctaaattgtctaaatcctggtacagtattgattttcccctctatgaactcacacccacccaaaaagccacaagagccccttgccctggctgagttctctctgaagtaggatccaggcatgttcttcctgacaggggtcctacagaagaaactgatcactcgctggtgggaagcaaaccactggagacagaaagggaattttatcttagagaaacatgaaaatgaaaaagctagttaccagaagtatatgcattacaatcttattttagaaagaaatacaaaaaaccccaccaaacacatacatacctacatacacaggaacaggaacagaaacta

SEQ ID NO: 74950 - DNA, 1058 bp, Homo sapiens
attgaattaaaaatgtaaagattatatatggatataagaaatgagagatgtaaaggaaatgctacacagttgatggcagctgagggtgcataggaggacagagaaaatgagccatcgtcgggtgggggcggcgctcagaaacaacagcaacaaaaaggacatgcagactaaaagaaggggcacaacgaccaggaaaatactccaaaacacaaaaaaggatgagaattcgcttatatgacatatctagaacaggcaaactcataggggaagaaagtagaataaagattaccaaggatttccagcgggaaaaatgggaagttactgtttaatgggtacagggtttcggtttaggatgatgaaaaagttctagagacaggggtggtggttgcacaacaatgtgaatgtacttaatgccactgaaatgtatgtttaaaaatggcaaaatgataacttttatgtcatgtatattttaccacaaaaaagggattagaacacatactaatgaaacatgacatactaatgagacaaaaaacagatgaaaagaaaataaaagcaaaagtagacatagagaaggaaaaacaagaaaaacaagatagggaagaatcatgatacaaagggtggagagaatgaaaagctgtggtttccatgacggctaagacgaaacagtagctggagtaccatattccaattattgatcattcagcagatatgtatgaagcacttacactctgctgggcagttgagatacagaagtgaattgtatggatactgtctctaaccagtagtatctgtgtggagacaggttacaaagaccaatgggatagtggtcttgcccccaaggagttcatggtcagtgtttgtattagtctgttctcacactgctgtgtaaggacacacccaagactgggtaatttataaagaaaaagaggtttaatggactaacagttccacatggatgaggaggcctcacaatcatggtggaaggcgagggaggagcaaaggcatgacttacatgacagaaggcaaaagaacatgcacagtggaactgctctttataa

SEQ ID NO: 74951 - DNA, 1026 bp, Homo sapiens
gaaaattccaaaaggaatgatttaatgacttgtttaaatctatatacttactcccttacctaataggctgagagcaaccttcaagttcttcttgttagaaaataatgctctttctcttacaatgattccaaaaaattttgttgacatgaaacactcttaatcttcatccttgtgaccccaaacactgattagcccatggggctagcattacaccacatgaacgttcctactcttgtctacatatgccagctcagcttagatatctttattcctgatacccagatttctttctgctcactacacttgatgccttcatctctttattgataccattccctctgtttagagttcccttccttcatatctctgtaggtgagcctatcccttaagagctggttaacatgatgctgtctttgagatcctctccttttataccagacagaatcatttgctttatcccgttgcccttggaacatacctctattatagcacatatcacattatctcattatcatttctttgtgtgcctgcctaactctagactctgctctctggatcaaggactctgttttatccatctttgtcttcccagtacccagtacagtgtataatacacaacaggtacacaatcagtattgaccacatgattgagtgaaatcaattcctaaatactttgaacaaagggtggtgttgaagaatgaaagttatagatcattcttggttacactagacttctcttttgttttctcaggttattacaaactgagaaagcatgttttcaaaaaactttccactatgtagatgtaaacaaagctttggggaaaaaaactacattctaaaactctagttagaatacgtaaaattagttatttcatatcagtctggaaggaactgaagtagataagctctagggtcagcatatgcctcgttcagctttctttaaaagcatggggagtaataaatctctccattttatcttcagtgaaataatactgctgaaatatcacctcatttttgatgtcagtg

SEQ ID NO: 74952 - DNA, 1050 bp, Homo sapiens
ggcctcccaaagtgctgggattactgtgcctggcagttctttttttctgaataaagttaacaaaaggtattttcctggttctttagtttctaagacacataatctatgagggaccttgctaggtgccaggaagctgaccaaggtaaatcaaatgtaaatctgtcctcaaagagtttacagactgtaagttgggggaagacatctataattatttctaatattgccataagagggagatgattcagtatctgatcaagaaagggggttttgatcctggttatgtgacagagtcacttgcgaagctttgttaacatgtgaattcccagactctatcccccagagttctaatttgataggattgggttacagtccagcatttgtttgcattttaaagcttcagaggtgatactaactacctgagaatatctggcaaatgggtttgcagttacaccagtggttctcaaccatggctacacattggaataaaccagcaagtcttgaaaagtccccctgtcccggctgtacctgagacctgttaaatctggatctcaggtggtggggcactggcatcaatattcatagacatttttaaagttttccaggctgggcattgtggctcacacctgtaaccccagtgctttgggagcctcagggaggaggattgcttgagcccaggagttcaagaccagcttgggcaacatagggagactcccatctctacaaaaaatgaaaaaattagctgggcatattggttcatgtctttggccccagctacttggaggctgaggtttgaggattgcttgaacctaggagatggatgctgcagtgagccgtgattccgccactgcacgccagcctggatgacagagcaagatcttgtctcaaaaaaaaaaaaaaaaaaaaaaaaaagaaaaaaaaaatccaagtctttcagggctggttggagggaatgaaaatgtgtgcaaagtgcctaggtataatgcctgatgtgtattatatgctcaacaaatactgtttgattaattaacaagcatgttccataagaaaggt

SEQ ID NO: 74953 - DNA, 1141 bp, Homo sapiens
ctgtagatgggaaataatgctgtattgtattggctaataaaggggactgtgaaaagcttttttttttttttttttttttttttttttttttttttttaagaggaagaaaaacgccaaaagcaggtcacagaaaatgatctcaattactagagtggcaccatgaggcactcgggtccatggagcttgtcaaaagaattaatgagttgatcacaggaatgaaaattaagtgatgttttgggataggacaatcattggaagtttggtaaataagacgaggccctgttctttggagggagaggtggctggtagctaaatcaagggagctgatgtgtgttttcaaaaaagcaaagccacagtccatcctctgatttgatgtctgtcttccctggttggatctccttctccagcattctacatttttaattagagaagaaatagctttgtgggctgtaacttggttctttcatgggtacatatgtatgaaaagtccccctcagaggttattctttctggtcatttgccattcagtctgacttctgaagaaaaagaagagactccaggagactccacaggatgtagctaactacatgggcttttgaatctcttggctgaggatgagacagtcaacgtttctctcttagctgaaattgcccaaaggcaatggagacagcagcagcacctgcctcacaggactgtcctaaagcttaagtgaaattgtgcaggtgatgagctttgcacacgccccatgtgtagtaagtgatcagtaaacgccagccatctttattaggaactgccaactccagcgaatcattctggctaacgcatgtttcctggtgttctgtggcccttccagaatatctcagacatacccacgatgtcacgatcataaacattttaataaatgccaacaaaatttgaaatgcagattcagagtttcttatcaaataacagcaacaggttcatgagatcttccaccctattgaacactcatagctcaggtgggttatcttttcccagggtgaattatttcctttgaatcaggtcctgttcagaaatgataggcagtttccaactcgatctcaacatcttcagcgcttcccagtggactgaatgcaggggctatcttcttggttagtctctg

SEQ ID NO: 74954 - DNA, 1039 bp, Homo sapiens
agcaagatgctgtgctggctttttgccttttcttccagtgtttacacaaccaagacttattacatggtctgtcattttgttactgggctggctttggtttgagaattaggtaaacatcagacattccatcacacaattttagactcaatcttactttataatgatgttaatgtttattgtacaaagcgagatgcatttgtatattttagcattttatttcagtcacagaatgcaaaacctgacactggaatcagtttgatttttttgtgtgtgtgattgaagatattaagcactacaagaacgctgaaatttcaatctgattaggatcaaacttcttcaggatcaaaacactctttttcctccccctacagttttactaattgtgtgctacttgacattgtggagttattccacagcatgatagctaaatatgtgaagtgtattttactatgcagaattatcagctcattctatttgtttttcatgtgtttaaggttattaaaagaactcaaaattagaagtcatgtgtatgagttaaaagaatgaacccaatcattgttagtaggctgaatcataaagcaatagccggtatgtcaatatcaagtaatgaaaaaaatcagaatttgaaagcataccttctctgtttattagttggcaagataccagaaaaattaggagaatagcacaatagtgaatggtggagtggtttattttcagcactctcaaattattctgggtacggaaaatgagataaaagtaaatcggaaagaaaggcatcaaacatatttgttggagacctttgcttaatggggagaaatgaactgccctcgctcactgttcctgaggaattgtgtttcttcaagctgtaaatcaaatcccagagagatagcatgatgcatgatgttttccaaataataactgaggaagacaaagttcttttttttttgtcagcctcaggtttctgaatttagaccttaattaagattccaaaatgagaaggcatctccctctgcacacatggtctatgacagtgtcctca

SEQ ID NO: 74955 - DNA, 1083 bp, Homo sapiens
tcataagaagaaggaagcagtctaattcagtttgaagaggagatgaagaacacatatcaaaagcggtcttttagcaaagtgtctcacaaaaggacattttagtggtttgcatatgcattaaaaagctgcaagacatggtgcattcaggtaagtatagaataaataggaaatggtgagatcatcggagattccacccttcacattcacacagccgaacaaagagcttcattatcgtcatggcgataggaggacgcatctgtggcgccattcaccccctcctggaggtaccttcgtcagtggccgcggagaacggagagcaggtgccttctgctacagactcaaaaattatttttgaattcactagagtgtgtatctgtgtgtgtaagtgaggggggtgtgctagaatcacactttctacttaataccacagttgggtgcttagctgtagccaccggttccctttctacattcacaaaactggcagatgaaacatgaaaaagaatactgactctttaatctctgcttctccacctaaggcccaaggcaggctgacagggaacttcattctggaaacaggactttctttcttcctttttctttctttccttttttttctttttaattctggattactttttctttggcttttgaaaactgggctataggggaatgaacctgacatagacttaaaacaagaacaagtttccttatctaaaaagttacagtccttgaggcttacaggaaggtcattttcaaaacccacaggagaaacacaattatagccagaaactgcattaagtgctttatttactcgcaaaagagacagtttttcatttagaactgctcataggatcaaccgaggctttgatgctgtgcagacttttctatagattttgcaattagtgagctagatgtcttaaatagcaggcatccagaaattggtttttaggtttttttttttttttttgtaaatctatatgctgagcaatatttggtagaattgaaggatatttgatacttactgtgagttatgagcttaaggacagaagacctgtagatgttttgtgaatgagtatgcatcat

SEQ ID NO: 74956 - DNA, 1114 bp, Homo sapiens
gcttggaggtagacctctttgagattctggatatttgaatggttccaaagatgctttacccctcgtctttgatcgtttctcctccgtgtgagcaatctcaacccgcgtccttatatgtctgttccttttgatcttgtctaacagaatttatagtcctccgatgaactaaatttacactggtcagtcgggggagattctggtgagacttcgctgaatgttggaacaaaataaattccccagtggagtcagagagaaacactggcctaagggaggcacagaattgacttggctggagccaaacagagtgacagctccacacagactctgaaatatggccccaaatgaaggagcaagtaaaaacaatcagtaatgtgaaacggtgccattaaatacccactgaaagagagctttaaaatgcagatgttaaaaatgatacttgaaccaaaatctcgccaagttgaaattgatttgatttgtatctgggtactcctgagctagtaaaaggggaaagcacagtaaatcatcccctgaaataaagtgctgtggatgggaatggtttaaaagggtgccggaaatgtggaaaacctgctgttattacttggctgcggatcgcagcaactcggcgccccgcgaaagctcaccggctggctggccactagagggcagtgtgcactcatctacgtcgcccacttttggcatgtccttgcctccgtctgctgaaatgaaaaacctctaactgctgtaataaatttggctaaattagctgctaaatggttatctcaagtaatatgtatttgcattaatcatcttgctctaaaccagaacaagccagagtcctaaagacgtagtaaattcatattgtccatttaattacggctaataagtgcttcatatacaacagtttcatgaagtacatttagattttttttttttttttttttggaggggggtggatgggtgtgaagggaagtcactttggaaaagggctgtgtttaaggctgtggaagctcttctcatcttgtcctgagccactcttcctggctctgaaagtgccacatccatctattacatccataaacatataaacttggaaggttttcttccattctccttt

SEQ ID NO: 74957 - DNA, 1034 bp, Homo sapiens
ataaaactctatgtacaaggattccttgatatcagaactcatcttgaacacatcacaaacacgggggagactttgcacggaaatcaggccttggagaaagccacactcaatacacatacttttacctttagagagaattaatgtagagcagaagaggtcaaaaaaaaggaaatagaaagtagataaatgaagactcttttaagtggtgcacattaaggccctctctagagcaataatcattagtgtctgattgatatgctgttggtagcaagcacattcatgccttcaagtcatcaccaaagtatgtgaacacactctgaagggccagtgtgctgatgagccatggttgttagcttcccagctccacttggctgtctcaaagaaaaatgggattcaggtactccctgtctaaattatcagccaaagggcaccaacttccattcccaagacctattggaaattttcctactcagaccacgtgtgggctctgcttggtggctttaggccaggagaagccaaagaccagaatgatgggggtgggagggagccaggccaagtgcaggattggtggagaacttcccagaaagcctgcccccaaactcaagatggcccaatctgtgggtcttggttacttttctgctagtttgaatccaaaggcagaatgtagactgggaaggggagagaaatggtgtctcacaccagaatttaggaagcagttgagcttgggctcacttgcagatagactgttaaggacacattttaagagcagtaaagcttgccaaagatcacaaagcagtgggccaaaaaaaaaaaaaaattgccttcattttttacaccgctattgtttgattccggcaaagcaactcactttgtttaccgaaactttaatgcccaggaagtcaaaccctatgtaatatgctaagggcatcaaagggaagaaatataagaggaatataatgttccctgccacttttctcccgctctgttttacttcatttccacaagaactggagtgtgtgagtgtgtgtgtgctg

SEQ ID NO: 74958 - DNA, 1040 bp, Homo sapiens
tatatatatatatatgtatatatatacacacacacagatgtatttatccagcactacatatctatatgtattgtgtgtatatatacctatatagtacatacaggtatgtagtggtgtacaattatatatatgtgtgtctggagagaggcagacactcagtaataacttgatgtgacatatgtctctctgaaatgtgaccagttgctttgcctctgatgatggccctctggctgttgcccaccccctgcgcgtggtgggcaagcttcactgaagaacatggaaaagaaggaataatacctgtaatacctgaggtgtctttagagtctgactcagagtcggatgtctccgaggattcggaagttttctccggcagatgggggagctgtgcgatgtccatgggtgtgtccttgtactcaggattgctgtggaagggaggcactggtcaggagtgcagacacccattctgcatggtttgtttggaccatcttctcccccacttctttgtcccagacttctggagtttagaaagtttcaaagactaaacatgaaatcatttctcagctcttcatgggattttatggaagcttggcttgcatgtgccaaggcacaggtgcaccctgctgcaatgatcgaatacccaaatccctgaaagccatggagagaagcttttaaataatcaggtaccactgggggtcaggaaactgtgctgcttgacagtacacctgggggaagggaggatgagaagtactctcaacaattcattcccatgtctcctggtgtgtcgtgtcttctcttgggctcctaatgagtccatggcctcagtacctttgttttgggcccttgatgtagcttctcagccgctcagatggctcccacgctattggtggggcagcagagcctttggtgcctatctgacagatgcacaggtgcaccttgggatgcatggattatggctaccaaactgtcaacacacccattacaatcacattttcatctgctcgtgtggtgtacacctgtggcttgttagctggaaatctgat

SEQ ID NO: 74959 - DNA, 1050 bp, Homo sapiens
tcgaaattgatgggttctgagatctccgtcttgatcttgagcaccgaggcactgttgggggaggacagcagccgcgggggctccaccaggcccgcgtccaggccgcctgggctcgacgcgctggacaggcgccggcggctggcgctgccgcccttttgccgtttccgccttttcttgcgcttctggtgcttgctggaggcctgcgcgcccgcctcgcctgcgctgtccgagtccttggcgctgtcggacgtgagtgactcgcagttctgcagccgcaggtccgactcgctctccacgtagcgctccaccttgatctgcatcgcgcccagagcaccgaagccgtcctcgcccgccttggggttctcaaagtccgagtgctcgaagctgtcgtcgctgtcgcggctgtccgggttactggagctgtggccgtcgtcgttgcagttcatgtcgttgtcacacgcgttgcccgacttcttccggtcgggctccgggtcttcgctgttctcggactggttccccttctcgtcggacttggagttctcgttgtcctctgtgtggggcggggggccggcggtggcgggggcggagagagaagagagagaagacaccaggttagcggggcgacccagcctgtcacctgcaggggctggggcggggagcagggcaagtgtccgtcctcatcacgggcttctccatcaccttcagaggacttaagacctgggctttctctctgctgagggcctgggttagctggatggttactcaaagtgcgggccagcagcattggcaatcatctggacacccgctgcaaatgcagactctctgctcccacccaggtagactgaatcagattctgcgttggaatatgacccccaggtgattctcaggcacattcaagtttaagaagtcccacaaagatactcaggaagtcaggttaaataacctggattaaggtgtgacacagaaaaatgatggcatgcaaggtgactttctaaagagtctgcattttcccttggtgaatatttgttcattactgagagccactctcct

SEQ ID NO: 74960 - DNA, 1069 bp, Homo sapiens
ggtaagatttcagctcaacaccttctaaaaattaggacaattcgacagtgtgctagaaagaccctcagcgctagaattattaaggacatgcgatttctacaccagagagttcctcttagttgctaagattctctggatcactattgtgattatatagctcaatgctcatacgtgaggatacactattaagtggtgctttcttgtgaatctatttgcttagctatccataggacacaatgtcatagttaactgagtcagttaccaactgtttgggttgtttcctcctcctcctctgtttgctttacctaatctgttgctgtatacagagtagatcgtattatggacacacccacccacctccaacatttatggatggccaactctgtgtcagccatatggactactcaagaaaggaagaatgaatgaacttgctgctttatccattttgacaatcttttcttgatacaagctcaagctatcctgtcaaaccacatggacatttccagtggaatctctgcctcttgacaagtcatgtttcatttgttcacatcttcatccatcagtattcagcagatctttaccaagccaacactactgtaaatcattgagctaggcactatggaaggatatgaagatgaataagcaatgatttatgcctgtggggaacttaccaaatcagccctctttcttcataatggtttcctaggagacacagaaagcagaaggcagccaacggtactcatttaccttagtgtcccagagagtttaagcctgctagttgacatacatctttgggaattatgctcaagaattaggtttgcctttttttcccactacatgatatggaatgttggcaaagatattcttccttctctcccaaatctttgaccctttctactttttgaacctggataataatcttggcttgaacagactgtcttctgggcttgagatatattatcgcctctcttaaatataatacatagggcaagttgattttcaaattactttaaacgttctcaatgttaaatagactttgtctaggagtaggagaaggacgggtaagaat

SEQ ID NO: 74961 - DNA, 1034 bp, Homo sapiens
ttacatcctgtttctgacacttccgctataaatctgagaactccttcagtgcaaggaagtgccacctccttactctctgctcctttttcttttttaaagtagttttaatagtatgcataaattatttttaaaggctgaaattaattttattttcccagaaaaattctttttaacatagacacattatctgggtcattccttgtggtatatcccgtgatttccaaacaggcagaggtggacagaagaatgaagacaactgtgcatgggacagtagctgggaatttagggattatgagttttaattccagatggaacatatactcagtgaatacatttggcctaggctctttgattttggtccataaaagggaataagggaggcccacttattttcagaaaattgaagaattttatcttgaaattctttcttgacttttgagtgggttttacacgtctgtatcaggagtcttggcacctctcacaccagttctgctcccataaaatggctgatatggtagttgctatctctaattctttccatttccttcatatggttggttttctctgccttagtttacttataagagggtagtccaccagtaatgtttgttatggatttattatatttattatgtgcctgtaccccagggttccacaaatattggagccaggtctctcctttccagcagagttgtgtgaagtagtctcagagggtatgtaaaatgcaatgaaaatgagaaatgtgttttcaggggttcaggttcttgctcccctttcatgcccatgagctgctttctctaagttgcttttcacccaagcccatgccagcattatgtgagggctatgtacacagaggaagatgggagacctactttcacaaaaattggtgaaaagactgaggctggttgactggaggcttaagatgagatagtaatttgacctggctgctaagatgtgactgcaattgcaggcagttttacctaggagctcagagtcttgaggaagagataggatggaacttctgtgccacgcaa

SEQ ID NO: 74962 - DNA, 1124 bp, Homo sapiens
gatgattaatactaaattctcaagctgcttcttgccatggttttttcccttgttaccaaccttcttgaagtaatggaatattacagtcagtcttcatgttctcatgagccgctttttccatcgtcttttggcttcaaccattacccacttatacaaactactttctcaaagatctataatgacctctggttgtcaaatttaagtgcctatgttttctgggtgtctgcagtggttgacattgaacacacacttctttcttgataccatttctctcctgatcagcctgacatagctgatgtgcctactttcattcattcttctctaaactcttggtcttcccatgccatctgggaacagcccaggcctcctcatcttacatggtgcatgcacagatcacatctctgcagccttccccgtgcattgcatttccactcacctcctcctctgaactcccccgtgtgtacatttttaatgctatttatcacattttactttatactaatcgtcatagctgggtccttcttcccccgtgactgtaagttccttgatacgggcagatatggtgactgatacagttttgaaatccccatgccgcctggcacaccacagagcctcaattagtttacccactttcaaacatgggtttttgagaaggaaaggcaagagtggtgtgagacgaggctggagaggtagcacagggccagataaagatgacaagtttaggagtctttgaggattctggattttacccaaagaactatattagcgcaggattttaaatgtgggatatgacatgggtaaaaccaacatttagaaatatttctctgctggaatggagaggggcaggcaaaagatggtggtagcttagattgatggtgggggacagtgggaagaaaaaaaggaaaagatctgaagaaaaatctagtagacagagtggacaggaatcacaattgatttgatgtgaggaataaaataaatgaaaatattaagagcgtttgccaaatttgacttaaatacctggctgcatggggatgcaaatttcacagtgagagactgctgaagagctgggttcactgtgtgtgcagcaggaggaggtgcaggaagtgaggaggtaatttagtttg

SEQ ID NO: 74963 - DNA, 1624 bp, Homo sapiens
tctgatatgtgagtgaggctacacttcatacaacttatgctcagcattagcccaagaggtgccaatgctggatgtaaacccaaagttcctccacagtctgtgaggcatatgggaaagatcccattgcaaagtcaagagagaatcctttggcagagctctattaggaggcttatataagatgggaagtgtttactggaggctttttggtgacatttgtgacataaaactcatcagagctgactccataccctctttattctcctttctgtccccaacccagggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagcca

SEQ ID NO: 74964 - DNA, 2035 bp, Homo sapiens
atttcccacacagtcctctccctcggggtggtatgtctcattgatggctgcttgccatggcttactatggtttgtgaatgccaaaggctttgtggcttatttttgtattatagaacttatagatagatggagatatgaagcctggttccatgcttacagacattcatctggactctgtatgctttccgaaagttaagaatgatttaggagtctgggaagtcagataacttttcaagcttatttggcttttgaaccttctgcatctcaatttcctgttcattaggcaaatactggctgtcataaagcaataatatttatccagagtcagaaaaacgaaacttgggaaaccattgaatcagtgaaaaggcctatctcttctccctgtttggtaacatgactggaatacatccattaagtctcctttaaaatcttgagaggtgctgatagagacaagagaataaagttatcagactggtaataataaattgcaaggtctggaatcatttaacaaatatttgagttcctgctagtgtcaggcgttgtattatgaagaaacattgatgtgtgaggcctgaactttactctgaatatggttattctagtaggatgaaataggttgacatgtaaaaaaaataattcaaggaagagagtggtgtatgtcataaaaggtgcagattaggtggtctgagagttcagtaaaaagagcatgtaacttccaactaatgaggtcagataggagctaagggagttcagaagagctgtaaattctaattgaaggggaagttacatgtgatgattttcttagaaagttgttaatggttagatggaaccatgtgagatcactgggcatttttttttaagtcaaaaacactcaaatattggcaaatcggtatgattcaatctaatagtactctattttacgtccatgggctttatgactgtggggggtgggagtgctttttttggtttaaggtgaataaggagatatctctagctaagtttgatataaaatttggtacgaagtggctgggcgtggtggctcatgcctataatcccagcacttcaggaggccctagtgggcggatcacctgaggtcgggagttcgagaccagcctgaccaacatggggaaaccccgtctctactaaaaatacaaaattaactgggcatggtggtgcatgcctctaatcccagctactcgggaggctgaggcaagagaatcacttgaaccagggaggtggaagtggcagtgaaacgagatcgtgccattgcactccagcctgggcaacaagagtgaaactccatctcaaattggtacaaactatgaggttgaagtaaaaatctggggtaccatgcatttggagtggtggttagcagatggcatgtttctaaatggagctgaaatatggttgttgataaactacatgagaggtaagaaataatcccccttctttgtgtctttcagctacatggtgggatcctgcggatatttccagaggggaaatcattcatagcagatgtggagcccatttttgacagactcctgttcttctggtcagatcgtaggaacccacacgaagtgcagccctcttacgcaaccaggtaatagccggagccatgattcctcttccggagcttggtgtacaaaccctagttccagagaactctttaaacgtgtgtcctgtgcatgtgggggattgaccacaccccatagctgatagcaaacttgtttggagtctacaaaaattaaaggggaaactttgcgttctttagcatatcaaacctaacctcagtttgaaagtactattaacaagttgttttctattagatgagcatattggattccaatttctcaaaagtatttttctcttctctcctttcctcccttctcttatctctctttccctttttttaaaaaacctaatgttgaactatgcctagagaatgttggctgtcacatatcaggaattctgtctggttactttggatgagtttacaagctgctaattgcaagcagagaaagagccttgagaagag

SEQ ID NO: 74965 - DNA, 1073 bp, Homo sapiens
ccataaatcacttgccgttggttcttgttcttcctgtaatccattttatgtacttttgctagagtgtagtagtcccaattccaattctaatcatgtagtctctgtgcttaaaacaaaataatccaaaaatccaaccatgctccttcttcattatctactatacaacactgtaaagactgtaaacttagccagctttgacagccctctacatctgaccacatctgacctttctacacttaatttcccaccactgccttcctttcctcccagtccctgaaatgctagaaactaatttgccaggcataatgagcttccccattgtcttccactcatcaaaaatccatctctaccgccttctagtgcctgttccctgaagtcttcccttctgctccccagaactctgtcgtggctcaatccaggctgcccagtacatggatttattgggctgtttatgctgtccaccgtgtgcttagaaattccttgaatgcagagactgttaagctttgtatatacttttagtgcctagaacagtcccttatacttcataggtgcttgttggcttaatttcatcttcaaaaggaactttgattttgatggatatttgaatgttaaaaaaaaagctagaattttttttgggggggatagaggggaatgacgggggaagatgggtggctgcagcttagtctctaattcgatgcctaagtatttaaatattttattagagtgacatgttatgtgagaccatctcaatggaggaccttagctttgtaagttttttttttttctcagtttcgaaatcctaggtttcaccctagaaatacccgagtcacacctggatcctggcagctcatacctacaggtctggctcagagacgccagggccacgaggcttagggccccaggttctggtcctagctcagcccctggcaagtttcatggtcctccatttccacttctttatggatgagttagatacttgttttcatttttgaacttaaatttggtcagcacctaccacttgacactaggatggacacttcagattttatttcatcttcctatgatcttgggca

SEQ ID NO: 74966 - DNA, 1047 bp, Homo sapiens
tgtttcttgtaaatttaggtgttaggagtttttcttcatcattctaggagcagaatttgctctgagggaggtcaggattaattggtatggaaagaggccactaacattgaaagttaaatatttttatttagctttgacttaatggatagggatagggtttcagactagaatttaactcaaatggaaggaaaaacactgtgtaagttagggtaagggaaagaaagatcctgtagatatgattcatcaattttaggttatcttttgggtggaatgaaaaactttccaggtgaccctgtcagaaggtgatcgtgaattgaaaataaaatttatcctgtcccacccccagatttccaggtttactttggctggtttgtcacaaagctccctgccctttagataaatcacctttcgattggaatattccctggccaattagaaccaaatgcaaaccaggcttgagcaaacaactagtgtagttaaattttttttaagtgtgctttgcttgtatacagaagtctccttagtgatgtcttgtggtcttgggtttcttgtttgaagttcattattaaagtcatggtagaaacactttccatttctacatgatttttattggtttcacattaatttatccttctttttcttcactcactttttatccctcagctgagctcctcattttgtgctgctttccagagcagtgatagagacccagtttaccggttcatccttcacccgtgttttcaagaaaaactaaagttttaaatttatttattattattatttttttgagatggagtcttgctctgtcgccaggctgtagcggctcactgcaatctctgcctcctgggttcaagtgattctcctgcctcagcctgctgcatagctgggaccacaggcacgccaccctgcccagctaatttttgtatttttagtagagacggggtttcaccatgttggccgggctggtctcgatctcttgacctcatgatccacccgcctcggcctcccaaagttctgggattacaggcttgagccactgtgcccggc

SEQ ID NO: 74967 - DNA, 1053 bp, Homo sapiens
gcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggtaggacgcgctcggcgccctgccgcagctgctcccgcggggacgggaggcactcggagtccgttgtatgtcgacttcccagggccgtaagcgaactttgttttttaaccaagaagtcagcctggtttgtctctactcgctgcttccccccacccctcgccccagctcctctgagcgaaagtcaacgttaaggggctcaggtgaaccatgatgatgaccttctgttgactttgaaatattggctcttgtgggtgacaaaagccagacaagctgtggctgtggtccgattttaagacgaggttctcaaagatccaaaggagggaaagggtattggaaacactgtgtatcatctgagacacacgtgtcctcatgatcttaaatgcctactttaaagccacctaatactgcccttcattgtggtcagaagagatttctacaaaagcactcagaattctggaggcagttgtgattttgccatgtggcagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaattgatggcaaagtccactcaaaacaaccagttaagtgctcac

SEQ ID NO: 74968 - DNA, 1050 bp, Homo sapiens
tcgtaacttttctatctagaacctagctctcagtttatcagttctagtgctaacgtggcctgttttagcggtgtctcccattctgtgttctctggaaagacaagttaaaggggagagtttgtattaacaggtgtcacgtcttctcactctcgccatatccctgtaccttctggtagatgtaaacggacacaactgtgcttataaaaccaataactcgccagtcttcctcaggtccattcaagaccatttgagtgggtccttgggtgccatggacagaaatcttgtggggacatggatgaggggggcctccagcccctgaggactgtcaagaccagggccttggggaagggcagccgagcttcacattgtccccacttagccacttgtcagggttgctgtgaggctccagatgaaaatacatggagtttccttaactaccgtggcccacagaaatgacacatgagattcttttccttggtcgtaggatactgggggcggggtcagtgagaggcactgtccatctcagaaaaatctgtatcactcttgtttgctcatcttgaggaagccatggagagcacagtttctatggagtcagcagaaacaaaaatgagattaattcacacgtaaattctgcctttagatacagagacctaggttataggatcttgactgtatacacagttaagccatttgtagagttttccctatttgggggtagtttttgttctgattttttttttcagaggggatgtttgccaaattctttctagattataaaattaatacaaactctcataaaagtgaatacactaaaatataaagaagaaaaaaaaaatcccgtaatacaacattcatacaccaataaaatgttagcatttgaggtatatttctttcgaagtatttcattttgttttattttattttatttttgagacagggtcttgctttgttgcccaggctggaatgcagtggtgtgattacagctcactgtagccttgacctcctgggctcaagtcatcctctcacctcagcctccagagtagctgggac

SEQ ID NO: 74969 - DNA, 1157 bp, Homo sapiens
tttccattttttcctattatgaactatgctaaaatagacatcactcatactcaggaccaccacactgcacagttccagaaagctccattcacttctacgaacgtgtcttctggagttgtacagcatacagcctgctctgctgtgcttggcagcccctgcctgtatctcctccatttattctattaacaagatttattcggtgcctactgaattccagtgctctgcttgtattaatgtatttagacctctgaaatgtcctaaaaagtaagtcgttttcaccatttttattttccaaaacaagaaggtgaggacagatgggggtactcacttggctaagatcacacggtctgtaaattgcagagccagcatcagaacctgcacagcctggttcccaagtctgggtgctgaaccgtcatactaagtcttcctcatgtttcactgtctacttagttaatatctcccactcatctgtaaccctgagagcagggaccacggggagccacttattttgcgtcactggtgcccaaatagtgcctgatctccatgacaggctcaataacgttctgtcagtcactttactcatgactgcaagctcctttcctaatcaacgtttcctctcccccttccccatgtatctctttcccttcataagcacccacctcgtctccctctccacgacattccaacccctgagcaaggctttgaaaaagtgacataggcacatcacagatgtgccgttggctctaatttgtgaaagaacattttaccgaggggcaaaggaggacttggaattttttcctgcccccaggaggcccagacttgcaaccctgtaggtctagaacttaagcggaggtcctgctatgttcacacatttagtagagaatgacttctaattccgtcattcagctgtcaggcacgtaggccgcttccttttataaagctggttgtcgtaactaaacaggtgcagatttgaggaaatgcagaccgactggaatgataagtcccactgcatgtgagattaggtggatagaggactcgagtcccacccgccctttactgtctttagtctccccagtccgccctgggcaccacccgccgaggctgggctctcgcagctacctctccatctatcttcatgacagctgcgggggccgggg

SEQ ID NO: 74970 - DNA, 1019 bp, Homo sapiens
ttgatttcacattggcaattgcgatagtactttgaggactggcccagaaagcattttcatcccctggcaaaactcttccccatcagcttcccaaccatgtgtacaaaggaaatgcaaatacatgtgaatagtagcctgagtcaaagtcttcttggaaggtaaggctgcttgcgactgctgctgctttgaaaaagaaaaatcctacaatgcaagtgaaaggacagattttctgagccactgcttctgcaccagggtgagggttcagaaggacgaaatacaggtaccatggttctctgaagagatggtcttgtgtggagcacacctggcatgaaaggatggggacagcttctaccctctccccagcagggcccgacaagcaggctgtgtggcattcctgtatttccagggctggcacagtggctgacacacagtagctgcctgtaaatgtttgttgaatgagtgaataaatgactaggaagggagctggagtgggtgtgacactgtctgggctggctggagctttcaccaggttgagggatgacagggaaaggggtaggtgggtgtgggagggtaatttcccagtgaggagagattctgtgtttcatctgggttgcctgtctgaggccttttctgtgggcaacgaaggccctaagacagagtgtgtggactctgccctaatgatagtcaaaccgcccaatggtcccattcattcacgtatttgtctactaattgacagctattgagtacctaatgggaaccgtggccttcatccctcatccctacgcaggcgaccccagactgtcttagccaccttcgtgagctggggatgggaatgccggaggaagtgagcacatggctaatactgggcaggggctttggctgtctggaaatgcagccagcagggagctggactgaggcaccggttgctggcaattgggccatttgtctctctggacaagtgcaagcaataagtgtgtatgtgctctgtgtgtgtgagactatgcaggtgtgagtgtggg

SEQ ID NO: 74971 - DNA, 1035 bp, Homo sapiens
accatgattttgattgtcattccccttcacctcagcaagaatctatcagataaagcaaaggattgccccattttctatatctcccatgcaagacattggttaacaccgctggatgtcttcctcacctcccttcccatagctattgcttagtcagtcattccgtggggtgaatgagcaacacctgtctgatggcatagataattagggcagtttggactgacagccctcaggcaatttctgcaaaaacagggactagcctcaattattcaaactgaaccaggaaccctaaggcttaccagcttgccaggaggccaagttggaggaactgtcaaactatgccctctgaatgatgtatgtcccacttagggagaccaacaacactttctttccaggggcactctgtgtgccctcaggtctttatttcctgtgtggaatccaggagttattttgtctcccctaaaaacaccttaggggtaatcataagatccctttaagtgtttaaggaagcatcactgacagatcatgtggccctcagatgaccacagagatctctccaaaatgagacttttcttaggtaatggagagatctctgcagtaagacaacagattcttaggctgggcgtggtggctcatgcctgtaatctcagcactttgggaggccgaggtgggcagatcacttgaggtcaggagtttgagaccagactggccaacatggtgaaaccccatctctactaaaaatacaaaaaccagctggccatggtggcgtgcgcctgtaatcccaactactcgggaggctgaggcaggagaattacttgaacctgggaggtgtaggttgcattgtgcggagatggttccactgaacttcagcctgggtgacagagtgagactcggtctcaaaaaaaaagaaaaaaaaagaatcaaacagattcgttatttatgtatactttgctggcagttatccctataacagtagtcatccaattagaaaagtgaagtggtaaaaatttcgctgaagttttcagtgacatgcctgga

SEQ ID NO: 74972 - DNA, 1273 bp, Homo sapiens
taggactttttttttttaagttgctgataatggtctttttatgggccaaaaaaaaaaaaaatctttatttctttcctagcttgctggaaacttagcttatgtttaggagattcctcttaaagaaagagaaaacaacatacagattctatatatggcttcacatctacttgcttttatgtccatggaacccataaaatatttatgttatgcccaggttatgaataacctctgattgttcattcagcccttgaacaaacatttatcttcagcacctgcacagtatcctgtcacattatttgctcaattctgggatggttcatgaagcaactgctttaccaagcaatgtactatggctggaagcaaaggctcagtaggggtgctctgtcaaacacttaaaagtcagtgtttagagacaagttataaacacaaaacagaacagcccattttttagtttttgaggttgtattctattcttgttctctattgcttgagtcatggaaccccctctagaatatagacctgattaatttgtatacagctactggcacttatgcaaacaacaagaagagttcggtaaatagaaagattactccattactttgtatattaccttccaatatatgtgtattgcataaaacggattaatttttacattttttctttgtgtacatgtgaaacagaagattgctttatggacgattgacaggtggtactgaaacgtcctcttcaaacaagtgggatcctaaaatgttaatgaaagaaaggacctcattttatgaagaaactcaggtccagagaggttgtgtcatcccaggattacactgtaaattaataacaaattagtagcaggatgaacttgggcaaacatagacagtcatgatgttaaatgctcaaaccctcaaagaacagttttaatgaggattacattgccttctcttgcagaataggttcgattctgaattctcacaaccctgaaagataggtgatgtgtgtccacattttattgataaggagactagtgttagagagcttttgacacaaacagggatggcagagttatgactcaaacctgggtctcctacagtgctgtactgtttctcctacccatttcttaaaactcacagtgtgtcaagggtactttaaattttgagaggcttgttacagaatgagatggattgagaaatctataccagatagcaaattatagccggtatactctgttatgtatatgtttagctttgtgagagcactttgaagtgtgacaataaaacca

SEQ ID NO: 74973 - DNA, 1319 bp, Homo sapiens
ggctgaggcaggagaatggcgtgaacccaggagacggagcttgcagtgagccgagatcgcgccactgcactccagcctgggcgacagagcgagactccatctcaaaaaaaaaaaaaaagttactttcaaaaagcagaaggaaagaggatacatttcttccttacactgttacatactaaaatgtttcttctgcctggtgcagtggcttgtgcctgtaatcccagctaccagggaggctgaggcaggaggatcacttgaggctaagagttcaaggctgcagtgagctgtgttcacaagttttaattattcttaaaacaactgtttaaaatttctttaaacttgctgttttgttcctgtgtcttgtctttggttggtatttcagtaagtttttggtattctcaaattttatctaaatggataaactattaacatagaacataaaccccaattctccatttcatttttctcttaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaattgtctgtattgtttttgctaagatgtatctttattcacccccaccccacatgatgaatgacagtatttagtaactgttacaattgcgtggaataggctggtagctttggctcctgcctgtaatcccagcactttgggaggtcaaggcgggtggatcaggagttcaggagtttaggagtttgagaccagcctgaccaa

SEQ ID NO: 74974 - DNA, 1005 bp, Homo sapiens
actccaccactgtgagggaagagcatctttatagattatttagaattctgtgtggggatttgtctgttctcctccatttatttatttattcagtacatttatattagcgtggattcgtgggtatttatactttgggttgtaatccagtcctactttattttgttgctcagtttcagctttggcagttggtgacttgttcagttggctcctgtttccctttgtcataaccacctcactgttttgtttttgttttcttgattacttccttcttttctggcactaaaagatgctccaggttcatcttgtgttccttattcctagaattagccatttctctgaatagtactggttctttttattggaaaatgacactagaaaccaagatctggttttaatatgtttttctccccactttcttcttctgttctagttaccatggtttgggaccacagagatcacgtcaacaacagcctgttccaaatagtgatgctgtcttgaattgtcctgcctgcatgaccacactttgccttgattgccaaaggtaatggatgaaggacacacacacacacacacacacacatacatattttgtttaaattagaaacagacttttttttttttgaagtcagagtcttactctgttgcccaggctggagtgcagtggcacaatctcgcctcactgcaacctccgccccgtgggttcaagcgagtctcctgcctcagcctcccaggtagctgggattacaagcggccaccaccatgcctggctagtttttgtgtgtatctagatctagatctagatctagatagatagatagatagatagatatagttttgttttgttttgttgagatgaagtctcactctgtcgtacaagctggagtatagtggtgcaatcttggctcgctgcaacctctgctgcccaggttcaagtgattcttctgcctcagcctccaagtggctgggattacaggtgcctgccaccacacccggctaatttttgta

SEQ ID NO: 74975 - DNA, 1152 bp, Homo sapiens
agggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtagagggaaagaggtctgctgtaaagaacaacacttgtttgtctgtggggaaagaaaagcagaatacttgagatgaaagttggcatacaaataggata

SEQ ID NO: 74976 - DNA, 1250 bp, Homo sapiens
gaatgcaatggcgtgatcttggctcaccgcaacctctgaattttttttttttttttaagacggattctcgctctgtcaccaggctggagtgcagtggcgcgatctcagctcactgcaacctccacctcgcagattcaagcaattctcctgcctcagtctcccgagtagctgagactacaggtgcacgccaccacgcctggctaatttttgtagttttagtagagatggggtttcaccacgttagccaggatggtctcgatctcttgacctcgtgatccacccgcctcggcctcccaaagttattctaatatttaaagatttttgtagagacggggcctcactatgttgcccaggcaggtctcaaactcctggcctcaaagtgatccccctatttcagcctgctaaagtggattacaagcgtgagccactgcactcagcctgttttttttttttttttaacgaatgaggcaatttattaacccagcatggtttgttctaatgcttcttgttggcaactgccacctgtccagcgattctgtccagatctctctgtccctgacgtgtcagtttgcggcccccatcttggtccttttccaccatttttagcccctccagggcttggaggacccggtgggccacattcttggagcctcggctaaagtggccaggcatgccgccacttctctgacatcccccatagatcttggtcatggagccaaccccagcgccaccccagaggtacaggtgccacgctgtggaagcagctcgcgtgtacaaccagttctcatcgtagggagcaagctctttgtgcttggccagcagcttgacggtgtccacccattcggggactttcagcttcccagactttctgaggaaggctgccagagctctgatgaactcctgctggttcacatcttttacagtaactccaggcatcatgcggcccggcctgtgcactgccagccaggggaaagggctcagtccgtttttttaagtaacagcttgatagtccatgtaccacataactcacaatttaaaatatgtaattcaatggtttttagcaagctcacagaactgaggatcaccataatcgattttagaacactttcatcacccaaaaagaaaccccatgcccattaacagccacttgccatttccccatgtgtgcccatatccctagacgactgctaatttgctgcctactacagatttgcctattctggacatgttttttttttttgttttttgtt

SEQ ID NO: 74977 - DNA, 1088 bp, Homo sapiens
tccccatctctactaaaagtacaaaaattagccaggcttggtggcacacgcctgtagtcccagctactcaggaggctgaggcaggagaatcacttgaaccgggaggtggaggttgtagtgagccgagttcacaccaccgcactccagcctaagcaacagagtgagactccatctcaaaacaaaaaacaaaaaaaaaaaacatgtccagaataggcaaatctgtagtaggcagcaaattagcagtcgtctagggatatgggcacacatggggaaatggcaagtggctgttaatgggcatggggtttctttttgggtgatgaaagtgttctaaaatcgattatggtgatcctcagttctgtgagcttgctaaaaaccattgaattacatattttaaattgtgagttatgtggtacatggactatcaagctgttacttaaaaaaacggactgagccctttcccctggctggcagtgcacaggccgggccgcatgatgcctggagttactgtaaaagatgtgaaccagcaggagttcatcagagctctggcagccttcctcagaaagtctgggaagctgaaagtccccgaatgggtggacaccgtcaagctgctggccaagcacaaagagcttgctccctacgatgagaactggttgtacacgcgagctgcttccacagcgtggcacctgtacctctggggtggcgctggggttggctccatgaccaagatctatgggggatgtcagagaagtggcggcatgcctggccactttagccgaggctccaagaatgtggcccaccgggtcctccaagccctggaggggctaaaaatggtggaaaaggaccaagatgggggccgcaaactgacacgtcagggacagagagatctggacagaatcgctggacaggtggcagttgccaacaagaagcattagaacaaaccatgctgggttaataaattgcctcattcgttaaaaaaaaaaaaaaaacaggctgagtgcagtggctcacgcttgtaatccactttagcaggctgaaatagggggatcactttgaggccaggagtttgagacctgcctgggcaacatagt

SEQ ID NO: 74978 - DNA, 1074 bp, Homo sapiens
aaaaaaaaagaaaagaaattagctgggtgtggtggtgtgcacctgtagtcccagctattgggacgctgaggcaggagaatcgcttgaacccgggaggcagaggttgcagtgaaccaagatcacgccactgcactccagcctaggtgacagagtgagactccatctcaaaaaaaaaaaaagagtacagcacgtgaacttggacctatatggggagcactaagccttcagttgcaaagtcatagaagatttcttacttgatagatagaaatgcatgtctattaaagtcttgttggtgaaattagtataataacatctgactgaggataggtatgctattttactgatgatcttttatatttataatgatagttatttacatataaaactaaagcaaataagtgaaaaaagtttatattttcttttgatcttataggatgtagatgatttctttgagcacgaacgaacatttcttttggagtatcataaccgagttaaggatgcatctgctaaatctgatagaatgacaagatcccacaaaagtaagatttttctgtggctaaagcttatatcttttaatggaataattataaagttcatattatagtttgaaaaagtcttaatatagagcagtagttctcaaactggtctgttggagcctaggctccatggcccttttatagtgagcctgtgaggtcaaaactattttcagctgggcacagtggctcacgcctgtgatcacgacacttttggaggctgaagcgggaatatcacttgagcccaggaattcaagaccagcctgagcaacagagtaagatcctgtttgtattgcaccagcctgatataaaaaataaaattagccagacgtggtgccgcatggctgtggtcccagctactaggaaagctaaggtgggaggatgccttgggcctgggaggttgaggctgcagtgagctgtgatggatcgtaccaccatacttcagtctgggtgacagagtgagactgtctagacagcaacaaaacaacaactatttttataatgatactgtgatagtttttgcctttttcaccatgttgac

SEQ ID NO: 74979 - DNA, 1144 bp, Homo sapiens
gcattttggattttaattttttttttttggagtatttgcattatacttactggttgagcatccctaatctgaaatctgaaatgttctgatgaatatttcctttgagcatcatgtctttatttaaaaaatttcagattttggagtactttggatttcagattttcgggtagggatactcaacccatatttcgtttttagtgtatttgctgaaaacacagaatctttccccttttgttaaacatttggagtaattttggatttgctggatatgtttctctattttgagagttgtacaaggaaataattttccttagttatcacctctgtcactttttctggtcatttctccccttcatgcatttcctcttctcttcttccactagttttagtttttagttatatattcacactgctactatacttctcttcaggatgctaaactcttgaaaagataaatcagcaaagcaggtcttagttgcaagcagcggtctgatagcagacagatatatattcaaagtttataagactgaaaattggaaatgagcagagcacattaatatcgaagaatctgtgattttccagtggccctgatcatgattcttttgtggtctggttaggggttggataacagagaaccttgggtttattctactgctacctccatcctctgcatccttcttttttgtcttcactgaatgactaccctcacagagatcaaacttctcccatcattggtcctgctggtttgctggtatgtaaaacttatccttcttgcacgtagttgaagcaagaatatcaagccttttccttgaatgtttttttttttttttcccccaaactgacatgtattactttgtggtctctgggattcactgctggtattaaaatattttaaacacatttctttggtgtaatggcaaaaaaaattagtttcttcatagtgtgtttcttgtgtgtttgggtaattagatgaaaataattattaacgttgaaaatatgctcaccgaggtttgggttttaattttttttgtactaagttgtttaaaagcagtcattggatattgaatcattaagattctatcaaataatttgtagcacacttcctgtagagctgagaacaagcagccctatagttaactttaac

SEQ ID NO: 74980 - DNA, 2805 bp, Homo sapiens
cccaaagtgctgggattacaggcgtgagccaccgcgcctggccaacaatttttttttaaacttaggcaagcttggtggtatatacctgtagtcctagctatttgagaggctgagagcttgagaacaatgagctatggcttgagagagccagggtgacagagtgaggtcctgtctctaaaaaaatttttaaaattgtatttcgggttttaaaatagcggaaactagcagagttacttaatgaagtatgaggagttgattatagcacaattaaactaattattctaaatataaagcatatgacctttagataactttatgtcctatttttggtgtctactagcacaagcaaacaggatttgctttcttggaggatcttaataatgttcagtaaaaatactaatttttgagtatgttgatgttgtgaaaagtattttttggtgaatatttgtgttcatggctttatgccttcagaaagatttgctcatgaaactggaagcccttaagtaatttgtccagaaactttctctttttttttttttgaaatggagtctcgctctgttgcccaggctggagtgcagtggcgtgatctcagctcgctgcaagctctgcctcctgggttcatgctatgccattctcctgccttagcctcctgagtagctgggactacaggagtgcgcgaccgtgcccggctaattttttgcatttttttttttttttagtagaggcggggtttcaccttgttagccaggatggtctagatctcctgacgttgtgatctgcctgcctcggcctcccaaagtgctggaattacaggcgtgagccaccgtgcctggccccagagactttttcatgtattacaaaattaaagggagaggaagacaaaagagcactcctgactgtgatgttcttatagaatcctgtagatgaaaattttaatatggaaatggaaaaaaacctgaattagaatgcttttagaacatcaggatggatatatacacttacccagttcttccttatttttgtcccgtggaactgggtgaatcataataattataaaattataggtgggcacagcataatcattgtttcattatatttatatttcattatatttcatcatccctctaaagcctttagtatccccctttttctaatgagaaatccgaacttcagagaaactaagttagtagtctgaggtcacacagcaacaaatgggagagctggactttaaaacacatttctgatatcagagccactgcacaggtttctcaaagtggccttgaaatacttgcattagaattacctggtgcatttgaaaatcaaaatgaaagtttctgggtgtcacctcctcactaaatcagaatctcttagggtagggaatacacagtattgaaaactgttggtcacactttgatctcttcagccccacctctacatatgggcagataactgcattttttttttaaattttttttgagacagggtctcgctctgttgcccacgctggggtgcagtggcaatcttggctcactgcaacctccacctcccgggttaaggtgattctcctgtctcagcctcctgagtagctgggattataggtgcccgccaccaggcctggctaatttttttgtatttttagtagagacagggttacaccatgttggccaggctggtctcaaactcctgaccacaggggatctgcccgcctcggcctcccaaagtgctgggattacaggtgtgagccaccgcgcccggccgataactgcttttttgaccagcacccaaggagtttctgtttgtgcactgaaatttgattactgctgcagaaagttatcctgctatttcctcattttaggaatagaaatatctggcctgtttaaatttccttacattgtgtttgtcctgatagaaatagattaccataattagaacttttaggcattgcatttttagtttagatcatcttgttgagccttttaagaaagggagtcttggctggtcacagtggctcactcctataatcccaacactttgggaggcagaggtgggtggatcacgaggtcgggagttcgagaccagcctgaccaacatagtgaaaccctgtccctgctaaaaatacagaaaattagctgggcatggtggcgggcacctgtaatcccacctactcgggaggctgaggcgggagaatcactggaacccaggaggcggaggttgcagtgagctgagagcgtgccattgcactccagcctgggcaacagtgcgagactctgtctcgaaaagaaaggggaattttgacagaaaaagcatgaagtacatattgatacaagttgcaaaggggacagcacattcaaaaataataactagcatttcatgtaaagcagcaagtaagcaaaaaaaatttttttttttttcctagacggagtcttgctctgtcgctaggctggagtgcagtggtgcgaccttgactcactgcaacctctggctcccaagttcaagctattctcctgcctcagcctcctgagtagctgggactacaggtgcacgccaccacgcccagctaatttttgtatttttagtagagacgaggtttcaccatgttggccaggatggtcttgatctcttgacttcatgatccaccctcctcagcctcccaaagtgctgggattacaggtgtgagccacagcgtccagctacaagtaagcaaaattaaagtcagtgttttaaaataaatctttaagcagctgtacattttcatcatgatatttcgattagaacagaatcttagtgccctaagaaaacattgtt

SEQ ID NO: 74981 - DNA, 1552 bp, Homo sapiens
tattaattgtgattaattatcgtgtggcataatacaaagaccagatgatgtattatggcttccggagggcgcctgcatcgtttttcgctggagccctcggggcaggggaactggagagctccctgggtggcctttggcccttccctggtcagagcccgccagctgcgaggtgcccccagccatgaggtctgggtcttcaggctctcccgacttcggtgccttgaccttgggcagaaggccctgttaaccttcctcgctcacggactcgagcgaccagcgccggggacggggcgggccgtccttaggccccgccccttcgcctccgccccgccccgccccgctcctggccgccggctccctccggcagcagggagatgcgcgcctgcgccggccctcgcctcggagcagccatgatggtgggtgttctccgcggcgccgagtcccgggagcgcggtgggggcagcgggcgcggggcgggcgcggggaccgcgccagcctgtcactaatgtctccctttgtgtctcccccatctcatccttttccccggcgcgccgtgcccgccgaccccacaggaaggcctggacgacggcccggacttcctctcagaagaggaccgcggagtaagttctgccttcctttcgctcgcgggaccctggaccctccttccccatcctgggtccccgggtgtggtacggggatgggtccccagccgcgcggcactccctccccgtagtcctcctttcggtttcctcgctgcaccgcgccccaccctcccgcagcccttcctccctaggggccgctcggctccgattcccggggacccgcggccgctttcttgtcccccgccgctgttcgggccttctggtggacctccactcccacgcggggcggggtgcaggtggcgaagtggaaatggaggcgggagatggaacgcccccaccctccctcgacactttggggccatgaaaacccattctcggaccttcccagcggcaccctcaattttcacccggtgtggacatctcgaacttgctcccgcccacccttctgtctctctcaaatagtacaggtgtagtctacattaccattttgcaaggatttttatagtagccgaatcaactcctgtccagtgccctactagattatgcaaagtgcaggtagcccatggtatctttactttttctaatatccaacaaatcctgtctttggcaggatttccttggtgttttattcccccttagcttctttgaggtatattgacaaatactgttgataattgtatatacttaaggtatacattatattttaatacacgaatacattgtgaaatgagtaccaaaatcaacctgacatatccatcacctcacctagttaccatttttttttgtgtgagaacatttgagatctaagcaaatttcaagtatgtaccctttgaccaacatcgacgctccacccactcaccccccacatacacactccgccaggcctttgataacctccattctgcccttggtgttctgaggttagttgcattctacttcagaaagagcct

SEQ ID NO: 74982 - DNA, 3568 bp, Homo sapiens
gtatttttgctgccactcctgaagctctgacatcacccagtgaaataggaaacatttcagggatgggacaacttgtatttgtccctttcgcttccacgtccaaacccctttaagaaggatgaatgggcaggatgagttagactccttcgctgtatcgtctactgattcttaaaatgtgacaaatctgattggacgacttacatggtacggtgcaatttttgatgtccagactaaagtgagtcttctctaggcaaacagtaattttggttaaaaccaaaatacgtgttctgaattactgttctgtgtttattttcaggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctggtgtgtaaaaacaaaagaaaaaagtacttttaaaatgcaaggattattattatcatagtcagtcttacctttgtttttcttataaatgggattcaataattttttttttttctgtagggctcctgaaagtgcacctttaaaaagcaagatgatttatgctagctctaaagatgccattaaaaagaaatttacaggtacaaacttgaatatttggggcagagaaattattctttattaattataataaagtaataggataatgttttttctttttaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgataatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgtaaagctgttgagatgtgtttacttatacttcagaacattaaaagtttaaaaactggtatttcagatcaaagaggcatcattatctttattctgtttttcaggattttagttggtaatactttctcatttatcaa

SEQ ID NO: 74983 - DNA, 1102 bp, Homo sapiens
aagagcttcctgcttctactatacaactacttagaaatgtaaatgtgaataaaaaaataactatgctaatttatccagagaacaaatcagatattgaaaagtatttatgccaaagtgcaaaaaataatttctgatcttcatattaacacataggaaataaatacactaatgtttataaaagtaccattctttaacaatggtattttatattagttggccttaagatagaatactttttaaaccaaatagatccaacaaatctggaaaatatcacacatgaatgctgtacaaaaaaaattctcaaatgaccagtgcagagattagtaatagctgtttttaccctagaagttgtttcacataacattttgcaaaatttccaaggaaaacaaggcaacgttctgtaatatgccacaatttttattgcaacgtggccatttttgtgagggtggggagtttgatctcaaaacaatgttccatttaaggctcttttatacagaaattgccatcatgactgatattcaaaatatctttagtgttgcaggactcacatggtaaacataaaactcctacacttattcagtagtgtacactcaatggaaaacaaaaaggcattaataacagctatttcttttaagaagatatgcaggtaacaggaatgaacactgaggtactaggataagttgatgacacagttaacaaaacttaattggcattccttttaggatattaaacttattacaaaaagtgcttttaatgcatagtgttatatccgtgctgccatatcactaaaataggcttgccaaggcaggtgaggtgtatgaatgctcaagcctcacagaactgcaatcaagtgccaactataaataatactgaaaaaagttgaccatctgaccagtggataatactttcaaggcattcaattagcttatcctttgcagtattctaagctattcacattgacgatcacatacattgtagtgcttgctgcaagggaggcatataaccagttgttttggctaaaatatgacaggaaggcattccttgggttctatataaaagtaacagtattcaacagtctaatggcaatcactgataggctgct

SEQ ID NO: 74984 - DNA, 1059 bp, Homo sapiens
tctagtttatttgcgtagaggtgtttatagtattctctgatggtagtttgtatttctgtgggatcagtggtgatatcccctttatcattttttattgcatctatttgattcttctctcttttcttctttattagtctggctagcagtctatctatgttgttgatcttttcaaaaaaccagctcctggattcattgatcttttgaacggtttttcatgtctctatctctttcagttctgctctgatcttagttatttcttgtcttctgttagcttttgaatttgtttgctcttgcttctcttctctagttctttttttttcaccagttgtcaaatgattctttactgaaatattttcctttgtgcttaactggctgggcattccacagcaccaatgttgatgtgatctatgatgtcatgagggtggcggccatcaacgttacagcccacagactgggcagtccccaggatctctttaatggttccagagagttctctggctaaggatcagtgccgcatctgtcaagcaatgttgacgatctcatcaaaagtgatattcccacggtgtttaatgtttttctatttctttctgtgtcttggtggttccttaagagctttgatgattagggcagaggcagaaggcaccacttcaatctgggcctgtctgttctgaatggtcagtttcactgtaatcctcaggcccttccagtcacccgttgccttggcaatgtcatcaccaaccttttttggagacagacccagggggccgatcttgggggccagggcagaagtggcaccgacttcacctccggtgcacctcaggtatacgactttgatttcgttggggtcgaactttggcggcatggtggaggcggctggtgcggaatgaccaaagaaagttgcaccttggcctcctccaagccgaaagccgagagctctctagttcttttaattgtgatgttagggtgtcgatttcagatctttcctgctttctcttgtgggcatttaatgctataaatttccctctaaacactgctttagatgtgtcccagagattctgg

SEQ ID NO: 74985 - DNA, 1056 bp, Homo sapiens
gagactcaggtacaacaaaaagttggttcctatggtctgtttttatcacgagcaaaagtccaaagctgattgtaaaaattagagaattccagattatttgaaaaaatgttattttatttgtacagttaaaaagttatacatagaaacttataatacagttctgtaaagctgaaagaactgtcaggaaaaagggagggtgttactttttttgattgatcattaaggaagttagaggaataaaaacacagtaaaaggtttaaaacattaaggaacatttttcaggtataaattttataaatacaaaacaaattcacaaattactctcaatactaaataaatatctagttaataaacttggacttaatacctgcagccagcactggtacagcacttcaaggttataagattggattcattcatgtgtagtgttgaaagaatgtactcaaacaattaattaagacataaacaccttttctaaactgtgctatagcggaagactcatccatgtagataactctcccttaataccaccactttaaaaaaaaatcatcaataacaaaataaatcgtgggtgaaaaaatattttccaagatctctggacacatgaatgatctcaaaaatgtacaaaaacctctgtaaaccagtactgtatccaatacatctatcaaacttattagatactgaacaaaactgtagcaaaggatatctttcctacattctcctgagtgcttaatattaaaattgagaatatagtgcaggccacactttcatgtggtcaatcaattgttattgctttatacagcatgatttaatgttccattttcatgaacaatttgtttttcttcaaatatatcctttagaaggacaaagtcagattcgtgactttttcgcagccggtggtgtgctaacttggtccacattactgggtgtgacgtggagtccaagcttttgagcctgaatatgaaaaaatgcttgaagcctagttccagcttttgcttcacttgtgttacgagggttgtattcaaagcagttcgaaaacattaactcaatgtcatc

SEQ ID NO: 74986 - DNA, 1028 bp, Homo sapiens
aataaacaccagagaatgataaattttttatgaaaacttaagtttattcccctgcataaaaatattttttccgatattttcatcagatgttgaaatgcgtaaggatattttcttcttccttgactagcccctgccttctctgctgagtctggttggtttgttggtttctttgttacctttttaaaatctgtaattcatggctgataatgtattctgttcatgcctttgccatcatctgtcacttttttgctgctatcaagtgaccaatcttagaactgtttatgatttatttatacagaaagtaaggcattatggttttcatctatgaagaatatgaattccagtttggccacttagtaaccttatttttagatacctttttgattcataatcatttctaaaatatccatgaattgattttatatgcatattgaacttcatacctctcagaaacaatatattccatttttcatggttagtaagtttgaattttgttacaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacaggtacaaaaagatttttctaaagtaaccattacttttccttgccattttaaggttttttttttttttttggtttttaagtaaatatgttgctttttcttattttaaaaacttgtcgtgaggaccttgatatttgtaaccattggactgatcattttctaaacctcaggatctctgttactccactttgtactaatgcaaccaaaaaacaattcattcgaataatgataatttcttaaagtttttttttttaatctttgaacttaaggttttattaattttggaaagtaattatactattattcttcttttctataggaaaacttagtaaattagtaaattctggtagacttgaatgttatttgagccaggcaag

SEQ ID NO: 74987 - DNA, 1071 bp, Homo sapiens
tgaccttaattacctccttaaaggttctgtctccaaatacagtcacattggaggttagggcttcaacatatgaacttggggttgtggagaggggatacagtttagttcataacacctaataacttggggtaactttgtatctcatatttttctaatggaaacttgaaatatgatgatgatgaaacattttattttaattacagggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcaggtaaattttcaatgaaaattgtttttactttttttccctccccctaatctctggtcattcaggattaagcgtttttgcaacctattagaaatacatttacaacaccttatctttgatttaggctgtccttttagtttgcaagttagagtttgggaatgtatttctgtatagaaataagattctctaaattccactggattgtatttgaattatgaggaacacatctatggtataacaaaatacatattctccctgatctccttattccttg

SEQ ID NO: 74988 - DNA, 1139 bp, Homo sapiens
ttggattcaaagttgccttttttttttttttttttttttttttttgagacagagtctcactcagttgcccaggttggagtgcagtggtgcgatcttggcgcaacgcaacctccgcctcccgggttcaagcaattctccaacctcagcctcccaagcagctgggactacaggcacataccaccacatccagctatttttgtatttttagtagagttggggtttcaccatgttggccaggctggtctcgaactcctgacctcaggtgatctgcccgcctcggcctcccaaagtgctgggattacaggtgtgagccactgcgcctggcccataattgctttttcctgaagacatgtcattgacatgtttgagagactactccatattctttattaggcattttcacattgagccacaaatttaaaaagttcaaacacagttcatttgctgcgatttataatacagaagtatttaccaatttttgacaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccaggtaagagataattgtaatagttgtgttaatgaaagctgtttatttctttgcatttaaaaccatatttcacatggtgctataatgtggcattcattatactgatgtttgatggctttactaagagcttgtgaatgaggccaggtgtggtggctcacgcctgcaatcccagcactttgggagggtggattacttgaggtcaggagttcgagactagcctggccaacatggccaaatcccatctctactaaaaatacaaaaagtaaccgggcgtggtggtgcatgcctgtaatcccagctactcaggaggttgaggcacgagaatcacttgatcctgggaagcaggatcagcctgggcagaagagtgaaactctgtctcaaaaaaaaaaaaaaaaagcttatgaatgattactacattatagttttataataatgtttgaagtactttccatgatttgattaaagacaagatgctaaaagtgaaatgtata

SEQ ID NO: 74989 - DNA, 1072 bp, Homo sapiens
attgttgattacatgtttattccagtggagttgttttttcagtacatgaacagaactttaaattcattttaaacattttattcacagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaaggtcagagttcaacattattgctgattgaaccatagtagttttgtagcgaaactaatttttgagggccaattttaagttaaattggcttttatgcttataaaatatagttgttcaggttacctgatgttgaatcatatgctaacaacaaatggattatgttacaaaaattttgttttgatataacctgtgtctgacaaccttaaagatattttccctcagtctatcttgcttttattcctttagacttttcctatgatttaggagcattacagatttcattgaccagtatctgtaattccaagagattctgctaactagcactctagcactgtttctttgtttttttggggtattttttggccctcaactaaggaaatacttttttttttttgagatggagtttcgctctgttgccaggctggagtgcgttggcgtgatcttggctcaccacaacctccacctcccaggttcgagcaattctcctgcctcagcctcctgagtagctgggatacagacgcccgccaccatgcccagctaatttttgtatttttaaaatagagacggggtttcactgtgttggccaggctggtctcgaacttctgacctcaggtgatccacccgccttggcctcccaaagtgctgggattacaggcgtgaaccactgcgcctgaccaggaaatactttaattgtaattaatactttaaaatgaaaatactactgctgatttcattttagatctgacagtttttacatcagagttaaataaaattttacttctgagtttgaactagataatttgccctttaagttctgcacgcttaaatatctggagtcagt

SEQ ID NO: 74990 - DNA, 1034 bp, Homo sapiens
ccagggcttacaaactggggctattttgtttgattcacacagccttttaaaacattgcttcccaaacttgaatgtacatatgaatcacttggggatcttgtcaaaatgatgaagattctaaattagtaggtctggtgggggaatgagattctgcattttttaacaaggtgatgataaccttgctgctggtcttcagatcacactttgggtattagggctttcaaaggcacagatatgtttgtcccagtactgtagtttgtcataaacttagccaatttgcttttcctgttttaataatctgctggctccctgtaggaattttaagagtctctactaatctcatttaactttaaattatttcaaggattctgttgttacatcaaaaaaattgccaagtgttattttgtctatatatatagttctaagtttgatttttcttcacagcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggtattcatttgagtatattagctatactctctacatatagtaatactactttacatatctacatccatggttgatttttaaatgcttttactactttcattcacatttatgaatgtgcatagaaagttgattggtttatctcccttttgctttggaaaatttaacatgcctttacgcatcacttaaaacctcttttagaatgcagttctaaatgatttcattgtttagatttccaaatttagggaagatgatatatgtaaaagtttatatgtaaacctttaagaggtaaaatacgcagtttgaaaaataaaataggccgggtgcagtggctcacacctgtaatcccagcactttgggaggccaaggcaggcagatcatgaggtcaggagttcgagaccagcctggccaggacggtgaaacccc

SEQ ID NO: 74991 - DNA, 1061 bp, Homo sapiens
gctgggtcttaattcatgattctctgtttttttacatacacccctgtaaacttctttgaactccctagaatcaagaaatggtagcaagtagctgtgaaagacatagactaagtctctagaaatctattagaaggtgttgacttggcatcttgagtaacataagtttagctaagtacctatgggaagggctagccttgattagattgacaaggaatgctaccggtggtttggttgtgctacaaagtcaatagtagcattgacaataattactacaatttatataatttacttctgggcaatgtccctgtgttgcactggtttccttctccctaattcctctgtcagggaattgtatttctttctgttggttttaaatatattagtcctcaaattattgtagccctgtgggacctactgtggtcagttgttcccactgatgactgtcagaccactttaggcctcacatcaactgtaattgggttcagagtagactcatttaccctgtatttgcctcatgaccaccaccactgttaccacttaaggggcattcacctgggctctgccagcaaagatcatctctgtttctaacttgagcaaccttgtcatagggtccctgaaaagcttccttcattacttcccagaagccttagtaatattatgagccctgatagatctgatatctaagcctttcaaaggcagatccatttgatttctttcatattttttacagctcatgttactaaagtacagagcctttttatcaataggctacataattacctaacaggttttgatatgatttcctgtagttgttcctcttgagaaacactggtttatttctaccagtcagtggtgaaagtcagcctgcagttctttagacatcatttccgtttgctaccaatgtaggattggtaattgagcctcttctcaagcttttctcttagaataaaaaaagttgttttttttattttagtaaaataaacataaaatttttactatttttgtcattttaagtgtgcagttcagtggcattaagtacattcacagtgtacttaatgttg

SEQ ID NO: 74992 - DNA, 1039 bp, Homo sapiens
acaggcacgagccaccacacctggccttagttatttttaatcttataagctgatatcaatttaggcatcaagtggtaataaaccaattagggctcttaactattcagccattaaagtatattcctgtggacttcctatgttgcattggtagaatgctttaagcaatttagatgaagtaaaagaaaattagctgggtgcaatgactcatgcctgtaatcctagcactttgggaggccaaggtgggtggatgtcttgggctcaggagttcaagaccagcctgagcaacatgacaaaaccccgcctctataaaaacaatacaaaaattagctgggcttggtagtgcgtgcctgtagtgccaggtacttgggagactgaggtgggaagattgctagagcccaggaagcagaggttgcagtgagccaagattgtgccactgcactgcagcctgggtgacagagcgagacactatctcaaaaaagagagagaaaatttgcacacaaacctatgatacagagtgttaagtactcagggtatattagaattaaaaatgagaaaattgattttttatctttgggtacttttatattgctagcctaaattaagtgctgttaatgaatcataaaatgcattaatgttcaggacaaaagagagctgctaaatatattgatgcggtaagatgaacataaaagattcaagcgagaaacaaatacagttattttgatttaaatatgcatgcttggatgccagtgattgggtacatgtgggattaatcaagtagaagtttttgagaaagggttgagtagaaatatgaagaaaaaaatatagattagcagaaaggattacaggagggggacttcttatttcggctcaaagatagtatagatttttagcaacacattaaatttattgtagttctttttcagaaagaaagctttcatttggtcagcttacactaccttttttttttctcaatcctgctccttctgtatatactactgaattcgtaagataaaaattgctagttccaggacaaaaaagt

SEQ ID NO: 74993 - DNA, 1174 bp, Homo sapiens
cttactacattctccttaactaattgctaactcttgattgacctgctttttcataggtaaagaagactcaatagcacatcaactatagacaaatgcgtaagctaaggtgcataatgtagtctcttaaatacgatttattctggctgcatgcggtggctcatgcctataatccaaacattttgggaggttgaggtgggaggatcacttgaggccaagagtttgagatcagccaggtcaaaatagtaagaccttgtttctacaaaaataaaaatattctttaattttggctagccgacaacaattttgtttatttttgctgtggattgttaaaaaatggaacaggtctgaatacagaatttcttgacttgtgggataggaaaatgatttgttgtattacctagtgacttaatctcataaataaaataactttttttttagccatgtagacacttggaatatatttcccatctttgagtgagttcagccttcaatataaaatgtataactctcttccacaacatcactaacaggtggtccaaattatgtttcacactggcttttcattggaagaggtttaactagcttacaaggcatcctgttttcattgttcatctgctctcccttgttaataagtcagtcctttcaacagcctccttttacaggtgaggaaacaagttggggtggggagtaaatccaagattacggtgtccaaaattatttttctagtaactgataatgctagactctaacatcaattattctagcatttatgctctttttactgtttatcacatagtgcttattatggaaaattcttcctgatatctgttgaagtatgcattaagaaaataggggcattgcctggaatttaaactggctgcctagatctttgtgtagataccactctgtactgtctgcttagacatttggctttttactataccccaagtgattaagctctaggtattcaatggacatatcagaacatcatcaatttatagtagggaagaatgtctttcatactgaccaattcctatactaatggtcagttatgtgtgaaatctagttataatcaaaggctatttggtgagcatggggttttcaaaggaagttggataattttcttagctagtgtctttaaatgagatgtttagctcctttttaaggaataagc

SEQ ID NO: 74994 - DNA, 1469 bp, Homo sapiens
cagtacgttaccctttctttcagcgaggcctggaatcccctggttgtctggttcaaccatttccagagaataaacctctattcatttgctggagtaggagaaagggaaatagggatctgactgcgtcttaatctgactttcagccacattcccttatttttagcatttccccctacttcacctggtaccaccaattattagccttttggagattctgtagcataagtcagatttgagtcttagctctcaatacttctatctttgaaatcaattttctctggtctcctaaattccttatcacttctccttttgttctaacaacaaatttttatatctgttatttcctttcccattctacccatccttgaaggtttacaccttcttttaaaaacccctattctgtcattataatggggtttcagtaatgtacatacatgtctcttatccactgtctttacaggcaaggcctatggattgaaattctttttcccttttcttcaggctagaggtaaactttccctcattcatatccctggtgttggcttattcctttgatggcagctgttgtatgaacttactaacatagcttttctaatccccttactagataacatatttgagagtaaatattgtgtctcattcatcatagtgtatatctctgcatggtatcttgtgcataggaggtgcctattaaatatcggttaaattgatttgagctaccttgtggcctctgcattgttagcattccagagttcgcccagagctattcctttatggttttcctgggaccttaagagcacctctgtgggctgccataattaattgatccacctgattctcttttaccctatctgtatagttgtgggatgtgggggaaaagagtgaacagaaatggaaaagaaaaggggggaattgtttgagagctgtgatagatcaggaggttaatttacatatttcatgtatttcatacatgtttcaaaagtttgaaatgattgactttttctttatattgagtaatatgtttacaggctccaggccaactttaaatttattattttagtattcttttttttttttttttttgagacggagtctcgctctgttgcccaggctggagtgcagtggtgtgatctcagctcactacaacctccacctcccgggttcaagcaattctcctgcctcagcctcctgagtagcttggactacaggtgcgtgccattacgcccggctaattttttttatttttagtagaggcagggtttcaccaagttagccacactggtctcgatctcctgacctcaggcaatccgcccgccttggcctcccaaagtgctggaattacaggcgtgagccactgcaccaggcccatattttagtattcctaacactgagaaaaaagaaggaaaatatttaaaaatcggaccacaggccaggcatggtagctcatgcctgtaatcccagcactttgg

SEQ ID NO: 74995 - DNA, 1065 bp, Homo sapiens
gttttttttggtagaaacagggtttcaccacattgcccaggatggtcttgaaatcctgagctcaagcgatctgcccaccttagcctcccaaagtgctaggattacaggcctcagtcactgcacctggttttttggtttttttgttttgtttttttttttttgagacggagtctcactctgtcgcccaggctggagtgcagtggtgtgatctcagctcactgcaagctctgcctcctgggttcacaccattcttctgcctcagcctcccgagcaggtgggactacaagtacccaccaccatgcctggctaattttttgtatttttagtagagacgggtttcaccatattagccaggatggtctcaatctcctgacctcgtaatccgcccgcctcggcctcccaaagtgctgggattacaggtgtgagccaccgcgcccagccacacctggtatttttataccaccttatgacttttagaaaccttaacagtttccttccttaaagctataaacaaatggatttgaggtatcttaaaattaacagaaagggattctaggattgttttttattgtatctgttgaaatccaactagcctccaaggttcaatttttcctttttcatttgtttttgttgttgtttctttctttcttttttttttttttttttttttttgagacagagtcttgctctgtcacccaggctggagtgcggtggcatgatctcagcttactccaacctcctcttcccaggttcaagcaattctcctgcctcagcctcccaagtagctggtattacaggcacatgccaccaagcctggctaagttttgtatttttcgtagtgactgggtttcaccatgttggccaggctggcctcaaactcctgacctcaaatgatccacccaccttggcctcccaaagtgttgggattacgggcgtgagccactgcgcccggcctgtttcatcttttgtacagggcttttctctgaatccttggttttctgctcatgcttaagaatgagtaacaaaaaagctgattgaagttctgagtggggattgttaactgtg

SEQ ID NO: 74996 - DNA, 1935 bp, Homo sapiens
gagactgcaggtgcccaccaccacgcctggctaattttttgaatttttaatagagtcggggtttcgccacctttgccaggctggtctggaattcctgacctcaggtgatccacctgccttggcctcccaaagtgctgggattacaggtgtgagccaccatgcctggccaaactatattttttaaagcttgatttttaaaatttcaagtagaaataaatccatgggtaagagttcattcatttgcatcatagcgtatcttcctattttagggttatctttccagttcagcagtgcaactctatggagtagaattgaaaggagacttttcgccaattgcaggaaatggtcataaaaaaatacctgctcactgacagaataaaggtaccttttaacttagtcaaatctcttttgcattgttttccaatctgttcttggttgccattgtatagaaacagattgaattctcttaaatattttaaaacattaatagagatgaattgttgtaattatatcctattcacatatttctctcttccctgattttattggaaagtaaaattttttgaattgtcttcctaccagatacagttttggtagcagcatttttgaatctctagaggttggttagaagtgtatttaattaatctgtgaatgtcaaaaatacataaaggcctaagtaatgctcacaatacctctttttcagcaggtatcgtgtatgccacagaatagcagttcatgggggaatgatgccataggttaggctacaacagaggttttctatttttcccgtacttaagaagaaaaataacaaaaaaggagaaaggaatttttttggttaatgcagtaatctttatcatttcactaatagttctgtacttctgatggcaatgcagagaaataccgagtatctctgatgttaagtgcaatctaatgtggaaagatgtacctcagtaagattaaggatgtagtcttccaccaccccgccccctttttttttttttttttgagatagagtttcgctctgtcgcccaggctggagtgcagtggcccaatcttggctcactgcaacctccacctcctcggttcaagtgattctcctgcctcagcctcccgagtagctggaactacaggagcccaccaccatgcccggctagttttttgtatttttagtagagacggagtttcactgtgttagctaggatggcctcgatctcctgacctcgtgatccgcccgcctcggcctcccaaagtgctgggattacaggcgtgagccaccgcacccggcctccccttttttacagaagaaaattatttcattccctcctctttcccacctctctctctccctgacttgctcatattagagatagaggcaaatgatcagagtaaattcgttgtccaatagtaagttcatggtattttctcactatcccatatgtagtgaacaataataccttgctcttgcacaagaatcacataactaatagaatcaatataattgaaaattgatatttaaaaattatgaactcttaaaaatcatggtttataaatggataaccaagtaatttttgttggtttctttttaaagaagataataaaggtgtacaaaatacatatttacttactttttttttttttttttgagatggagtgtcactctgtcaccctgactagagtgcagtggcacgatctcggctcactgaaacctccaccttccaggttcaagcgattcttctgcctcagcctgctgagcagctgggactacaggcaagcaccgccacgcccagatcttttttgtgtttttagtatagacagggtttcaccatattggccaggctgatctcgaactcctgacctcgtgatccgcccaccttggcctcccaaagttctgggattacaggcgtgagccactgcccccagccttacttacatttt

SEQ ID NO: 74997 - DNA, 1008 bp, Homo sapiens
tctggtgtaaggtgagaaagccggatggtatggaagttatgacgctgtcccaggcacaacaggccataggaagtagagaaaggaaaaaaacccaggactctaaagcagcagcaagaaggaaatgaggggcacaggaatagagacggtcttctaagtagttgttccctaaaggcctcttaaatgtcagacttaatatttgttctaagtcagagtggatgagtaaaaaattatcacacgaattttttccaaataacttctggatgattttcattgattaaggaacaaaaacatgaaatatactttacagatgaaatatagatgaaagaattagaagtccagaatgcaattacttatacccaagcaaaatttgatgttcactcttctaattctctgggatttatttctcattacttctctctcatggaaatgaaattcatttatcatcatgtactctctgacatatcaggaaaggtgttggttgacatcagctccaggcctagcatagtcctttatggggtactgtccagcttgcagacatcaacatttggaaagcattttcttctgctagcaacagctttgcctgtcaccatccaaggtgacagtgtggctttatttattaaagtaaaagaataataagttatgacataggtagacacttatattctagtttatgatgacaatggaatttgggatttcaaagaccacgtgtctgatttcctttactactttgtctctgcaatgcaaattaaggaatatcaacaaaacagaagtgtatgactctttcttgtaacactttgctattttatcagtcactactgccttctaacccctttttttggtactgtaccgaaatagtatgttgaactttgataagagcttttataaagctgacaaatttacttgacctaggatattactgtatggccataagcaaaccacttaacacctctaggcctctagttcctcattttaaatgagcaaactaaatgctatccaaggacacatctt

SEQ ID NO: 74998 - DNA, 1731 bp, Homo sapiens
agattacttgttaaatgttttaatggtaagtcactgacatgtaggactcagaagacctggtattagtttaaattttttcccctattattaactaatataatttctttgaagaaatgtttctggtaagtatttgtaaaatatgctacttaggataaacaaaatgatctatgagattcctttcaactagagttttatgtatttctcatggcttgttttgcatcattccaggtcaaaaagttgctagggtctcagaaataaaacgaaagtagagcagttacttgcatgagcaaaacatgtcttactgtgcctttttgttgctctcagaatgttagcatatagaccactgacattttgctttatttagcaataaaaagatacttctttgtactttgtttcttttgatgtttttctctccaccagatgcagcagcagccggaacccacagttcaccttggtgcattcctttatgatgaagacttattgattcattatatgagaaaggaaaaatgagcagaaactactgtatgatgtgcagctcacaccagacagcaactttaggtaggcacttaggtatgcaaatctgatgactttatgtgtattttttcttacatgtcatgagtatgcaaagtttggactaagctattcaatgttttctgaaagcaaaaggccaacctgtggcatggttattaccaaatactgcagttagggagagtaaacgaatattatctcaggagaataggtcacttaatgtcccccaggatatatttagaaactttgttttgttttgttttgttttttgaaacggagtcttgctttatcgcccaggctggagtgcagtggcacgatctcagctcactgcagcctctgtctcctgggttcaagcaattgtgcctcagcctcccaagtagctgggattacaggcacccgccaccacacctagctaatttttttgtatttttggttgagacggggtttcaccatgttggccaggctggtctcgaactcctgacctcaagtgatccgcctgcctcagcatcccaaagtgctgggattacaggcatgagctaccatgcccagcttagaaactgtttttcacagttttttttccctagtcaagtaaggcagtgagatgtttttcacatctagaaactatgtaatcagaggcaactctgcaggttcagaaactaaacagaggtgacaatacaaaggaactgactcatactctacatattgaacagagattggtaaactatacactgattgatttacaatgagaactataatttccaaggaggctgaaatgttctccccataaaaacatctacttgagctgggcatggtggtgtgtacctgtagtcccagctacttgggaggctgaggtggaaggattgcttaaaaccaggagttcagggctgcagtgcagtatgattgggcctgtgtatagccactgcactccagcctggacaacaggagacccagtcacttaaaagaaaaacatctggctgggcacagtggctcaggcctgtaatcccagcacttgggaggccgagatgggtggatctcttcagcccaggagctcgagaccagcctgaccaacatggcaaaaccccgtctgtactaaaaatacagaaaatagcagggtgtggtggcgcacacctgtaatcccagctactcatgaggctgaggcatgagaatcgcttgaacccaggaggtggagggtgcagtgagctg

SEQ ID NO: 74999 - DNA, 1036 bp, Homo sapiens
tgggcaatgagagcgaaactctgcctcaaaaaaaaaaaaaaaaaaaagagggtgggttttaaatgttctcgacgcagagaaataataaatttggccaggtgcagtggctcatgcctgtaatctcagcactttgggaggctgaggcagacagatcacctgaggtcgggagttcgagaccagcatggagaaaccccatctctactaaaaaaaaaatacaaaattagccagacgtggtggcgcatgcctgtaatcccagctactcaggaggctgaaacagaagaatcgcttgaacccggaaggtggaggttgcggcaagccgagatcacgccaatgcactccagcctgggcaacaagagcaaaactccctcccaagaaaaacaaagaaataataaatatgtggtgatgaatatgttagcccgatttgatcattctacaatgtatacattctaccccataaatatatacaattattatttgtcaattaaaaataaaattttaagaaaatggctgagtagacttgtgatatggagggccttaaaaatctcaagatttgatacactgaaaaatagaagatcattaaaagtttgtaaggagagggagtgatataaaagtgaggtttaagcgagattcgtttaggtgaacaaggtattttatagtggggagaagctgatattgaggaactggttatgagtttgtaatggtattcagagtgtgagatgatgactatggctatgagatagttgaattgagaatgaagggaaaataggtttcaaaagaaaaagtggtgggactgaatacctgactagatacaaaaagtgaggtttgattcataggctgtcagctttggggacttttctttcctcatataattaattagatgtaagtaggaaattttaaagaattgattttgccctttagagaagctcttctttctccattcccttcccctctacatatgtaatttgaggaaagctctactctcctttaggcagctgattagcaccttcctttaatctttttccaagcaacgtagtat

SEQ ID NO: 75000 - DNA, 1033 bp, Homo sapiens
ttgtttgtttgtttgtttttttgagacggagtcttgctctgtcgcccaggctggagtgcagtggtgccatctcggctcactgcaagctccacctcccgagttcacgccattttcctgcctcagcctcccgagtagctgggactacaggcgcccgccaccatgcccggctaattttttgtatttttggtagagacggggtttcaccgtgttagccagaatggtctcgatctcctgacttcgtgatccacccgcctcggcctcccaaagttctgggattacaggtgtgagccaccgcacctggccaatttttggagtcttttaaagtaaaaatatgtcttgtaagctggtaactatggtacatttccttttattaatgtggtgctgacggtcatataggttcttttgagtttggcatgcatatgctactttttgcagtcctttcattacatttttctctcttcatttgaagagcatgttatatcttttagcttcacttggcttaaaaggttctctcattagcctaacacagtgcattgttggtaccacttggatcataagtggaaaaacagtcaagaaattgcacagtaatacttgtttgtaagagggatgattcaggtgaatctgacactaagaaactcccctacctgaggtctgagattcctctgacattgctgtatataggcttttcctttgcagcctgtgactgcggactatttttcttaagcaagatatgctaaagttttgtgagcctttttccagagagaggtctcatatctgcatcaagtgagaacatataatgtctgcatgtttccatatttcaggaatgtttgcttgtgttttatgcttttatatagacagggaaacttgttcctcagtgacccaaaagaggtgggaattgttattggatatcatcattggcccacgctttctgaccttgggaaatcaattaaggggttcataatctcaattctgtcagaattggtacaagaaatagctgcatgtttcttgacattccacttggtaggaaataaga

SEQ ID NO: 75001 - DNA, 1081 bp, Homo sapiens
gcgtggtggcaggtgcttgtagtcccagctactcaggaggctgaggcaggagaattgcttgagcctgggagatggaggttgcagtgagccactgcactccagcctgggtgacagagcaatactctttctcaaaaaaaacaaacaacaagaaaaaactactttccttaaaatgttttacagtggttatttcaattagagagcaggagaagggaaagtatgtcttaattagaccaaactgatttgaacatgacacttttttttttttttttttttaaacataagctgacagtggggaaaacagcactatataccttttggactttcgtatttcaactattcttgatattgctccttttttttaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagttttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttc

SEQ ID NO: 75002 - DNA, 1036 bp, Homo sapiens
gcctgggcaacagacggagactgtctcaagagaaaaaaaaaaaaaaccgcaaaacaaaaaggctgggcgtggtgcctcacacctgtaatcccagtactttgggaggccgaggcgggcagatgacttgaggtcaggagtttgagaccagcctggccaacatggtgaaaccctgtctctgctaaaatacaaaaattagccaggtgtgttggcaggcgcctataatcccagctactcaggaggccgaggcaggagaatcacttgaccccccctaaaaaaaaatcctaatcctaacccagaaataaaatggctctactcatgaatgggaaagtttgtcatctttgagattttatatatatagacacacacacacacacatgttgtgtgtatatatatatgcactgtcagtcaaatattcacattctaaatgactgtcagaaatattccatggaaacttcatctctgaagattatacagatttaaactgaacatcatctacctacagcaaatcacacttcccatctttgaactaaaaggaaccagaacttaccccacctcctaacaagcaatatttggtcctattgcttctaaactattgcaaccaaaattccagtaaccaaaacatttgctgtgttctctaggcatatcaagtgttttatttagaccatttctgaggattttgctttaaaggctttacatgcagcattcaagtatctcataatataagacagtctagtctttcagagatcatgtatcatcaaggtctgcagagttttcactgtcatttgcaacaagagcctctctgttctcgtaagtccagaagccattcaaatcgattagaatggtggttactgtgtctccttgattactgttgattaaatcctgaagagagattttcaaaggatcctttggttttaccatgtcaaagatttcatcctgcaagagaaaaaaaaatacaatgaaatttgatccacttaatttctatcacacatagtgatccaaaattcagggctgtttgcatccactgaagtacagagga

SEQ ID NO: 75003 - DNA, 1081 bp, Homo sapiens
ttgtattaacaaaagaatatgttaagcattttaaatgcctcaaatattggctgggccaatataaatacaatataatacaatataaatacccaatacaaatactttttgtatttttactagagacggggtttcaccatgttggccaaaatggtctcgatctcttgactcatgatgtgcctgcctcagcctcccaaagtgctgggattacaggcaagagccactgcgcctggccaaatctccatttcttttaaaaaaaaaaaaaagtttgacttaatattttaagtttttgaattataaggagtctctattgttctttcatttttaattgtatgaatttatgccattgtttgctaatttatgtagaagtcattttcttttatgttggcagatcatttaaatctttattttcttttcttaggcaatttttcacagcaaaagtctttgctaaactccttcatacagattcatatggaagaatttccatcatgcagttctttaattatgtcatgagaaaaggtgattcatttttactgtgcttgaactccttatctgggaatcaagtaggtttttggtctgtgcttttataagtatttcttctatgtgaaatcactctaagtttgaatagtagaatttcttatcttttgaccaagatgtgttacataaacttgggttagcataaaaaaacaaaaattttttaaaccctcatgtgtcttaaagataatagtagactagaaatattaagagctgaaccaagagttttaatgtatggtaatttgaaataattttaatttactgataattttattttaccagtatattacaagttgagttgactgatagtttcaaacccaaagctgtaatatcagtttcaaggagcatcaattaaacagcttggacttatgattcctacaagtgccataataatctgtgaaagcctattgtatacaatctttaataattggttgctgtaattaacctcagaaataaaagcagcttcactgaaggcataatattatactagctgtccctgtttggtggaacaccaagtttaattggtaaagaacagtatcttcaaggtgtc

SEQ ID NO: 75004 - DNA, 1082 bp, Homo sapiens
ttcccaccagaagcagccgctgagtttgcatgggtcatgtaccccaaacatagtgttgtttgttatttttgtttaaggccctaggtgattctaatgtgcagccaaggttgagaaccactgctgtagggtcagactacagaggttcaaatcccagccctgctatatgactttaggcaatggacttaacatctctgtgcttcgattatcatctctaaagtagggatagctaactatatcatagagatgtggattaaagaggcagtgtatatcaaaagcttagtaggcactcaataaatgttatttttattgttagtaatcaaaaggataatagggcatgagattcatcttaatattgactctgccaacaaactctcattttagtggaaagcacacatttaactacatattaaaatcttgttgtttttaacttacaacatcttcacttccacaattctcttaagaacttatggtttttgctggacaaacaccagacaccacctatgattggagaggaagcgatgatcaattacgaaaactttttgaaggttggtgaaaaggctggagcaaagtgcaagtaagaataatataattaacaaaagaatgtgttatgttaagcattttaaatgcctcaaatattggctgggcacagtggctcacacctgtaatcccagcagttttggaggctgaggtgagaggattgcttgagctggggtgtttgaggccagcctgggcaacttagggagatcttgtctctactaaaaaaattatctgggtgtgggggcgtacacctgtagctactccggaggctgaggtgggagaattgcttgagcccgggaggatgagctgtgattaagccactgcactccagcctgggcgatagagcaagaccttacctttaaaaaaaataaacaaatcctcaaatattaaatgaagtaaatggaatgacatttgagtccatttaagttactaattaaatttaataaaattatttacagtcaaaaaatcacattggtatgaagttattaaaataaataatatagccaggtgtggtggctcatgcctgtaatcccagcactttggga

SEQ ID NO: 75005 - DNA, 1421 bp, Homo sapiens
cactgagccatagtaaagaaattaacttataggtttggtctaaggttaaaaattaacataataggccaggcatggtggctcatgcctgtaatcccagcactttgggaggccgaggtgggcagatcacctgaggtcaggagttcaagaccagcctgaccaacatggagaagccccatctctactaaaaatacaaaattagccaggcgtggtggcacatgcccgtaatcccagccactcaggaggctgaggcaggagaatcccttgaacctgggaggcggaggttgccgtgacccgagatcgtaccattgcgccccagcctgggcaacaagagtgaagctccatctccaaaaaaaaaaaaattaacagatgcagcagaaatgcagtcataaaaggaattcaaggaaacaattacaggcttgttgggaaggaaatgagaccagaaagagtaaaataacttttgagaaaatagatcacagaattcaagagctcagtgaggctgaagtggaaatggtatggcagtgaggttttgaattaccagaaaggatgatctgagagtatatttgagcttaagatttcagaaagggatcaagtaaaatctgtgatcttgtcatagaaccaaatggcagaatgaactagaggtgaaagtctttggagttgcaggacccatggtcacccacataaatgtttattcatcctaaatgattgcaggaccttgtgaagaacactgtgtaccagtcaccatagtccacaaataagtggggaggaattggctgaatgagacagccacgtgccaatagcaggcgagttgcagggtaatagagccctgagttttgagcttcagacagaggatgagtttttttgtttgttttctctacattaggtagagaaacagtgattatgaggctgaaactccatgaggtcaggggctggggctgtcttgctcacccctcattccgtgtctactacagcgttctctgtacatagtaggtgctcagtaaattcttttcattgaatgaattaggagcactctacagagttctgtaggagaggtaatttgaggaagagactagctttagcgataaacagaagtagagggagcatgagaaatggttgaagatgtagaggaggctgcttcagtagagggtagtgattcttggtatttcagaaaagttaatatgctcagtgtctaagcacaattgtgaaggcctttttggcactgcaactattttaattaaactattaatataatatataggatgacctgagtaaaagtactgcttgattttaaaagtgctccccttaatctgttttgttaccagaaaaaaaaagtgaacaagaattaaaagatgaagaaatggatttatttacaaaatattactccgaatggaaaggaggtagaaaaaacacaaatgaattctata

SEQ ID NO: 75006 - DNA, 1339 bp, Homo sapiens
cgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacagtgagttttgggaggggcagcccgttgggatggcccggccctaaactcctagaggtaggggggaggtggggaggaggagcaagggggagccgccttttccgcttctgtgaaacctcccgacaaaggaggcggagtggaatgtggtttaaggatcccgataggtttgacccaaactttcctggggcagaatctagaggaacgaaaaacttagctttagtcactgacttccatggtcttaatctaaacttgtgaagaataacttggaaccccggctccaacaacgcctgaaccccaccaggacctataattgtcctcctgcctttttactgtcacgctttttgcttccctcgtaatccattttatatttcataatccatttttccttttatttttctccttcacattgcttattaactaacctcgttaaatctacctttcctattccacacccgcactaagggctgttgaaagtggctggagaaaaacagaaccttggtgagttgtctcacttttttttttgagacggagtctcttgctctgtcgcccaggctggctggagtgcagtggcagcatctccgctcactgcaacctctgcctcccgggttcaagcggttcttctgcctcagcctctggagtagctggaactataagcgcgcgcaaccacggccggttaatttttgtatttctagtagagacggggtttcgccatattggccaggctggtctcaaactcctgaccttgtgattcgc

SEQ ID NO: 75007 - DNA, 1727 bp, Homo sapiens
gccgcggagaataccgctaccacgctgactgggggaaaaaactatgaaagagatggaaaatggttctccttcagaggcgacccaagctcaccaagccggattttaaaggccacgataagcccgcgttttcctttatcgtgtgcctttggcgcgtgcgcaccacgtgacccaggagttcattagttccggcttgagggaagcgccttctttcacaatttcttttcattgttcattgcggatatctggaagccttccaggtcccctgaatgtagtagacacttcagcagccgtctcctaccccttttgccactaaatgcttcaaaactgccttttttcctcgccgccgggccaggcggaacgcctaagtccgggtcagtctcgtccgtcggtcggggctggcgcggtgcatcgtgggcactgtagtttccgccgcgtttatggccgcgttaagtctgagtgccgctttgagttgttgaatgaagtgaacttcatttgtcagcgttcggtacgcagtctaggcagcgcccttcctgtacctctcttcctttcctgagtcgttggcgcagctgactcgccacctcctccctcctcgtccccccaccggaggagttttgcggtctgtagagagctatgcagggtgagggcccctagacttcggctttcgccgctgttggtggtaggctggagttgggggtccctggatacggttttggctttacaccccctttccagcaagcttcccgtgggaatctgttccttttcaggacagctgtgatccacgtgagtaaaactgggcgttccgtcttgtgctttttcctcaggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccaga

SEQ ID NO: 75008 - DNA, 1015 bp, Homo sapiens
agctgtggtggctcacaactgtaatcccagcacttcgggaagctgaggtgggaggattgcttgagcccaggagtttaagacaagcctgggcaacatagcgagacctggtgtctatttaaaaaaaaaaaaaaaaaaaaaagctgacaaatacacatatgctttcaggatagaagttatgaaaagggagattataaaacagtgctttcttagtgattttcatgcagaagcaacatcttcctaatcttcctatagtaaagatttcctcaagtaaacatattatatattcattataatataaatagtatatattcattagaaaggatataaacagttcagaaataccactatagagaatgaaagtccccttcttaaagcaaattatactttttaaatgctgaaaattgtcatgtcatttgcacgtttctttttccatttttgaaacgcacaagataaaatttcttaatagagtagaacaactaatttagattcagagtcaattctataaaggtttcctactgtactgcattgtttttgctttgcaaagaggttattaacattttttttctgggttaggggaggagtttgaaaaaatcctgtacaagttaatccattgtgtggtaaaagctatagctgaagaggcaatgtggaatactccagtgtgcacaacccctgcttttatcataggtggcaactgcagattaattctggtgtggttaggcatttcacaaagggaaatatgaacctgagagcctatgtccccaacagtgctaactgggagatgtggagtgtggggatttccactctttgttaataagatctccggcacatttcctctttgcttttgcattttccttggttatgaagcagctgcagagaagtaaaatgtgatttcctgtgtttaaaagagtgctggcttttctttcagagacttaaaattggaagggtggaatgcatatggattgagctacctacagggctaatttaaacataggtgttttatttttgtttttgtttt

SEQ ID NO: 75009 - DNA, 1028 bp, Homo sapiens
aaggaggggccgggcatggtggctcacacctgtactgtaatcccagcactttgggagaccaaggagggtggatcacctgaggtcaggcgttcaagaccagcctgaccaacacggcgaaaccctgtctctactaaaaatacaaaaattagccaggcatggtggcgcgtgcctgtaatcccagctactagggagactgaggcaggagaatcgcttgaacccgggagccagaggttgagtgagcctagattgtgccactacagtccagcctgggtgacagagtagaaaaaaaaaaaaaagaaaaaggatatgaagtggaaagcttctaatgctgcattttctctctcattctctcttcccccacatacctacccataattcagtcctaatgcttttgttctttgttccttttgcagcttgcattttggattttcagtgttcataagctcctctaatagaagatgtatggggggaaaagcacatcattttagttaatcatgctagttcttcaaaattctgctccctatttctgtggataactgagaattggttaaaatggcttcagcagaatgaaaatttataatgtaatttaaaagaattatggctgacaccagcactgaatgctttcattcttatagcatgcttggggcattgaatagaaagtggtttggtgaaaacactgtagaatttgttttgattgccatctgttagttggttttactacagtgagagaaaaatagaggcacaagtattggtcattaaaggtcatttggtaaagtgtttacttgacagtaagttcttattttttctgccactcaagttattttatttctttctgttgatttacataacctcttgtaaaagtttcaataccataaagcacctaagatacaataaactatgctcagtatttttgtgtgtatataatcccgggtgtattttttttttttttttgccccaactgtagaaatgtgagtttctcgatccccatgcttgaaattatgtttcaataacgttaaagtgggaaggaa

SEQ ID NO: 75010 - DNA, 1027 bp, Homo sapiens
gggtttttttcttactattcatttttcatgacatggcaactcagggaagtcatattgccctaggtcaaacagtgccaggctgactacttccttttgtcatgtatcacttcacccactcctgccttgacatgtgttaagagttatgttttgtcatgtgactgctgggatcgtctgcatcactcagaattattcttaccaactgctaatgaagttaatgatcaactgtcaggtgggtttttagtgaagtgatcaagggcataactagcaagatgaatggagccaggcaaaatttctatagtgatttggcttcatagtcctttcttttcaaatgtcccagaaaggaacattctgcatagtgtttgaaacaagatttccccaattgttgtagaagtcaagtgatccagtgtctttgaacagcattaaaaacactgtgttgccaagctcccatatcttttctctctctggcaaaatcctaatagcaagttgatttcccatcactgatgtgtcattgataatgtctgtgtgataaccatttagggtgtggtgagattgtctcgtgagtcattattgtgtatatcttgcttccatcacagtgttttaaaacactctcattgagagtgtggtaggaagaggccacttatgaaaatataatatccattttaacaagaaaagtttaaatatttgttgtcagtaaggtaaacagcaattgcagagtgagtagtaaatttacttaaactgtttataaagctatataaattattcttacctaattattacagtggtaacactttaatcataattttctggtaatgtttattttaaaacagcatttttttccttttaaaattgtttctgtttcacaattttcactaatataaaggctgatttttatcccagtcaaatacgattaagatcagttgattaagatcagttcagatcttagatttcttttgcagtgatttagacatggctttttttctagatagtattaggaagggtatattgttccttagagtattcactctgc

SEQ ID NO: 75011 - DNA, 1357 bp, Homo sapiens
gctttccagcttccaaaatcttgttgctattgtctctaaagtcattgtggatttgtgattttagaaggtctatattatagttttaatggaatttcaagtggggttaagattagatgcatgtgttcagtttgccttaacctgaaagtttatgttctactcctaccaagtgttgacagagattatcacaaaaaccacccaaatgtgtgataatgccaaaagaaactcttttttctctgtcttttgttttattctttcctctctcttcttttcttttttgctctttctttgttttggatgcggggagaatatagtaaggattgggagctctaaattccctaatcccgtcccgattgcgtagtaatagctaacatttattgagtattttcccatgtgctttgtgtctacatacattatctaaagtaaccctcataataacccaattattatttctactttaccaatgatgaaacaggctcagagaggaaatgtaacttccccaaggtcacacagttggtacatagtagaattagaatctgaacccaggcagcctgatgccaaagcttgtgctcttaattatgattattgaactattaagtaatagaagttggaaaggtctctattatgtgtctatccagttttatttatgtataagtccttccaccgcagagctgcatagattgcttaaaacatgaactggagatgtctaaggtgtctctccctccctcccttcctcccttcctttctcttactattttttctgcttccagtcatccattataaggtgtctttttatatagccaggtattttatatatttcgaacagacagtactttaccagaaaacagaatccataaccatagtgtacaactgtgtggggctttgtagcaagacaaaagctgtgtaaattagtgcagccatggccaggctacacaagttttcaagcttctgaactccccactcatcttactctttctcttctagtcatgaaatggagccctttgatcctgacagtattcatatactttcccagagtgagcaaattattccttatatatggactggacctagaaccctagggtgaatttttaataaaccttttgagagtggaaatttaatcaaattttgatatttccatatcaaaataagttagtttaatcttcctgaaattagttttcagtcttcagaatacctatcctttcttgccttacaggatagggaggaaacacagatatcttacagagaaaataaaaagaccaaatgcatataaatgtttggagaaaagtcacactgtgagtcaggaggcaaatctgtcttctagacagctttgactctcagctagctgaggaaatccatctag

SEQ ID NO: 75012 - DNA, 1053 bp, Homo sapiens
tccctaaaataccaaagactgacgaaagcaggatataggacatggtgggtctaatgtaaaccagtgggatcatttatgacattataatgaagtaataatattttgtatatatccatatatccattttttcccaaagagattcaaaatgctttatatagtgagtcagtcattaaatacttttagatctgtgtacaaagaggcagaagtaggactcctgctcagtcagcctcagcctctctcctctggatacaccaccagacttagaaagcttgcagcttacataccacctggtgaaagtttccttttctcatcttccatttctctcattttcatcaagtgctaatctgtctgttgtatggtatatagctctgaagtagttccagcaagacaatatgatcaagcttcctttaaataaatcatgatctctttctctctctgcaagcagcaacagctgtcaaaggtagaactgaagccaaggcagcaccaatggagcaggctgctaatgaaaatatgacaagaatatttgaaactagaagcctcaagccacaactttgttaggtttcctgcactctccaccttggtggcattttcagaggtacacagaaaaatgttgaatatagcagtcacttgagaaatacagtgtcactctatgtctgggacagggattctcgtcccaaaacttagctcaagagaaaaacaagaggaacgaagacaaagaagggacttaaactgggtattagctaacctacagagagtaatagcatcataaaaacaagtagaaaaccgcactggactagtgtaagttatgagttccctgtttttttccactgtacattttgtggcgagcacaatgcatcaattacaggcattatgtttgtgatatcctgagttctggaacactgcctcaagagagttcatcaatcattgtctttttccctaaagtggtcttgcgttctctcagtctgtgggaaataattgtcaaaattaataaatgcacatgaaagaatatttacttttcttgctttctcctgtctgcttttgacttaaccccat

SEQ ID NO: 75013 - DNA, 1171 bp, Homo sapiens
gctgatccaggtgactgtctagaagctgctctgaaataccagttcagctttaggggcagccagttatttggtggcttgcaagaaagtctcatcctgccctagtagtattttgggtgtttcttgaatttgggtgaagagagagggaaaaggtgtgctctgtgatagataaggcaaataggaaaaatgcccaaagagaagcaacttttaagtgtgaagagagcattgttagaattcatcgttctagtggaagagtccagtgagctgtgagaatcccaggcattagcattctgttcccctcagctttccatctgtgttctagatagtattgcttaccagctaaggactttgaggtggttcttaagtattactagcatcatgttggtcaagaaatcagaggcacctccaaggaaagtaagtaaaaagtacggtgaaaaacactgtcctctgcctcttcagctgtgcttgattgtgtcctttcttatgcctggttcagctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcaggtaatggtacctgttctttatgtaatattaacagagtcaagtatacagtaagaatgtggcatagaaaaagagtgtcacaactaattgaaggttgcaaatgctttatttttctcagttttaggttagtatttggaactagccaggtcctagaaagagtctgctagagttttcataggccaacctcaaattaattaaaacacttaggggccaggcgcagtggctcacacctgtaatcccagcactttgggaggccgaggtgggcaaatcatgaggtcaggagatcgagaccatcctggctaacacggtgaaaccccgtctctactaaaagtacaaaaaaaaaattagccaggcgtggtggcgggtgcctgtaatcccagctacttgggaggctgaggcaggagaatgtcatgaaccctggagacagagcttgcagtgagccgagatcacgccactgcactccagcctgggcgacagagcaagac

SEQ ID NO: 75014 - DNA, 1066 bp, Homo sapiens
ttgttgttgttttgttttgtttcgttttgttttcatatattttcaatctgtggttgtttgccagggatacagaacctgcagttgtggaaggctgactggatttgaaatttttcactctcacacacaaaactgatagagccaacaaaagaacgtctgtattacataaatgtaatgcttctacagagagtctttagacttaaaaatgagacccctcaaaaaaaggaactcctaatattagggctcatcttcacagagtttgctgctgtttgaaaatccattattaagtgagataatccattatcaatactcttctggagcaaacttgagaagtgtcagaaagagaaatggccaagtagccctttagtgttgttctcaatgttttgttctctttttaattcaacagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggcttactattcatagcagtttttaattactt

SEQ ID NO: 75015 - DNA, 1149 bp, Homo sapiens
tcagaaaataatgttctttccagcggctgcttgaacccgcttccttcagtgcctaaatttaacggctgcagctgcagctgcaacctgtttcccccgtaataggaatgaaagtggaggataaaagaggttaggaagaaggcaagccagcagtctgaccagacacaggatgcatgtaagagacttgttaattacacgttctatttaggtcacactgataggcaaatcgctattctgggcccccaggaagccttttcgtccttgctatagtcaattcattctccagatgaaagcctgaaagcgccacgacccaagtttcacgtctatccactcaagaggcctgcttggcgcaggcgcataccttcaaaggcctcccgccctcactccaccacccccttagggggcggggcctcagagctcagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtaggtgagtgaaccaggttcgcctgtgggccacctgaattgccctgtcatggtacgtgcctggagcgagcagacgcggcccgggtttagtctggggccgaagctgggctggagctgggaagggagaacggctgaagctggattgagctctgtggtgtttgcacccccgtctggacgcagggatcgggggcctgaaggcctgtctctgcagggcgagcggccacactgcgtagacccaatggagagttaaggaagatagggctgtaatgcctgactccggcttcgtgaggccccttcagttattgtattctgtcctggccaggcacaaggtctgtttctaaagggtaattgattccttaacgtctcaactaaaatgcctcctctccgttttcctttgtttgcagcatggacttctgtggttaattccacacaggcactcgaagcctgctatataccagacactgctagtcctaggagatacaaatgtgaatgttaca

SEQ ID NO: 75016 - DNA, 1113 bp, Homo sapiens
gcaatggcgcgatctcggctccccgcaatctccgcctcccgggttcaagcaattctgcctcagcctcccaagtactgggattacaggcatgcgccaccacgcctggctaattttgtatttttagtagagacgaggtttctccatgttgatctcgaactcccaacctcaggtgatccacccacctcggcctcccaaagtgctgggattacaggcgtgagcaccgggcctagcaccagcctagacagaatgattttaatctctgtgaataacacactccctctgctattcagggcattaattagacattgttaggaaaatgaaagtgaaagagtagtatgagcaagcagtatagtgaagagttcaggccctggagtcatacatggattcaaatctctgccctgctccatactacctgatctgggcacttgccaggtatgtaaccttagccttagtttctctttccaaagttgggctcataataattcttccttaaatggtggttttgagaattaaataaggcaatgtatgtagagtgcttaacgtgtgcctgccacatagtaaatgctcagtgaatgttattagatgcttgtttgattctttggcccccccttttttttttggtctattagattagtagctctgtatggaatatttccctttttatgggtccttccatgcttagttctccagtaaaatatatacataatcataatattctaaatactgtctgtttgtaaactttagaatcctccaaagacaaagcatggaaggattataggatgcaagttgttaacattgacagtaggaaaataatattttaaaaatgggatgatgatgaggggagattaatggaaggtaactatgctctttatcttccatacttgggactcaaaagataaatgtcgtctaaagttgatatatcaaaaaatagaggtagacatttaaagttataatgcttggccaggtgcagtgcctcacacctgtaatcccagcactttgggagggcgaggtgggcagattacctgaggtcaggagttgaagaccagcctgaccaacatggtgaaactctgtctctactaaaaatacaaaaaactagctgcttgtgctggcgtg

SEQ ID NO: 75017 - DNA, 1050 bp, Homo sapiens
atcacctgaggtcaggagttcaagactagcctggccaacacagcgaaaccccgtctctagtaaaaatacaaatattagccagatgtggtggcacgcgcctataatcccagctacttaggaggctgaggcaggagactagcgttaacctggcaggcagaggttgcagtgagctcaggtcgcaccactgcactccagcctgggtgacagagcgagactctgtttaaaaaaagaaaaaaactttattggaaattgggtgcatcagcttaatgaaaataatttcagtaaaatgaaaatggaagaaatggagttggtttaactgtgacttgtggtcattattattattttgactttgcacatcctggaatgctatatgagcattctgtgttcatgtagctctttctcattctttttaatgactattatttcattgcaagaatctacagtaatttattccaacttaaaaaaaactgttctgttttccagaatatgcttttaaggctattaaccagggtggccttacatcagtagctgtcagagggaaagactgtgcagtaattgtcacacagaagaaagtacctgtaagtaatactgcccaaatagttaataattgcagaatataagaatttttcagccaagtgcagtggctcacacctgtaatcccagcactttgggaggctgaggtgggcagatcaccttagatcgggagttctagaccagcgtgaccaacatggagaaaccctgtctctattaaaaatacaaaattagtcaggcgtggtggcacatgcctgtaattccagctactcgggaggctgaggcaggagaatcacttgaacctgggaggtggaggttacggtgagccaggatcacaccattgcactccagcctgggcaacaacagtgcaactccgtctcaaaaaaaaaaagaaaaaagaaaagaaaaaagaatttttcatgggtttgtagaaaagtgtatttttatatacaaatattaacataatcttgctttgaccctgctttcctgtcatccaagaagtgtctattgaacgtctat

SEQ ID NO: 75018 - DNA, 1010 bp, Homo sapiens
gggactacaggcatgcaccaccacgtgcagctaattttatgtttttagtagagacaggatttagccatgttggccaggctggtctcaaactcctggcctcaagtgatccgcctctcttggcctcccaaagtgttgagccaccatgccctgcctccttaatgctttttcttttgggagttactggatacttgcagaaactattttgactgctgatgaaaggctcagtataaaaggggagtactgtgtagagagcttcatgtttttaaatttttttcatatacttgttgatgagttatttagtattcattgggggagaaaaagccgtagcggaccctttctctttaactcatgtatgtctatatggtgggaaaattgcctggctaaattgcctggctttcaggtttgttctttccttctaaccaggtaaatctttgttttttatgctataagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtaagtatgctaagaggtctcccaaataattgatgaattgaaactttttacagaacatgtatacagaattatttaaataacacttgagttctgaacatgtggtttggaaaatacatagagtgggaaaatctttataataaatcagaactaaaggataggtttcacaacagtatgtcgggcattatctttaagctttagatgctgttagactttttatcaaagtatttccatttggtgtatgtgatttgaaagatgcaagtcctcattattaggatgttgtaatgaggttctactgcaattcgagattactaattccatagaaatacctgcatcaggcatcttaataatgtagctgtttgttttgaccaccctaaagaattagggtcacacacaggtgtgtaatt

SEQ ID NO: 75019 - DNA, 1066 bp, Homo sapiens
gagcgagagtctgtctcaaaaaaaaaaaaaaaaaaaaaaaaaagtgtttttgaagtttatttgaccaggcaacatcttgaaggattagggttcaaataaacatgcttggataacagcaaggattggaaacactatttttaaattgtatttgtaattattcaaactattttttttaatctgtgataaatccttttgtgaaatgggaatttacctgttacctaatttacctgtggtgataacctgtattttatcagttttcttaaaggaaaatacatatcctaaaattgatggccaaagtcatgattagcagcagctatgtgacaccaccaagaaagaggagatgtcattgtataaagctaaaacatttaattagggtcttttctctttttaggtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaagtaagtcaaccaaaaggagctgactttttttatgctatatagaacagtgaggatctttgtataatttctatacaaagctattcctgaattacatcccaggattcaagttgtcaacttaataatgaaattgatatcatacagctgacataggaaaatttgagttgcttttattcacttaattccttatttcgtaatgtatttgaggtggctttcaacaaaacgcatataataggaaaatataaataaaaataggaaccagctgggcatggtggcacacacctgtagtcccagctacttgagaggctgaagctggaggactgcttgagtctaggtgttcgaggccagtcctatttactgccaagaaattaaaaacaaaaattttagtagattttgggtgtaagtctggaattaaagccattctgaagatgctaacaacatgcttctgataagtgaccaaaaaaaaattaccatctaatgcttttacgtttggtttgga

SEQ ID NO: 75020 - DNA, 1194 bp, Homo sapiens
ttgcagtgagccaggctggcgccactgcactccagactgagcgacagagtgagactctgcctcaaaaaacagaaacaaaacaaacaaacaacacttaaaacattcttaaatcgtttttactgtaaattccttgaagatgcagagagtatcattcatctttatccttttcccatttcaccccaagtgctaagtgaagtgtagtgcctgggtcatgaagccaataaacctttttgtataaatcatcctattttaattaatggacccctttattatttgacttggtagaaaaaaatttctcatcattgggaggcaatacattagagttaagcagtctgttagtaacattgaactacctcattgaaacatggagctcctgattgactcatgatttgaataagctaggaatgagaaaaccttggaatctctaaaaaatactatattttaacattaaatactttttttcagactgcaattacatgcctgtctactgttctatcaattgatttcaaaccttcagaaatagaagttggagtagtgacagttgaaaatcctaaattcaggtgagtgatattgtgggccacatgcagactagaaaggtggaggcgtgtgagtccatgtgtcctataacttgtgggggaaatcttttttctttaactgtcattatagtttttgtttgtgtgtttgtttttttccccagcacctgagatctgtttttaaaactttggactctatttaagagtcagatatgaaagcttttctccttatttcagagtgattttatatctaacaccagagatgacataaagttaccttccttatgtaaggaaaaaaattagcataagtgttttcttttttttagtttaaggccaatacaaattcaattcccaaagtagtagtttgcaagtttttcagatagaactttggttatttagtggttatttaagtagaactttgaggagcaatatgagttactgatatatgtcagacccttatctagagatctttggaaagcccaaattttgaatacagctaattgacttgcagttgctggatgtgtgtgtgtgtgtgtgtgtgtgtgtgtgtgtgtgttcttactcactaagtgactaactcccacacatcagccttatagcttccatgattcaaatccatactgagtgcttcgtataatcagctcatttaatcctcccagca

SEQ ID NO: 75021 - DNA, 1058 bp, Homo sapiens
aaaaataaatgcattttgacatagaagctaaatagaatactttatagtttagctttatttatgttattcaattgaaatattttctatcttagctgcaactaaagaattttattttcaagatacaattctaaatctgatgtcaaagtaaacatttttgtgtataggtgaaggtggtataatatctgggaattccttcaaaataatctgagggaagataagtgtgtgtatagattttttaaagattggtttataaattgataattgttaaagtaggttgataggtatatgggagtttattatactatcccacttttacgtgtgtttgaaaaaattttttttaaatcgttgtttttttcccccttttgccttctaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcctgttgttttcacctcctattttaaaatttatttttgacacctaatgtacatatttatggggtgcaatgtgatgtttcgatacatgtatacattataatgatcaaattagggtgattagcatatccatcacctgaaacacggtgtttttgtggtgagaacatttaaaatcctctcctctagctattttgaggtacacaataccttattagttttttgttttttaaaacaagatcttgctctattgcccaagctagagtgcagtgccatgattatggctcactgcagccttgaactcccttgttaagtaatcctctcacctcagcctccttagtagctggtactacaggtgtacaccattgtacccagctaattttattatttttttgtagagttggggtcttactatgttgcgtgggctggtctcagactcctggctagcattaagcgatcc

SEQ ID NO: 75022 - DNA, 1905 bp, Homo sapiens
caggttcctgcacttggccatcatccatgaagaaaaggcactgaccatggaagtgatccgccaggtgaagggagacctggccttcctcaacttccagaacaacctgcagcaggtgcgccgcttgcctggcccgggttctctctgaccctgggacgtagctgatgtagcagagtcaccccagatcctttctgaattcagggccactgagcactatttaccctcaccttttacttcacatcagcccacatcctagagagtgaaggaaattccactgatttggtgaggtctttatgacccacctggagcctctgctatttgccagccctccccacccccctgtctaggaggagcagcacccaaccaggagacacgggttgaggggaactcggggtgtgggtttggtccatggcttactttctctggtctctcttgcattcgtagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggtatgtctgcctccctgccctgccccaccccctcggagggcaggtgacgtggagaaggggcaggtgggccaacttaaggagtccaggcaagagcttaaactcctaacatttggaaggttgagaaaatatgtgtgcaaagtgcctattggatgcctttataaagttctttcagaacccagactgtgggttcttaaaattcagaagataagactacttgttccataaaagaataggtgaaaggagtgagggttgaaacaggtggttatacttttttccttttgttcttccaggccacacgtgtctacacttagcctctatccatggctacctgggcatcgtggagcttttggtgtccttgggtgctgatgtcaatgctcaggttggtgcttcctgcccccgacgcactgagtcaggctcctcgtgcttatgttgtgagcagaaattccaaatgcagccataagcatctcaaattccttttggtttcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgaggtgagtctgtgaactccttcggcgctctaactaatgaggtgccattcccttcaccctcccaggcccctagagctgctccttatcagaggggtatctacataatgagtctctcaaatttctgtgcataaccagtatcccaagaatgtacctgccccccctctttttttaaagagaagcattaaaggcaaactctctcagcctgtaaagttcattatatttgggctatggagaatggagtccaagagttatttccagtagtggcctccccatcccggtagcttggcagagctccgctccggaagcttaacgtgtcttttttccccttgttttcagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgc

SEQ ID NO: 75023 - DNA, 1008 bp, Homo sapiens
aaatacatctgaagtgataaaaagcttacttcaatgccagccttatggctagtgacaggcagaacaatgccgccccccgccaccctctgcccccggatgtcttagtcctaattctcagaatttgtgattttgttaggttatatggcaaaagggaatttaggctgcagatagaattaaggatattaatcagacgaccttgagataaggagattagcctgtcttagccaggtgggcccagtgtaaccataacagtacttataaacagaggagggaggcagaagagaaacagggaaatggcagtgtgaaaaagacatggcctgatgttgctggctttgaaggtggagggatgaggccacaagccaagggatgcaggcagcctctaaagtgggaaaaagatcaggaaactgagtcttctctagagcccccagaaggagcacagttctgctgcccccttgatttcagcccagtgagactcattttggacttctgaccttcagaactgttacataatacatttgtattgtttaagccactaaatttgtggtaatttgttatggcagcaatgggaaaacttatacatggattgacagaagggaagctgaaagtgaagaggcaagtaaagatcaaggcactgttacacacgggcaaagcagtagacatggaatcagaaattcccagttactgttagtatctctgtaactcaattacttaacctctctgtgtgtcaatactttcatctgtatgaagggctggtacttcctcagatggctgttgtgaggaggaaatgaatcgatgcgaacccttagcacagtgcgtttggagagccctaacacatgtgcaccgctgttgctgctgccacatgccatcactacgactgccacagggttaatggtggttttttgttgttgtttaatgagtaggtgtttatttacaaaattatgtgtaccatatatacataattcagacaaaattcacaaatgaaggattacagattaaaattacattagc

SEQ ID NO: 75024 - DNA, 1031 bp, Homo sapiens
gccactggtaccttcagaaacattagcgcccacctctatggcttcctgaatgttgctaaggtctttaactggcatgatcaatttctcgggggtcttacattttgttatataactaacttttcctcaattatatacattacacatattgctggtagaaaaatctggaaaagtataaaagaatgaaaagcaactgcattcttcttatcaaagaaaaccactattattatcttgatatatatatccttccatgttgtatatacatatatagttgattctcattatcttggtagtcaagctttataaaggcattgggaacaatgaattagcaaatagccgttgttcctaggggaagtatagagttaggttcctgtgaacctctggtcataacattttcatcaactgatcaatacataaccttgattatttgtgtatttatgtttaaatacactaatctatattgttgattcattaacattgaactcaaggctaacagcactatcactcattcctgaatgaaacttatcttaacacaggtattttctctgtaaagcacatcacagactctttaactgagaaacacttgacagtacttcagcattatgcttgggggtattttatttatttatgttttgaggcagggtctcactgtcgcccacgctggagtgcagtggcatggtcacagctcactgcagcctcaacctcctggctcaagagattctcccacttcagcctcccatgtagctactacagggatgcactaccatacctggctaatttttttttttttttttttttttagtagagatgaggtctcactatgttgcccaggctggtcttaaactcctgagctcaagcaatcctctggccttggcctcccaaaatattgtgattataggtgtgaaccactgtgcctggctggcttttatttttttgggacagagtctcactctgttgcccaggctggagtgcagtggtgtgatcttggctcactgaaaacttgacctcctaggttcaagtgattctcatgcctc

SEQ ID NO: 75025 - DNA, 1070 bp, Homo sapiens
cctgggagataacctctaaacccttggaatatcctgcctgacaagaatgtctgtttgtgtttttcttttttgagacagggtcttgctctgttgcccaggctggagtgcagtggtgccatcacggctcactgcagcctcgacctcccaagctcaatcaatcctcctgcctcagcctcccaagtagctggaactacaggtgtgtaccaccatgcctaatttttgtattttttgtagagctggggtttcactaggttgcacaggctggacttgactcctgggctcgagagacctgcccacctgaacctcccaaagtgctgggattacgggcatgaaccactgcgcctggccaagaatgtctttgtatagtgatcataggccatgtcagataagttacacttgtgtgatttatggtgaacacctgttcttgtttacctagggcccaggaccatactgtatcagttaggcatctgaggacctggagactgagtagctaaggtcagtcacataggtgctctgtgtaatatactgccctttcctcccaaaaaaaccttggacatctaggctcagatgagtctccctggttaacaatactttgtacatattgtcacattgtagctgggagaattcagagatctgctgggagagtacaactcaaagcttgcacttggtttctcctggactctgcttcatgcacctttctcctttggtgattttaatctctatttttttctgtaataagccctaatcattagtataacagcttttctgagttctgcgggtcattataatgaaggattgaagctaaatgtggttttggggaccaccccccaaagcagtctattatatatttatatacacatgtaggattatgtgcaccaaaacatatataatgtattttatgggagatttaagaggttttcaagggtaattggctgtattatacttgatttttgccttacattctatttttagaaaccaatccttatcagctgcaattccactattaaacatctttttgaatgcttattggccatttgaatttcttcctctgtgaattgtctattcacgtt

SEQ ID NO: 75026 - DNA, 1258 bp, Homo sapiens
tgctaatgggtcttgggaaccttctgggattatgaattcaagtttacagttagggtttctgctttgcaatctcaaatgtggtttacctggaacagttagcatttcatcttaaatggtatttaatagaacttgggagctcttcagagcaggaacttcaatttttgttgttgttgttacctattgcaaagcactaaattcactgctagagaaaactagcagttacttttatgtgtacatcaaatcgttctttacaatcagatagagatcatctctaacatttaacaaacaattcaaaaaggcacaaagtttaccacattaatgtgtgtagaggattcacaactttaataattaagcaaaatctttgatacttgtatgaagagaaggtagacaggataaacaacaggaaaactaacttatggatttctttaaatagtggatagggacaattcattccctcagatatttgtaataaaattttagaaccagaaaatatctacctaggaatactaacgctcaaactttagcatgagattgatctgcaggtctgagctcagctaacaacttgtatactgtcaaagcagagactgccctttcaaacctctccttgggaaactaattagcagaataataaaaaggcaagatcaactcttgtcttccttgttggggatataaaaaaacggtagttctaattagcaataattaaaatttaattaagaagctctttgcaatcctcctccctgcttcctgaactagtgcttgccagctcttggttgtggagctgtttttattcccgtggtgctgaatcatggcttaatcacaaagccttagatcacagcttatccagccctgagcactcatcaccacagccttccaagagtaacaaatatatattctagattttttaacccaagcgattacttttttcagttttataatcatgaattatgactttttacttttaagcagctgattatagatgccattatagatgattatagatgaataaaaattgctttttatttttaaacttatctttatatttgttcccctagttctaccccttgttgcaacaaaaggataggagacctccaagaatattaaatatttgaacccaaatttctacttctgtgctttaaagtaaagcaggtaattagcttaagtataaaaaactaaaacattggtaaaaccccagattttaaaaataaaagtatttgattatataaaaataaaacagtacattgtagatgaaggttaagga

SEQ ID NO: 75027 - DNA, 1134 bp, Homo sapiens
tgaacctaacaggattctacatcaaggatgattatttttagatcaggcaatgagctgaacttctttggtcccacatgctgagctgcaaatatactccctagtgactttttatcacttaaggtattctgcaaagtattctctaatcttcctaaaaatactaatcctgagtacaacatgaagggaccagaaagcaaaaatgtatctgtttgtcaacaatgtaataattattgtctctgctccttgataataatctggctggtaataaacctttgatggcctctgatcctggcccttcaggatgttgatttctggttggaaaagttaattctcctggaggataacaagatagaaaaagacagtcttctatttacattcctctggcagccaggtttaaacattaaggtataaaacctcccaaatctcctcaaactgtgtttgtttttgtttgctacagcctaaaaaggaatccttccttttttcttttatttcagaagccttttccattttggttggtatggattataatgttaagaaagtactgcggattatttgggtttagttggaagaagagactattttccatctatttctttctttaatctcttgtttttttggctcttatcctcaccactctacagaaaatattctaaaattaactgctcctggctaaacctaatagtcttttttttccccttggcacagtttttttttcctttttattttgaaataattatagattcataggaagtcatgaaaattagtagagacagatcctgtacacccctcccccagtttctcccaatagtaacatcttacataataaaatcttatatcatcttatataaagaaattgagattttaccagttttacatgcattcatttgtgcatgtgagtgtatgtggtagttctatgcaattttatcatatgtgtaggtttgtgttaacactaccacagtcaagaaacagaactgttctattgccacaaagatcccttatgctacccctttttacagttatacccactccctttcctctctacaaccccaggaaaccactaatatgttctccatctccataattttatcattttgagaatgttgaataaatcgaataatataaataagtaaccttttg

SEQ ID NO: 75028 - DNA, 1045 bp, Homo sapiens
tagtttgaagtatcaatgaggtgctacattggctaacaaatatgctgaaagtctccctgtaaagtaaggacatgtatgtgtacagttaaacctgcaacctgtgtggtgtttttgtttgtaaaacacataaagaaaattttcatgtacttaagacccagaaaatctggattaaaatgccttaaaatatccagaatctcttgctgttattgttttcagatttttttttctgaaggacttttatttttaatgtgattttaattaattactcattttgtttaggaaatatttgaaagcctacagtgtgcaaggttctgtagtattgctgcatattagagaatgataatttatagaaataaagcacagagatgaaaaactactttataaatgacacaaagaactttcctatttgattttgttttacttctaaaattgtatatctactaattctactggttacctgcttgcttatgattgaataagatacctgcaaaagtttaagttaatgaaaacaaaagcattgtttatgtcttttaaattaagacattttgggggagtcagtttgcctttttttaactgacattcagaggagaattcttgtcctcccctcatccacaaatttatcttgctccttcttaaagccgtctttaaatacctagcatgtatatgatctcatagtgctgagttcctttttttgttttgttttgtttataagggcatctagtgaaactgacttcctttttgaaacccgtggttccaaaactgtttggaactgtttggtgctgtttttcaagtttgagtagtgaaggctcttttcttggttgtaccctgaatcctagagataggaattggtccttctcacctgcttcttgaccccttccctgcatgctgatggtgctttggatccctgttctttctggctcaaagattttgcttcccactgctttttccagggttctagccctgggaatgatgattggcgctttcttgctaatataatgacatgagccaccagattgctgggttttaaatacattagtaggctatt

SEQ ID NO: 75029 - DNA, 1071 bp, Homo sapiens
ctatggtgatggaaatgttctatatctgcactgtctaatgtggaagccgctaactacatgtggctgttgaacaattgaaatgtggctagtgtactgaggaactgaatttttatttaattcattttaattcaataaatttaaacttaatgtggctgtggctaccacattggacaatgcagctctagagattttatgtctgagtgattaggataacatgccaacagtacagtgaacactttaaaaggtagatatttacagaatctctcatagaccttttttcttcttttcttttttcctatttgaacttgttttgttagttggtaagtataacatttgaatttacaaagcattgtcattgtgaaccatcaccctaatgcattgcatgcccaattatatttcataataaaaaccttgattcctctctctctgctcctcagttaacacctagaaaattctgcactgtgtctctcatatctgttatctatcttctcttttgctttctcacttctgcttgctactccatttcttcattcacaacaaagaaagaaatgcagtgatagttctcttcctcccaaaacctccgctagaaaacattggccatctcaaggtaaacagcaatgggagggcctctcgtgatggccgggaatgatatgcattaccagaaaagcatgagctactactgctcttcactttccttctgccatccatctgcagtgcttccctaaagggggtcatggattcatattctcccataaattttccagtatgggtctgctatgaaccaattcagatcttcaggaagagtaaaggtgaacagaaatatgtttccttctccttgtattttgaaggccagtcttatttcaattagaaaataatgctggaaaagttactttgagaagaagggcaattgacctggattatgagtgacagaatatttttccttggaaacatatattttttcttaagtataactctaacatttggtcttaaaaactttttgaaggccgggtgcggtggctcacgcctgcaatcccagcactttgggaggcccaggagggtggatcatgagat

SEQ ID NO: 75030 - DNA, 1051 bp, Homo sapiens
gcaaaacccttctctactaaaaacacaaaaattagctgggcatgatggcatgcgcctataatcccagctactcaggaggctgaggcaggagaatcacttgaacccgggaggcagaggctgcagtgagctgaaatcgcgccactgcactccagcctgggtaacagagtgagactccctctcaaaataaagaaataaaaataaaaaataaattgtgttatttcctttatgatattcagtgccatccatgctaatcttaataacttatcaactcctttaaaaatattaaaagcaaggttatttgggtagcctttaacctttaatataaggttatattttataggactatcaacataagagaggataaatttccttcaaactaaatttaatggtatgttgtgcttttcacatttgaacaataatattttgtataggtggtcattttcttcaaaaatgttcctcatttctatcccttcgtttctaatcctcatctgttctgattcaaaatgtatcagcttttatttttctctgtttaatagcattattatgtagctatacttactgtgctcctactatgtgccaatatctttgcatatgtaatcttaatccctgggatgacttgacaaaattgcaagtattagctccattttacgaatacaaaaatgtctcaagtcagtttgcccaagatcaaacagctggtaaagtgacagagtcggcatttaatctaggactgtctaacctatgcccatgttctttctaacaaatcacatcgtcgctggagttcagtattaattgaaattgcttttaaagatataatattttatagggctatatctgcccaataattagcagctttaaaccagtcatacctgtcaccaaacagtacaaacgaaaccacaataaaaaatgatcttttgagctccctcttataatccctatatatcccaaaagtcatatccattatgttaattgtaataatagtttattgtaatcaatgtgcaatatatgaatcaatttatcccatcagattacacagtctgtgtgagcactgtaa

SEQ ID NO: 75031 - DNA, 2070 bp, Homo sapiens
cacttctgagacattaaaggatgctacagcagccaagtcagggttctgttggcttcatttttaatgtgtcttacaaaattattgtgtaagttgtttaaaataacacttatgattgtctaaatagtagtaaaaatgtgaatttgaacataaacctaatattgtgctacagattttttcagttaatttttaagagttgtcactgcatttaagaaccatcctctaattttaatatgcactctgattttcaaaagggtgtttttgcttgtaaataacttgtgccagtattactgaatacgtttctatataagtttttgcagactttaatagttatgacataaatttttatcagagtggttctcagttcaacacaaaataaaaatgaaatatttactcttaagagtagcaaaaacatagaatctgaaaaataatttttttccagttatctcaaatcttaacttttctgtcataagtcccatacatatagagctccctttaaagttataagtcaaagtggacagagaagacataaaataagctgtataatagcagtttggacctgactgctggtttgcaaaaatgacataatagtgtaaagtttttaatctttttcctagcagaagtataaaatgtgttcaccacattgaaaaaatggattcataattgcaattgaaaaatcaactttagatatcctgtgcacaccctatgtatataaaatagtactaatcaatactaatatggtcatttgaaattaaattttaaagaaatgccaaaatggtgattatattctgtctaaccaaccctataacataattatattcagtggaatagtatagaaaaataatatttattattattattattattacactttaaattttagggtacatgtgcacaatgtgcaggttagttacatatgtatacatgtgccatgctggtgtgctgcacccattaactcgtcatttagcattatttttttaagatttcttaatttggttcaagattatctaaagcccactttctggttagcggtaacgtgcaaatcaactgtggtgacatttaaatccgagaaaacatttttccgtattactttcagtattattaaaatagatatgaaagattttggtgcatcatagttgatccataaatttcataactgtattttctcaaaatgtactgtctgtggcagtagactgatacttaagggaaattatttttatccctaaggtcattgagggaaatatcgtgatgtcacactttgttgatctttcataactacgttaaaatattattagatttttcttgtcttttatttttaaaaaattacaggaaaaaatccctttatctttgtcaggcatgtgtgtggaaaatatcaaaagtttttagtgacttcttaaagttttttcatatttacaaatacctctcctttaattataaactttaaaatgaaattactgctcttcttggccagattacactgtttgttcatatgtacatgtttctcccaatgttatattgtcttttcaatattatctttttttattttgtaataagagaaattctagaatgacaacaagaaacaggatcctgttttgctgaaagtgtatagtaaatattaattggtttaactttctcaatttcaacattaaaaatatactcataattttttggagtattatgtctttaagttacagattttagttatttacagttaaagtgttgataggtgtttctgtctttctgtattcatatacatatatatacatacacaaacatatatctatacatacataacactttttataattacttttggagaatataggggttcctatttaaagcaatattataaaattaataaaattcaaatataatttttatgataccaaattcagagataatcaagagtgactatgaaaacctagagtagtatctagtctgccttctaacctcagttgtgctgttaatttgcaaaatctatattcccatatgtagataggatggaatttatgatggtcagatctatttctttgaatctttgagtgggatggatcatcaaaatttagccattgc

SEQ ID NO: 75032 - DNA, 1034 bp, Homo sapiens
gtgtcaaccaaaacaccctctgttcttctcccatttccttttttcaaaattagcaggctctaagcttgtaacttaaacaataagtaaacttaacactgtccggttcatactaaacatttcagaaattgtcactaaattttttccagtattatactgactaacccaggtctgcatgaaacactaacatggtttggggataaaaataactaataatagaatcccttggttgaaattagttacaccttgttatattgaccttttttttctgtttctcagcatgaaaaagtagtactattgaactgaagtagtgtgtctttgtattttgtgatgtgttgcattgttattggatatcctaactcatcaaatgataactctctgtgtgccttgcacttcactaggcacctgaaatacaaagatgactgttgtaatggtattcaagggaagcaggaaaagaggacataatatgcttgaagtttatcataataaaccttcaaatctctttatattaaataagttttctttatattaaataaattcaaaaggcacaacacttcttttctagcctaatttatttggaaaaagttactgtaattctcaattgagatttagttagtgaaattaaagtttccattcctgtcatcattaaattgctattagaaaaataattttacaaaaaatttagatcgctttcagatagtataaaagacctagcaaagacaaaaccgtattaaaccaggttgaatcttttgaaagagataaaaagtctaagattcactttaatggattgacactatccaaaattacccagtttggcattaaaaaagatggtaaaagagaaatattaaattaatgaacagcaaaataactaattaagtatatctggcaattttcttgtttaataatggagaatgtccgataaaatgtcagattatattaaaagagatatgaataacacttgtgtatcctatagtcaagccataaatttcacaagtgaaaaatattgataatagaaccacacttggactaactttccc

SEQ ID NO: 75033 - DNA, 1024 bp, Homo sapiens
aaagaagaaaggatgtaaagcagaaattagtctttaaacatatttgacataggaattgaagtggttttcattcattcttttcattgactaaacataggccttttgatattaaatttttaataataatggaattaaaattaaagtatgggtcacaaatctatccattttcttctaactgctattcctctcaaacactagaatagagcctatttaaatcttaacttttgcttgccaaaccactgttaccgcccatctgttcatgccaattgtaaagaaggttcagtttttagtgaagctttgcatttcacataaggtatgtgaagtgaaatttcacaagggacatgatggatcctgattcttagtgataaacctttggggccatcagggttggcatatggtccagtatgatatgaaggcttgggttccctggcttcacttctttggcgtgaagctgataaaacctggctcttgagtattatttcactggacaccaatcatgggcagcaggaactgcccatttaactctctgtgggaaggaagcccagagagcattcacaatggtaccattgtcgagttgcaaactgctctgaacagcttgacagcactagggaggaggggaaggggttgctttactaattgctgttcagaaaagagaagaagcaaaaatagctgttgcagaactgatgtttctacatttacttactctcttgctaagaatgttgacttatttagcatgtaactactatcaaaaaagaaggcaaatgaatataagcaaccacctgtagtaattccttattaacatgccattatctatttttagcccatcagattattgcagagcaaaagtcagttttgccttatttttttattagatgaaaataaggaattttttatcttcataatttaattgaggtgaagtggataaaatcgtcacaattcacatgtcagataaggttataaatttggtttaatttacactttgctttttaggattcccaaataccatctgaatacatataaacga

SEQ ID NO: 75034 - DNA, 1090 bp, Homo sapiens
gggattacaggtgtgagccaccacgccctgcgatgttaccgtattttaaaagtactgcatacctttaaagatggtagttttggtctagcaaatccttgtcctttcaaaaagcaataaatgtgaatctctgatatgtaataactttgtgataatagtaaagaaagtttattctgtctgaaaatagcattgtctcttaatggtctctagagacagtctttaaggttttactaatattgaccaataattacttacagttaaactgtgggagctcacaaaaatgacttcagtatatggccaacttccatttctgttaacattgttttaattctagagatattttcaatttttatcttctaccaagaacttaatgcactaatgataaacttaagcaatttggggtcattcagcaatagtgatatagaccaagtaggatggtaaaggtgattaattttaagtgggagaggatagggtgagaggatgggatggaaattagaggaatggctttactatggaagaattctgctaatatttcagagacacatggaacttttctagacagatatggtcagggaagaattttttaagggtaagaagtggacatggaggcataaaaatgtgatatggtcaagagataaaaggtgttcagtactgctggatgatataaagggaagagcagtggcagataaagatcaagaagtaggtcaaaaccagataatacagtcaagcagaaagaaaataaacataaatgtggttttctaatgctactgattgttttatggcagccagtgtctaaggtaacagttccttctgctattgtgtgttttttacccgttgactagcgaaacaattacagcttgaatttcttatttttcattttctagcgaagcctttccaaaatgtttattgatcgttattttcataaagtcttttttatgataattagttgagcaataattgccaggctaatagccagtattgcattttctcaatgagactaagatctctaaatgtttgatagtatttatacatatgtatcatttttaaaagagcatctgagattttcatatttcttatgatagactcatgatac

SEQ ID NO: 75035 - DNA, 1054 bp, Homo sapiens
gagatcataccattgcactccagcctgggcgacaagagagaaactccatctcaagaaaatataggctttgcattagatgattttacccaactgcaggctagtgtaagtgttccaagaacatttaaagtggacgataagttatattccttataattcgggtaagttataatgttcagtaagttaggtgtattaaatgcattttcaatttatgatgagtattttggaatgtaagcccattgtaagtcaagaaacatctgtatactaaaagacttaagatggctcttaactgcttattgaaacaagtgtaaattttttgatgacctggaagcaattatttttaccttaccctccctacccttatgtttctcactgcagttttgtccaatatacctgtactcctccccagctccatcccccatctttaccctcatctcctaccacactgacgcccagggcaccttatgtgtccagctaagtcatattcattattcctgaatgctcttctttttcaggcccatgttgttaccccagtaatgcccatctctactttttctacctaacatatttattattcatgacccaaatatcctttgttttaaaagaaaaaaaacctcctttactatgtaaaactattatttacactgcctcaaaacattttgttatagtacttactgtgtgtgtatatattagcaagtcttacttaccctccttgtttcactaacttccagcacagtgcctagcctatggtagatggctagtaatttattctaattagaacaaggtggatgtatttattatctatctttttgaagtttagatttagcatggattcttttttttttttttttttttttttttttgagacggactctcgctctgttgcccaggctggagtacagtggtgctatctcagctcactgcaagctccacctcctgggttcaagcagttctcctgcctcagcctcccgagtcgctgggactacaggtgcatgccaccacgcccagctaattttttgtatttttagtagagatggggtttcaccgtgttagccag

SEQ ID NO: 75036 - DNA, 2266 bp, Homo sapiens
acagaaattgagatacaggtaggctttggaaaccaccagttaatcctttactcttcataaaagaaatgaagggataaaaaataataagcttgattatatttggataattgtactgctgtgtcagttattttatgcccaataaaagtactcactaagattccaaagcataaattgtgctatttatgatcattaaatacagtttaaattttatcctaggaacatgttctgaaaccatgaatctaatgttgttcactaaatggggacagtattgattgtcatatgctacccaaatcgatcataccagcagccagaattacagtaatctgtccgtattgatgactgtctttcaagctgaaacctctccttcgctgcacttgtttcttacattacttgtactggaaaagcattttcttacaacttctgattttgtcagctaggtactttttttttcaggcaggggaggggtctggagctcaatttgttagtttaatcatgcaattagaattgaaatgcaacactgtggaggaaaaccaagcagattctgtgtaaccattggaccagagaggtatttcagctttaatcctagccatcgtttattagttacctattgaaagagtgttcatggtttttttgtttctgttttttcagtgggaatcataatcccaaattattaatttcatgacctcagccatcatgattctattccttaaataaaaattttaaagcaattatttcttttgatcctaaagacattttgactatgacttctgaatatacaaatgttaaatatgatacttttaggtaaatactgtttcttcttttagtgagatttattatacatagaaatttgcagaatttacaatatataatcatgttgtagtagtgagggttctcagagaaacagaaccaataggatgtatatataaagagagagaaaagagatttgttttaaggaatttgttcatgtagttgtgggcgctggcaagttcgaaatctgtaggagactcggggaagagttgatgttgcagtctgagtctgaaggcagaattctctccttcctcaggggacctcagtgttttctcttaaagtatttaactgattggatgaggcccacccacattatagagggtaatctgctttacccaaagtctactgatttaaatggtaatcaaatctaaaatataactgtaacagtataaatataacagtattgtacagtaattaagagtataatatatgttatatattatattaatattataaaatataacagtagcatctagactgatgtttgaccaaaaactgggtcccatgacccagccaagtttacataaaattaaccaacatatcctgtttttcttttctttttatccttattacaaattataatttgagaaaatacataaatcataaatgtactaggtaatgaattattacagtttaactatcaacaagtcaagaaatagaattgtagtttttcttccttcaaaaatatttattgatcacttacacagtaaagattttgagagggatacaaagacaaatcagatagtaatcctgtcctcataagcttataatttaacaaggagagaataatatgtaattactaattataatagaagactaaatgaaaatgtcctggtagggttatagataaaatgctataagagttccaagggtgaagaaattactttggagtaagaagatcaggaaagagtgtttagaaaatctgggcctcagaaggtggggtttgagtagatggaatgcaacatgtctgttttaattcttgtaatttatagtcctaaggttttgtatgcatatatgtatattatagaagtataatattctgaaatatacagtatgggggatattatataattaaatggcattttaaaagaatactttattcctcgatttagaatattctttcctaccacaactagtatcgtttgatttcttctaatctgtttagatttgactttttcttaaataccagaattgggtttctatttaacttgatcagggagattaccagaagtcagtgattattcttcaattagttacagtttattctccctcaagctctgctactcaaatgtccagtacctgttgcaaagtaggaaagccaaaactaagtggaatggaattgatgaattgattggttctgctaatgcagttgcctttcgttataataaaacattataaaaccttttgggggggtctgtcagtattgttgccatttcacgttagaagaaaatgagtttat

SEQ ID NO: 75037 - DNA, 1013 bp, Homo sapiens
tgtagtaaagctagtgtcacaaaaataatgaaaaactaacttcttgcctataagtatatatttttcttttgttcactcaatggagaaaaggaaatttacttctagtgttggctttttgtatacaattgaaactagtaaaatttggaaattggctaagtgtgtaaattatttactcagttacatgaagcacatagttcttttgaatagacaccctataaacctttgacatttttattgtcctagtatgagtgacccatcacagaaaagaattgaattcaaatagtatttttactgaaggaagaactaaagaagcagcagaaatacttttggatgcaaagtgtcttgattgctcttatttacaatctgtctgtaatttgaatgtaaaattatgttctgatttctcaatcaggttcccttctttggtcccctttttgatggtgctattgtgaatggaaaggttctacccattatggttagagcaacagctataaatgcaagccgtgctctgaaatctctgattccattgtatcaaaacttgtatcctttttttaatgtaatggtttctactctaacgtatgtctactcacaaaggtaaatatttcttatatattgttaaagccttttattttctagggtttttttaattattattttttgtagaaatggagtatcattatgtttcccgggattgtctcaaactcctgggctcaaatgattgtcccaccttggtcagcctcctaaagtgctgagattacaggtgtgagccactgcacccagcctgattccctgtttattgatgtatagatggttcagttcctccccagtgttggagcagttatatttgaatgatatattttctttcacatgctttttttttttttttgagatggagtctcacttttgtcacccaggctggagtgcagtggcacgatctcagctcactgcaacctccgactctggggttcaagcaattcttctgcctcagcttcccaattagctgggattacaggcat

SEQ ID NO: 75038 - DNA, 1013 bp, Homo sapiens
tatcataatgtcatatctcattatgacagcctaaaataattacttatttagcatttgaatgtaaatgataagggatttcatgaagcttttcgcttaaaatgtttgaacatgtttagaatgactttgttatgtacatggttctgtgccagaaatcttcattacaacagcttggcaaaaatatgttgttcttttccattaaacttatttaacagacttttaatactatacagaagatatttgaacaagcttcagttataaaataaaagtatacttgcccttttttctcgtttctttagataagtgggcactagaaattatagatagttttggcaagagttcaagggttaatgtagcagataaataaaaggaattttctgtaaattgagacctgcattatttcagttgtcttgtctttccttacctaactcatttaattttaaaaagtaaatacctaaattcttcctgacagtgtgctcagcttttactatcgtttattacttcaattatacttgatatcacttagaacaatctgccatttggaaatctcagtatagcctggagcttagtattagatctggctgctattgtaacatgtacagcatatgacattaatgtatcaaaattagattggatcatccctcctggttaaatttatttcacatttcttttgtattcagttaacataaacctattagggaagctgacacatggggatggctgtataggaaggatatttttaaagtattttgattaaaaaatgaaattatgaagccatggcttttctgagttgtgtaatcttttttgctttttaaaaatgtcacaaagcccaagtcccacacatttatattattcaacttgtgtatgcatataaggagttactccaggattaaggagtgacagaagagaggctttcactaattggacttaactcctttctttgtttaaatcagatattaagttctttttcctaccctatgttcatccttaagccaaaataaatgacatatttctga

SEQ ID NO: 75039 - DNA, 1061 bp, Homo sapiens
tcacagatgaccatcttctcattgtaaccttatatataatagcagaagagtcaagtaagctctctggggtctcttttataaggacattaatcccttataaaggagcccgcataacataatcacctcccagagttccctaccttccgataccaacacactggggggttaggatttcacaatatgaatttggggggtggatgggatgcaaacattcagtctgtagcaatgggtgaacatctgattttcacagaagaacatggagcaggccatagactatagaaattaaccaacattcgtgagcttcatgtcagtgcctggcaaaataggattattaaacagatggtttgtgagcacttagataatgaagtgtagtgatcactaggagccaccatgagttcaccataacaaatcacatcaaaataacttaatttgttttaataggattactagattagggaaaaccatagactgcaataaagcatttaactaagttgcttgttgtggacaagttgaagaaatgtggtcttaataagagtttgataagtatattcatgagtgattgtataatcatattcatagcacataaattaattatttaacaagaaacaatatagggaggtggttacagtataggttctagaaccagcctgccttggtttgaatcctggctctgccacttactatttgtatgaccttaggcgagttacttcatccttttaagcttcaattcctctcctgtaaaaatagggataataataattattactacttcatagtgttgttgtggaaatttaatgaattgtcacaaacagtaagcagtaagcacttaataaatacctttaataaatatagggttttgtggatttttttaaccaggaggaaagtctgtaatgacttgctgtaaggctcttaaccaagcctgtcccatttgacatttttgtccaaaatgtaaatgaagacactggaatttgaacttaaggatagcccaaatctggcagagagccagcacatgaatagcatagtcaggctaacaatagaccttcataagcttaaagataatc

SEQ ID NO: 75040 - DNA, 1084 bp, Homo sapiens
aggagtttaatacctctaattaaattagatagtcgacagtcagtataaagaaatagccatgcctctggcaagctagaattatttatgactctggtcctttgctttaaacttggtagggtaaaatcatttatatccattttatagaaactaattttagttctgattttttatttaaaatatgtgatttgtaaattattttcaaacattttattttctcagaatgagaagtaaatatccttggacctatttaaatgtagcatttatatttcttgtgaagagaagctttttcaaggctcaagacagtagcagcagaatatttacaacatagactatacttcttgagcaaattagccaaacattcagtttagctaagtttctcttagaaatgttgcaccaccatataaaaatcctgatataaccccagtccaagcaatctgttctataaattatctcttcctgaggaagattgatggaaaatggttaaaaataatttccacttaactgagtgtattcacccctaaaaatcaaaagtgctgcaagcattggtataaagtgttcataggagcctctctcatttcctctgtctccttgttctagccacttgctgatactctgcttcataggtagctgaatcatccttttagaagtttgatgaagatcaagttgagataattgtaacatacttagttgaactctctagtctatgtttcatttcctggaccccccaaaatagggggaaagaagcactttatttaagtccatttcctctgaaatactattagtgtaatggaaagtgtttcattttctgtcttgaaatttactcacaatagttgtgcaaataaatgaaccttgtagtgctgcttggtctgattttttattttaaatctgtttttctttattttatacagaaatataagatactttccaaagaactatatgctaaatatagtctgaaaaatgaatttgttaaaaaataaatttaaggaataatttttaaattttttcattattttagtaaaagtgaagttaggattatagttaataagtgctgtgaaattatactcattgtttgagtcctaaatat

SEQ ID NO: 75041 - DNA, 1056 bp, Homo sapiens
tatgagtaaatacaacacaccaaattaatcattttgtcaaactgatattaccattttaacttttccccaaactatttccatacttgatctttttctccctggccttggtgtgctctgacagcctttataatttaccattaacacctagtaggctaacaaaagatgcatagtacacagcagttgatacctttcctggttaactcctactaattagaaatcctcaaatacttaaaaagtaccagtacaaacaaatcaattctaacaattctagattaaatattggttgataacatgcaaaagactttgttcccaatttttttcttaagcaagaagtttgagtctttctctgtagtgtatttgggttttgtttaattaatttatgtgactcttcattacttctaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaagtaagtgctgagaagtgctttcaaattaaaatgctcataattgagacagttaatacagaaaatacgtaagtaagaaatcgaattgatcaagcactgtttctggttgtagtacaccactccacccagtgctgtcttgaaaatagggtggttgtacagcaaactatgttttctttaagaaacaatgatatggttaaaggttgcagtctttttttaaaataaagtttattgtgtatatttagggtttacaacatgaaatgttgtgggatacatatagataataaaacggttactatattgaagcaaattaacatatctatcatctcatctagtttttttatgtgtgtatgacaagaacagctaaaatctacaaaattccaaataccatacaatttttattgtgcgttaaatctctagacttgttcatcctacatatctgctactttgtatcctttgagctccttgtcccaatttcataccccactccacccctggtaacca

SEQ ID NO: 75042 - DNA, 1108 bp, Homo sapiens
agccgtttattagaagagaatatcctctgccttataggaaatgttatatctcaggaacagtttgccatatggtatgaccaaatataggtaattgccactcagttatgtcagttatggtataaatgcattctactctcttttgctgtagaatggtccgtatgttgtcccttgggaaaaattaaagatgagaagctgtattttacttcagcaagcattgattttatgaaaataatttgtacatatttagcacccatggaagggatttggtaaaattattcactgctttgtagtctaaaaattataaaacaaggaagaaagaaaattccatctggattacacttgcttacttgataatgatatagattctgtgaatattttatttctcatgagatacaactttctcacatatttttatgagactcttgaaaagaaatacaaagtacttttatccattttcctggatatgagtttaggaggctcacaacatctgcaaggaaagattcaagtggccaattgatatgatccactagcagaaatgtatgaacacctggtggaaataatgacgtatattctttacattttttttagggtctgttctcctttgtgttagaagtatgaaaaggcaagaaaagtagaaaagttgcatgagtagagtggaaagtatttccgggactgtcttgtcattcactgcaaaggtgatgaaaatgtttataaatctctctatttaggaggagctttcatctcctgaagaaaaatgaaaagctacttagagaacttaggaacttggattcaaggcagtggtaagttgttggaaaatcttcacataactagcaactctcaggtatttctcttttagaataatactgtgaataatattttaaatagtatataatactgtgttattgatttataactttctgagcaaaagttttttaaggaaaatttaggactgcatagaatgttgggtgtctttgaattgtttatgcctttttttttttttttttttttttgagacagagtctcccactgtcacccaggcttgagtgcagtggcatgatctccgctcagcctccggagtagctgggactacaggcacccaccaccacac

SEQ ID NO: 75043 - DNA, 1106 bp, Homo sapiens
tttcctccttttttgccatcattactgtattatggaatctaaactggaaatattaacaatgtgataaaatccctatttgttgtctaatatttcattgtcatatgattccctaggaagcagcaatattcccattcatttatattttttatttccagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggtaagcataagggagaaattttttctttttttttttttttcggtcttattcatcttctgataaagcattttattttctgttcttttcct

SEQ ID NO: 75044 - DNA, 1018 bp, Homo sapiens
ggtataacaagcagtataaagcaaaaaacaattagacaaaatttatataagcaatttaaaattatatttttagatttgacgtaataagataccatgtttattttacttaaaaatatggttatgtgaaaataatagttgacctttgcacatttaaggtataaaatggcagtttttattcaagacaatatagtatgtttcttgaacaaagcaatagagtttgcttatttcaaaggaagttttaattttagattttgtacaaaatttactgtgccaatatcagtcactgtaaaagaagcaaaggaaaagatgtaaatagattagcttaatattgatatcaaatactctgtgcagtacccttctctaaacgtatcaagttgttccctttggacttcctcaaaggttttaaggaccagataaatgcagaaccttttaggaacagctgtgagctaacagcacatgattctctggtctgtagtgactacatgctctgggtgttttttaatgtggtgaaaatgagtgatcattgtgcccttgtctaaggcatgtttcatcatcttcaagtacttttttggccaaagaattctaaacattgagtgtccctaataagctcagtactggattgaacaagtctgatttgagaactattgtcaggagtggctgtaattattaaatttactaaagaataaagcaaggtagtgaagttggctttttgtcaaatggcagtagtcttattagcaaaaagtcatcatttgccgggtcagagtgaaaggaggctccaaaggattcattctgtcctaattatagtttcacctatacttattatgcaaagctaatatttaaagcatttgccaaaattaacttcctctgcatgttctattacagtgcagtgaattgcagcagctttttatgtcttgctgcttttgtacgccataataatctgtaattatgggtttgctgcaaatgctgtaggatttgtttaatctgacaatctgaagagacaaccctgaatagagttatt

SEQ ID NO: 75045 - DNA, 1758 bp, Homo sapiens
ctacctcatccggcctccatttttagccaagaatccttcgctttagtgtcgcaggctatggtgtagaattccaaatccagtttatgaataatttctggataactacttgttcatctttttctatatcatctttgtcttccagaagtctagctattaatatgaaaaagctatacttctaagtttttgttttcttgcccactaaatttattaaacatttatttatcataaaatatgagtgtggcgttctgctaggcactaaacagaggtaaacatgatactccctgttctcatggaatttaaaaattagagacacaaatgaggcaacacaatataataaatagtataaaaagtagaaaaatgtatgagatacaaggtagaatagagaaagaagtaattaactattggggaaaggcatatttaggaaaaattcttttaaagttaaatagagacataaatagagacaaacagtagaatcagaaaattattccaagtggtatgaatagcatgtgtaaatctggggactataaaatagtatggtttgttttggagaaacaactaggcagttccatattttagaatgtgaagtggacagttaagagttgggaaaataaagtttctaagataggaaggggccagattataaagggccttggatgccacactatgaacgtggtacttctgtgaaagtgacttttttgaaaggtttttatgtaggataaaatatgaccagatttgtgaaaaatcacttgagaaaatgtgaaagttgacttaaaagtcaaaatatggtgattattattaaaatcatctttataagaattgatgacgttctgagctaaggctaaaggaatagagaatagatactcacaaagtagaacccacagccaaggtgaggaatacaggaaagagcagctttgttggagcagtgagtttcagttctcagtttgttgcatataaaaagtaatctccaggtggagaccaccagcaaggcaattatatacctgattagaaaatttgatgctggaaataaaattattggcattgtcagtacatgagtagtattaacattgtgagaatatatgaaatcacttaaggcgatatagtagagtaagatgagttagcaaagtatagcacattaaagaataacagttaaggagaaggcagagaagatgattcagtaaaagtgactgaaaggactagtaggaaaggtaggaagaacaccaggtctaggagagagtaatcacatagaagacaatcaaatcatcccgaaaatgcttttttgatctcagactttattcactgttttttttgagacagggtctcactctgtcacccaggctggagtacagtggcgcaatctagactcactgcaacctccacctcccacactcaagtgatcctcccacctcagcccccaaaatgggaccacaggcgtacgccaccatgcccagctaattattgtatttttagtagagatggggttttgctatgttgcctaggctggtcaggagctggtcacttcagctcaggagcttgagctgaagtgaaccgcccgccttggcctccctaagtgctgggattacagatgtgagtcactgtgcccagcctatcattcactcttcttcttcttttttttttttttgagatggagttttgctctgttgcccaagctggaatactgtggtgcagtctcggctcactgcaatctccgcctcctaggttcaagtgattctcctgcctcagcctcctgagtagctggga

SEQ ID NO: 75046 - DNA, 1035 bp, Homo sapiens
tttctgttggattttaaaataagttacataaattttatgttctcaatttgttttaaaacaatttgtagctaggtgtgttaaatttaaaagatagaaaaatatttaacatattccatcagcttcatgtttttacttaagttcattttgctgttatcagtcaataaaattacactttccattttgaaagcaggttacattttgtttaggaagcttgatagcaatgtcagtctaacagactaacatggatttttaaaaaacatgttgtgtggtatcccagcctgtagtcttcttagtaaattataatagaaaattaggctcagaagttttgggattctgctttcttcatactttctcttctttggttaccagttaatgtatagagtaacaaattcattaattcatttaaaatagtgcatgttcattctgtgtcagttgattgtgggtcatgtttgtggtggtggtttcattttatgtaaccgttgttgtttgccttttttgcagatgtgtagcactttgtagtttaggtatttggatttgtgaagaactagtccatgagtctcatcatcctcaaattaaggaagctctgaatgtgatttgtgtttccttaaaggtaaagaaaactgtttagtgaaatatattaagataggagagaatgcatatttttttctccaaatattaatggtatcttgtgtaacatttagtaaatgttttcattactttattattctattattttcttgatcctgactcattccttaaaaattgttctgtttcttgaatttagggtatctttatggtgacccatttttatctcaactttttatgtattttagctttgtccctaaactatatatggtagacatctaaaaaaggaaacccaccatttaaaacatatatagggtttttctggtttttttttaactagtatttttgtaacttactgttctttgatctttattaccactccctgaattcttgagctgttcagtttttttgctttatcttttcaagttatgtgccttctttgtagacaga

SEQ ID NO: 75047 - DNA, 1044 bp, Homo sapiens
aattttttttttctggtaatgcctttgtctgactttgatgtcagggtagtgctggcctcttaaaatgagttttgaagtattcactcatcttcaatattttggaaatgtttgagaaagattcttcttaaattctttatttgaaatattttgtagaattcactggtgaagccatctggttctgacttttaatgatatttctcaaaatcttaaaaatcttcatacctatgagctattaattctactttaattacctgcctttatcactcttctaatcaggaagaaatgttattttttgaacgtatgcttttggctataaatttcagaaacttttatttatttagctacttttataaataatattggtctctttattgaaagtacatacatgagaacaaagactgctttaataaccacttaataaatatttgtagaatgaatgagtgaaatctcagtcattgccgttaactatttcccccttattttaggaacttataatcaaaactgtattaagctcggcaagagatgagccctctggtcctgcacggtaggtcggatattcttagactgagtataactattttgtgtttggaagtttagaagttgactgaatttttatagcagcccagattgttttagatacataaaagccattctgaattacaattttaagttacttgaataattaagtattcttactttttttcatgatttaaatactaacctttcttcataaacagaatcctagtcacctttttcagtaacttcactctttatctctaaaatgatttgttttaattttattttatttaagtacattttgtttattgttcagttatatttgtcaatgtcttttatgcagtaccttgaaatgcagtagcaggtacccaatgaatttttgttaaattgaattaaaataaaatattttattatagaaagtaatatatctaagaaaatagtatattttaatatttataaatatttgatcaagatttttaaaaatagaatatgtcatagttttagatttttttctaaatgtcttaagaa

SEQ ID NO: 75048 - DNA, 1001 bp, Homo sapiens
tccctttcctttttaaattttgttttatgtatcacttccctgtctaatgtagttggataacaaagcaacttttctgataatttcataacaccaatatatttttaaactttttaaaaatgtgatacataggcaccaagagtagaagcacaagttcttctgggatctttggtttgctttcccaacttatattgtgaactgccttctcttcatcccaacattcctgatgttgctgtgtctcagtttacagatgttaaggtaagaaatgagatgctaatttttagcacttaaatgattttataatcataaagtatatgcaataaaatttgtattctttcttttctttttgaaatccacacaattgttaaagaacattagccatatcctccagacacaaaggcttgaatgttcatttggagcatatccttttttgtgtttaaaactgctttagaacctttttcttgttattgaacctactcacatgtctacctgttaggattcattcacttactgaacatttattgaaataccccatgagccagatactatgctactaatgtaaagcttctgagattaagatggtaaagtaaacctgcatattagactctctccttctcccagtttctcagtgtgatgagtcaaacatagtaatggaaaactctgtactgctctaggaaactatggagttgggatggagatcccatgtaccagaggcatttaggggcttgaacagtagatggtgcaaaataaatgtgactatacagttgccagtggaacttaccacagatattaatccttaaaaaaaagacaattgtgtccagttaggagaagacataccagatcacccttgttgtttataagtcttcaaaatgttttctggtagaaaagcagtcagtgctctgagcccagcaaggtgcctgttgataaataattccatcaataagttaagacctgtgtcttactgagacctgtccttacttaactgaatgcctatgtatgataaa

SEQ ID NO: 75049 - DNA, 1003 bp, Homo sapiens
agaaattgggccaacatggaaataaatgagattatatacatcgtttgctatattcagttgcttaagttatttagcaaatagtatttctttttgaacattaaaactgatcttttaattttaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggtaactatatatatatgtatcatctaagaagtagtttatatcatattatctttgattcttgattctgtttaactcttgctttttaaggtctagaagttaaactctcccccttatttagtgatttatatacaatttacttcaattttatgaccttatttgttcttgaaacatggttgaaaatcaagctattattgtaggtagaggattgacttgagtagttctccatctttaatgttgtaccaaccagttcactttttgaagcaattaaaccatcctttgcttaggctgatacctttctttaataatattctaatgtacctactcttaggcattttgtgactgatacttgaggcatatggattcgtttatctagttatgcaacagtcaggtttttttcaatctaagaatcagcacatcacattttcttattactgtcaattatattggcatagtgacagttacattgatttgataattatatgaggtataatcattaaatagtcataaatataaccttagaattactttgggagtcttgatattggccataaactaacaagtgtaggaggttgcaagtcagaataatgtaaatatgtttatcctaatatgatgaactcgtaggtcatttacagagtatattaatattaaaagataatatctttctgaaaaatgtaaaatttttgcattaatttaaaattagtgtgctaccttgtaaacatgtctcaa

SEQ ID NO: 75050 - DNA, 1365 bp, Homo sapiens
tttgatgatataacctgaagttgctattagataaaagtgagagtatgtgcttataaatttgatgtttttatcaaacagatttctctatctgcatagatagaaatttctctatctgcagagtgagtagtagttacatagaatcactattgaatagctagttaacataatgcttacaataattccttattattatctcataataataagtgaggttttgaccttatcgggaaaaaataatgtatgttgacatttcttttattcatttctgtagatatttaagattgttaatttagcttggtttcttggggggttttatgttcagttcactgaaaaatggctgacactatatatttttttctatagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaaggtaaaaaagaaatagcggatataagtggagaagaaaataaaaatatttaaaaatagaagaagccttagaaaacatttgtgacaccctttttgactataaactggtaccctgcatggcaaagtcacttaattgtaattaaatagtaagtgtagaaactggatttgaaattcagtttaaggtaaactggaagagataacagttttcttaggtttgttgctttttatttgaaaattacagattagagataaccttggcatttcaactgataacctgacctccccttctccaccagttttaattcctccactgagaattcttacaccttggctttttaaggtaagcttaatatataaaatattagtttaaaacttctcatttactaaatcttaaactttttatagagattttggctattatatagacttctagagcacttagtttttaaccagtatccttaggaagtcattaggcattatatagagaagagaatgtgcatactaaaattactcgggatttattgcttttgattatttcataaaacaaaagtgaatatagagaggtatgtctgtattgtatttaactgaagtataaactttgagttgtatcacagaatatgctgtgtattaaaagttgtgaccgggtgaggtgactcacacctgtaatcgcagcactttgggaggctgagccgggtggatcacatgaggtcaggagtttgagaccagcctggccaacatggtgaaaccctgtctctactaaaaatacaaaaaattagctgggcatggtggtgggcacctgtaatcccagctac

SEQ ID NO: 75051 - DNA, 1050 bp, Homo sapiens
attgaatgacatctttgctgtcattctttccactcttccactgtcttttttatttgctgctttttttccactaaatactctttctgctgttttaatttatattcactgcatggatcctgctgaggcttaagagtcacaggcccagcatcatgtgatatttgggtctttaggcagaccaacaataggtcaggctctagctccattcagttacatagattgtttggtgagtgtgttctccactcctacttcagcctctaaatctcagcatttattgtgatggtttggaaattaaaggtttcagatggttaaagagaataaaagctttttcttaatggtaaaatatttcttgaacgtttagactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacagcaagtatcttttctatttgaatactatgttttatgttgattgtcttctgttcaagactgacttacggattatgtagccatcaccttcctctccagtgttacttaggcagtggctcccacgttagaaaaaaaaaaattagatatttggtcttgctatgttgtctgggctagtcttgaactcctggcctgaagcagtcctcctgcgtcagccttccgagtagctgggattacaggtgcaaggcatcattcttggccccacttatttttatttcaattttcagtgaaatttcaaaggaagttttagggaatcaccttaagttgaagctactttatgttgccaaattaagagcatttaaaaaacaaaaaatgtgatcccttcttaaaagaaatgacatttttaagaccaaaactgtagaaaggaaaataatttaggatagacctgttactaaaaagccagtcatgattatgagttgcc

SEQ ID NO: 75052 - DNA, 1107 bp, Homo sapiens
gttttgattttatttgttttaacatggttttgttagcatgattaacaacgctgtataatgcatcttgcattgagccattaatgccacctgagggcagtatttgacagcttagcaaagcctggccagtaatataaagataatggtatttcacagtgagcttctgaccagtgtgtttttttaatctgaaatactttgtagtttattaggaatataaacagtgctcattttcctttcattgcagagaaatcaacttttcaatagcatagtagtgacatagataccatattattttctataagttagtttcccaagtctaaaactttcttgttaatgtaaatggtaaaaataataataatgtagtgataaaaaaatcaaaataactattttgggtttttttggtaagaaaaacatttgtggaagtcaactttttattcttaaagcattaaaattagattttatagtggatagaaacagcagtatatcaaaaccatagaatttgtatttataaatactcaaatgcatttgtatcccactgagttttgcatagattcaaaggatgtattccctgcaaacgttctttgggggaaatacggaattataaattgttaaggctctaaaaagaaacattgagtcaggaaaaaagataaatataccagtttctttataggcaatattaacctaacttcagctagtgcttatctataagctttcttgctgtttaaagttacactgaagattgactaacatctgcttagttaaataaagtaaatatcaatttactaattcttaaaattaaatctgaaagaagggaaattattcataaatgcatgtttggcaaataattggcaaaggtactttgttttgggttgttgtttgtttcaaagttagaaaatgcagttaagtttttcctcactatatatagttatttatttatttttagtcaataaagaggacatgagccaaaaactgcctcctcttaatagtgatattggcggcagcagtgctaatgttcctgatctgatggatgagtttatagcagaacgacttcgaagtggtaatgcctcggtaagttttattttatatatttggttttatagaggagggtag

SEQ ID NO: 75053 - DNA, 1070 bp, Homo sapiens
tccaccctgaaagaatattttaaggaaaaccaggaaaatcatagtaaaaatgagacagggaaagacccagcttctcaggaagtgactattgcagtaaataggggtgaaagattatccttagataaattagaatgcacagatcaggaaactgaatcagaaaatatcacctcttttgttgggactcctgaaaacctacagtttcagaaagaaccaaactcagctgtcttcatgagtaatatcgcacctaaccagtcagacagtttttttagaacacaaacttctgaaaaatctaagcaactaaacactgataaacagccatcagagcctagtttagatagcccttgtgataaagaaaaaaggaaacatctgtacagacaagcagccacagaattagatgcttgtgttgatgtaacactagttgaaaagcttaagagtgtgcaaattaatgaaaaaatcactgtcccacatgttatgcgtgccaagaaagcaacactaaaagcacctgttaaccgcagaatgcctcatgttacaagtactagcaaactttctccaactaaaaggagcttgtctgaaacagtaactcatagagccaaaatcatgaaaattgctactaaaaaacgaaatagtgttcatgttacttttaggccatccactgagtccgttcagttttataatcctctggaaaacaaagaggctccatggaagatgagactgcggaagctcggtggctttagtagtggtagcagcaatagcagcactagcaacacccataccagcacaaatagtgctacagagctagtaaaacctggtgtgtacagacctctagatacacttggtactgcatcagtaagcagcaaaacagtgaaggaatccacagagattcccaccaccatattacaaaaagaaggaattgcaagtagtcaattaggtagtcgtagtactcttaggtcatcaagtcatgaggcaggactacagcagggctccctgggtggcgtttataaaactgttgtacatgctctttcgaagccgaaggcaaatgtttccccacagaggcagaacagaatgccacc

SEQ ID NO: 75054 - DNA, 2074 bp, Homo sapiens
taaaatgagctttgaacacttccattattattttattctatttatttatttatttatatcgagtacagaatttgaattctcttggccactaattcttaaaagtttgattggattagccattcctctactgttttaaaaaaactgtcagaaagatttatttttttctccacatcttaagggatttacagaatttctcatctgcaacttaatatattggcaaatattcatgttaagtgctaaaacatttttgaatagctaaaacaaagataaggttgttcctttcaaaatattttagagtggtgccatacccaggatgagaagttcctatttcagaattcttgctttgctgtaaatacataattcagaaagtttacctttttaatgattttatgatttaaacatttatgagcactgttggaaaggaattttctaaatggcaattttatttgttgtattccttttccctatctggggtaatatgccttctatgataaatttaaagatttagatggtgttgagacatcagtcactaaaacaaaacaaactttatatctgattatcaaaataatgttcattttagaaaacatggattatatggaaaagcatatgcaaaaatacacataatcctccaaaaccagtgataatttattgacaacttcagatgcttttactgccagttttttatgcttgtgtacatttaaaatataaaagcataattacagttattttgaattaaaaatcatttttttctcttagaatttgaaagaggcaaggaacctgtcactttaaaatagcaaaatccctcctttcctgattgcaaatgaagtcaggatttttcaagctgatacgtaaatttagaacactttccaggagatgcaaataggtgtgtagaggaaaagattaaagattcatagtgcaaatcaacataccaaaggcccttagaaaacctgttaaaaaaaaaaacaaaactgttggccaggcacagtggctcacacctgtacccccagcaactttgggaggctgaggcaggcagatcatgaggtcaggagtttgagaccatcctggctaacgcgatgaaaccccatctctactaaaaatacaaaaaaactagccaggcttggtggcaggcgcctgtagtcccagctgctcagtaggctgaggcaggagaatggcatgaacccaggaggtggagcttgcagtgagccgagatcgcccactgcactccagcctgggcgacagagcaagactccgtctcaaaaaaaaacaaaacaaaacaaaacaaaaaaaaacactgtttataattgaatatgtctcagacttatttaagcacagaacacctttccaagtacacatattgatatcctgtgccattaaggttccagagagaaccaatatgaaaattaagcaggattaatcttctaccagtttacattgtagaaatctaaattattggattggtctttgcctctgcgattcttggaagcaaattaaagacttggaatttgattcctcaggtgttaggtgtagagcgaaggagagtggaagagataagagaaaatgtatgagttataagaatagagagttgtaaaaatagtgctaaattaaaaaacaatcaccaaaatcttagatcatcaaccaatcatactttttaattgctgatgtttcttccaaggtttgactaaattttactttagaatagtttaatgtgcagagaattaataagaaagtgaactgtatgaaggggaaaaagtaaatggtttttcatgcttttgtagctctccctcatgtgaattagcttaaacgaactcataaaatatttcctgagtctatctctgaaatcaggaaatgaggtttcttcaactacttcaccaaaaaaaaacctcaatgaaacgactcatagacaatctacctctagtttatggttagaagtagaatttgttagaaaaatatttatctgatacttttggataattggggaggtaaagggaagtcctttaaatccttttttttttttaacgtaccaaaatctatgagaaaggaccatcagttttctaagtaccttatttgttcccag

SEQ ID NO: 75055 - DNA, 1047 bp, Homo sapiens
gaagagtaaacttgattatttatttctaagtgaactataatttatctttaatttttgtgaactagggactctcctaagaaattatcaaatgcaactacaaatgcaatttttaaaaagtaatccagtttaaagctttctttgaaaacaattttaagtttttatgtttatgatttgaataagcacaaaattatctatttttgtcaagaacccaatttttcatgctctgcaaattgttttctgtttctatgtaaaaattttaattatactcctatactttattataaaagatactgatttgattagcatcctcttaccagaaacacatactagacatgagattaaatccttttgactatgaattacctaaaaatttctaagaaagacctgtgagtgatttagaaaactttatttggtaaagagtatgaaagtaggaatgatttattcttataattcagcctcgttagtaagaatggctcaggattgcctagagaaatgcccaaatattgttccaaaagttactttgaactattaatattgagttattttcaatgttttcattcagtgaatttctcaacccttggttttgagaacataatgctaattaaagtgtctgctgttgtttaatgctattccattgtaactgctaataataatagcatttttctgctttatataaaaaaattatattcaaaatgttgtgtgtgttctctgatttcttttcttacagcttgccagtatttgccgtgctgaaatgttttaatttataatttccttcctttgtaccttttagttttctctgttgctgctttttctgtgacacgagcctttcattatagtcactcttcttttttccttccccacttctttcttttccttttttaaagccatgagaagccgatccattggtgaatgtgctctgccatcggcctatatacgcagtgctaaaagtgctcctgttctgatccatacttccaaacccttcttgcctgatattgttctcactcccctttctgatgagctttcaggtagtgccacctctgctaattt

SEQ ID NO: 75056 - DNA, 1050 bp, Homo sapiens
ctactttttcctggactatatttcccaagtggctattattggcagattagagatttagtaatcatcaccacaggatgggttttgtttagcacctttcctgtcttttttttcttgtctaaatgtttcatttttattccaaagcaagtgggtggcagagaatttctaatagcttattgctaatggtgtaattttaaaattgcgcatcagttttggaatatgatttatacataaagtgaagctcataaaagccttacagtacacagcgttttgtcttattactttataatttatgtgagcaaacctaagactctgaggcaaggtagcacgcataacttgaagatattattgatcaagtaacagtatattgagattgaaaatctacatttccaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcggtatgtactcttgaaaatcatgagaatggtacagggcactacatttatagtccttggtaacaatttatatcaatataaatttttcttaccagttgattattgttgtgaaatgaaaaactgctatagcaaagccttttttccagaagtactcagagtctagtgataggctgttatccctttatgctattaagatttattggacattatttttatgtggtttattttactgtagagagccctaatattaaaatgttattttacggaattgaagaagtagaactgtgattcactttacagaactcaagcattaactgatgtggtttcattgaaggaatttactcacaaatatggaaaattagggtagctaatttcctgtgctacaattatatagtagattagtttcacagacttccaacaagaatctcattttctctgctggcagacagctaaggccaacatggagtctgttactgagtttcttgctgcttttaacaaaaa

SEQ ID NO: 75057 - DNA, 1517 bp, Homo sapiens
cagtcctttaaaaccagctacatgtatcatctaaactcctcttaacttcattagccattttttgttttttcattcaggtttctccattgttagagctaacccgatgatgggagctacaggaagataaaattttatcttgctatgtgaaacaacttttttatagtctgagtattaaagtagtcttttttttgtattaaattaaagatagattgggaggtcagtagttactatagttctgtacctaaactctgttcattttcatctttacatttcaggtataaatttatgtgaattcctttctaaatgttgtagaattaagcttttgagaatcgttattttatgacttgtttcttcaatcagaggacatatctttagtagaaatccacaaaatctcagggggtacttactggctaatccatttctgtccttttatgaatttttttatcctgtgatcagatttattacagaatgcttttaatttgttgtgtttaaaaatatttaatttcaacctttagtttatgtatacattttcaaaactacatttcattaagttaaatatgtctctagtatgttgtttctttatattattaaaaaacattttcgagttgtagttagtgatttccatccttaatttgggaatgtaggttttggctttttagttcagtaactcaacattttcaacacttaaaagtatggagactattttttaaatagcatttatttaacattaatataatgcagcataagagacagttataaatttagggagatttctttttagattgctgggtgttgggagttggcagttgttgaaatgaaatttatagtagattctaatgattgcatgaattgcttttacaagtagtattatctattaaaaaaagcatgcgattttaaatgttgcttgtttttaagtaatttttttaagaattgaatgtctgattttgaagtcacacactaaacacattttattgttatttctgatatttgtctttatagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggtaagaattgttcatagagatgctctatataaatttgtttaaataattgagtcagggaaaaccattccagggagaggggtgagggtgaaataagtagaatcttaaatattttatttttaagaattaaacaaaatgaaaatgtataaaataccattcctttttatcgtaagcaattttttcttagaactgagaaggtggtttaatgttactctatttaaaatgtgtacaataattattttaaaaattgtttttgaaagcacttacttagttttaactaaaa

SEQ ID NO: 75058 - DNA, 1053 bp, Homo sapiens
aatagctaatgatttcttttgtcttaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttggtaaaaaaatttttatcctttatgtctatgtgtttttattgtgtacacaggtatagtaatttttagagaaatagtgtctgtgaagagggtttgtttacagtattatagaggctcctattattgaataaatataaaattaatcatagtggcaatagttcctttcagcttatctgaaactttgttcggacttccgcaagaccccttggactgtcttcctgaagtgagcatataatggcctcatcctcctcaacccctaaggaaagaatacatgcatacaaatgtatatgagtaaatgaagtttacttgtgtgtgaatgagttaatgaataagttgatgattgactgaatatgtgaatgcctgaatccttaatctggcattcagagctgtataccgtcaggccctgcctacttttcctgtctgaagtctaacctccagctttcaggataagatcctgcttcccagctttatcaagttgttcttccctgggcaccttctgaactttcctttagaatgtctaattctgctgtttttcctgttgtcaccgtaactgtcccttagattcaccttcctgtttctacatatccttacttaaattttttcttcacttgtttccattctatatttgtacttctgtatagttcttgtgaaaactgtcttgatccctaaaatacttgtgtaaatatctgtttaccaccatagaactgagaacccctagaaggtatttactggttttcttatttttatatttcctacatttcttagtatagtacattatatatcattggtgctctataaatagttgtctaattgattggaaaaatagaccttttggggagatgggaaagtggttctgcagtttttgtaaaaatgaaatgtt

SEQ ID NO: 75059 - DNA, 1846 bp, Homo sapiens
tagacaggactagattctgttcagtaacttgtatgccatgttagtaggctttaattacattctagaaactggaaagcctttgaataagagagtagcatgaacagttacatacttgagaaggtcataccaggcccagaatggaggatagattgtaggtcagtctgtaggcaaggagaccagttaggaaggattagcaaagtttggaagtgagatgataagtacctgatctaggacagcggtagttgcagtggaaatataagggagaggacagatatactagtgtttttgaggaatggggaggtgtcgcaagtttctttcttttgcaaccagagtagttgccattcacacatggatgggaattttaaacagctcaagtttggtgatggctaaggcagctggagggattgggttggcaggaattggggggaatctgattaataaacttattttaaaatatctgaagtttgagatgcttgtgggtcattcaggaagggctcttcagaagacacttgattacagggacatggagcttaagagaaaggctagactagaccatggcatgttttattggctactcagggcagggttccagtactgtttctggtaatggcagaactgtttgtattggactaaaccttttgcatattacaaaccctatacaaaatatttttgtaaaacttaactatttaaagatattggtgaatgacaagaaggaagaaaatggagggacactttaaaaagagaactgcagagtggcatttctgtttgtactttttaactgagggaactcccttgtctgtaagacttgttacagctaaaatgcaggcagaaagctgtagtctcagtgatttgaagtttcagtattctttgaataatgagaattttagtactcctaagtaggataaacataagcctttttttttttgtcatttatttgaattctggcatttaatttagaacagaattcatctttttacaaagctataggtagtataatcccattcttgagtgtgtgagagtatgaaagggaggtttatacattagacctatagaagaatactctctggaatgatataatctctggctgctcattatgggttttgttgttgttttttactttatatttttgtcattgagaatccttttttacagtgaatatacattgtttttggatttggataagacatcatctattttgagagaaagaaacctgtttagcagtgggacctaacaatttcatttaccttttcaacttaactgactagttgcagcattcttagtaatgaaatattaaaaacttgatattttgcttcaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtggatcactttatggctatttttaaaaataaaataatcattaaatatttctgttcagtatttcagtatacagtatacttttcacaatataataaattcaccacctatatttatcattatgccatattttattttttcctttcatcacttaatatatatattaataaacattacatattattctagataattttaaatgttatataaattatgttatggtgtactgtcatctgcaactgattttttttattagccattctgtttatgagatttgttgttactatacagccataattcattttaactattttgtggtattgtactttatttcacatttgacttattcatttttctgttgatggtcttttgtttccagtttttcactattccaaa

SEQ ID NO: 75060 - DNA, 1752 bp, Homo sapiens
aggtgaattggtgtgtctaaatggtctcagtccgggtgagtgttggggtgtatgtgattgcaccccacaatggaatggcatcctgtccaggactgggttcctgtcttgcccctgagctgctgggatacactggccaccagtgaccctgaattagaatatttgggtaattaattgtcttacttatttttattaatctttcttaagtgtacatatagctcacatttatttcagtgtttaatattgtaagtgttgtggtctctatttagaagtttggtgatttttttttttttttttactagaaatataccttaggaacttaactcttatttatatcaattagcttatggcaaaatgagttttgttttatgtcattgttttgcttaaagttgcagtttccaagaatctatgatgtgatgtgaaaaacattactgcgttagtggtttgtggcaaaggaaaaagtatcattatcttgattctcctttttttccctaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggtgaagttataagatttatatattttagtgttagtctaatagattaagagttttgcagaaacataataatgggttaacacaaatatacttattaaatgggaagataaagatatctttcagtatattttgcaacaatttaggtaatataagtagtcatctcagtaccgtatagcaaagccctgtgataccacaacttttaaaaattagtattgaggttgtatactgattctttaagccattgtctagataaaaattaggtactgttataaaggtataatatttcaaactgtggtactacatcaaaatggattttaaaatacatactttcagggggttgttattaccaaaccacagttcctcctttcctggaaggagtaactatttaggagtggctacccagcataagctacagtgtttgtgccccctccttggaatcttttgcactagagctgatttcagaatgtgaaacttcttgacttggtaaaataagttattctgtgataagaaagactagagtttactcacagcagggaaaagatgagaaaagagagagtagtagaggtggcatttgggttcctggggttccatttattcctttgattgttcaacctttgtcacaggtcagactctccaacagcagatgctaagatggagttaggagtgcagaaagtttattgaaagtgatttatctgttttgtctgatttgcctttcaccataaagttgtctgcgattgatacatatcttgctaaatctagataggaatgattgagtaatgcttattcactttagtggttaatctaacctcatcagtggaatttagtcaggatactaatgtgtggatgaataggccagttctgtagggatttgatgagcctgagcgtgtgtgtgtgtgtgtgtatacgtgtatatgtatatatacacacaaacatagagcaccctccccccttctaagaaagggaaaaatgtaactgagaaatataattgaagtaaataaaattaaccatatgaattatgaaataatatctacagtcctaattcttacacaccaatgaaaaatatca

SEQ ID NO: 75061 - DNA, 1062 bp, Homo sapiens
atttgacttttattcctcttagtttatttatctttagcaaactgtattgtgtgtcttcctccaaaactttgctctaacttctgtattaagaactattaagtgcgaaaattctcaagcagaactatctgctttctgatcctagaatgtaatggatgaaaatcataaatgtttttggttggaaaggtatatttgaggtcatttatttaagctctgttattttatggatgacaaaactgaggccaaaaattgaataacttaacagaaagtaatttataccacagaatagtgctacttttaccatatagtaatttgcttatcaccaccttaagacttaatttttccctatctggttaggcttgatcttcagacttggtgaaaattccattattagaattatagaattttctctcaagttttctaatattttctgttagttttgttcctacttctgtcataaattttgttcctttgttttttgttttgtttaggaaacttttacttgtctaaatttttgtccacagtaaaatagagataattttaaacattaagtttttattaggtaaacattctgatgttaagttatttacttattcttgaaggtctgagctgtctctaattccattattcatccacccagctttgattaataacttgtttgaactgcaaacttactgagaagaatatataactataggtgggtagatgattaattaccacacattttggagtatctgtcacttagatgttgagttacttgcattgccacttaattatttagaatggcttttaaatgaaactctatgcccggagtttaagcagtggtataaattacttgggaaatgttttggattttgtcagtattacctattaaaagacaaaatacatagttaaatgattatgatattgtttctctcttttttttttttttttgtattttagagagcagctgctagtttagtatccagagaagaaagcaaaaatgataatgctgataaaacagacagaactacagaacccgaacagtctcattccaatacaagcactctcacggagcgagaacct

SEQ ID NO: 75062 - DNA, 1030 bp, Homo sapiens
gatcacctgagatcaggaatttgagaccagcctggccaacatggtgaaaccccgtctactaaaaatacaaaaattagctgggcatggtggcaggagcctgtaatcccagctacttgggaagctgaggcaggagaattgcttgaacctgggaggcggaggttgcagtgagccgagatcgtgccattcattgcactccagccagggtaacagagtgagactccgtctcaaaaaaaaaaaaaaaataataataataataataaataaataaataaaatttatttttgtgatcaactatcagggatgatcttaagatttatttcaaggatcagtcattagaaagttttcaagcaattttcattgcatactcattttgcagttaaagtttatttggttatattattgttttattaaatttgttttgtaactatatactattcttttgtctttggatagctcaagtcactatagaagaaatcactcctcttgtccccccacaatcaggagataaagggcaagaagatctcacaagctattttcttgaagcacttctaaaatacatagtcattcaggtacttgttatcttctttgatatcacactccttactatcctatgtgggtgattcccttttctgtctcttaccattattctgtcatagtagatatttgcttattttctttttgtcagggaggttggaggggaagggtcaatggcttgcttttaattagctttagcttttaagcttttacaagtgtaatcaaccaagtgatggtggtaggggatatttcctacacttctcatgtaaactcaagttttagattcttctttggagtaaaaatagactcttcactctttagaagggtatcccttagttaaaaaaattccctcttcgtgttttttccctgtatccctctattcatccttggctgccacaataaaaaagacagaaagtacaaggacatgtttttcttgcatctgtagtggaaaccttagcagcagacaggaactgctccaggtctgtcacatagtaga

SEQ ID NO: 75063 - DNA, 1238 bp, Homo sapiens
aactcctgacctcaggtatctgcccaccttggcctcccaaagttgggattacaggcgtgagccaccatacctggccttcagacatcataaattattattctgattttcaactgtcttggggagaagttaggaaagctgtagctgtgaattgaaaatagaacttaacttctttttttggtatgattaatgattttgaataagtttttctgagctattgttttcttgatcagtttttaaaattaaaactaaaatcggcaaagactaaagttttaagaacgaggatatagacatagaaatatatattgtaaatattttaatagaatagaattttaggagcagttctttgactttgaaggaaacttgtcgctgaatatttgctaaacttgatttaacatacatgtaaataatcagtaatttttttttatttttcagagaatgcagaatctattgatcttaaacagtttttcgaccaacatttttcacatatatactatgtgttctttgaaaattttgtgactattgaagctagtcttaaacagaaaggtaagatgctaacatatatcttggcgtatgttaatatttctaataattgtcataaacataacttaaaggctgttggacatattgtttcacttatttttgtcggacagctttttgctttccctctcacactactatcataggtctagtgacctgtattttaaagacaactgatgggttagtattactatccttattactttacaatggcttgaagatttgctttttcactggtcaggttgatttgttccctcattgtgccttctttggttctgccctaggagcatatgtcacatttgagcagtcattttcatattttcattttcagagcttatttgaagttctttgtaatatatcatgatttgtttctagacataaatatgtggaacctaaatttaattacagtactcaaaagagtaaagagagtgactgtgatattgtctacacaatgaatggaatatgctttaaacattttactaaataattgctgggaaaaaaaaaaccttcattcttgaaatattttaagttcattatgaggacaaaatgatatgttttaaatgttttcttataaaaatgttttaggtcacaagtctcaaagagaggaattggatgctatactttttatttttgaggtaagtgcttctgaacctaacttttccctttttcaaaaataatttttggaacatacaaaggaatat

SEQ ID NO: 75064 - DNA, 1222 bp, Homo sapiens
aaaaaaaatttgcctttctcagtctgatctccatgagctcttcagcttctttttaggttaattcttttcagcctggccaagaaggtatagctctcagattcagttagccaggtagggtctggcagatctcacaaattaggatgtcaaggggttgaatattagatgagctaaaaggaatagatcagcaaaaaaggaaaagaaacggaaactcataccttttagcaatcactccccatttctccttacttcctgcccctgccagccattagatactttccatctctgtggttgactcttctgcatgtttcatataaatagaataataaatatatggccttttgtgtctggcttctttcacttagcataatcttttcaaagtccatcacattgtagcttataatactatttcgtgctttttacggctagataatattcattgtatggattataccatattttgtctatccattcatcaattgatggacatttgggttatttccactgtttgaccattatgaataataacattataaacatttgtgtgggcatacattttctttctttttctttttttttttgatagagatgagacacttttgccatgttgcccagcctgatcttatgttttcaattcttgggtatgtaatgttctaggaatggaattgctgggccatatgataactctatattaaactttttagggacctgccacactgttttccagagtggcttcatcatttatattcccaccagcagtgtacaaagattcaaattttcccatattgccaacacttggtattgtctgtctttctgattatagctatcatagtgggttagaagtagtatctcattgtggttttgctttgcatttccctgatggctaatgatgttaaacgttttttcatgagcttactggctatttgtatatcttcttaggagaaatatatattcaaatcctttgaccattaaaaatttttgttttacaattgaattataagaattctttctatattctggagactaatgttttaaaatcaggtatataatttgcaaatattttcttgcattctgtaggttattttctcattttcttgatagtgtcctctgaagcaaaaaggttttgaattttgatgaagtcaaatttattttttcttttattgcttgtgcatttagtgtcatatctaagaaagaattgactgattcaaggtcatgttttcttctg

SEQ ID NO: 75065 - DNA, 1045 bp, Homo sapiens
gcgctggtacaatacaaacttctcccgtcagatgcaactagtctagcgtccaaacatcatgcacaacacctcggcggcagcagcgcactgcacccactcccgccacggccctgctcatttgtgcatgatatttggagcatctggaggagtgggaatagcactggggagaggagggagcaagaaacagcatgagtgcctgctgagaggtcagccaaagttgtgcagggcgagcctgaacatgtcattggtgcaaacccaagtattgttgatgttctttaataggaacatctggtggaaccccatgatggcggtcttcatccgccttaagctggcccacaaccatgctgatgatgcagctatgcggcgtgagctgatggtcctgcgcggtgatgctgtgctggattttctggaaccgaaggctagacaacttctccacaatggcagctttcccctggaactgttgtccttcccacgtaaggcatgatgcgtcaatgtaaattgcgcctagttggggtctatcgttatcaaataactggtagtaatgtggaatgaagctggatcctatctgctcccaaattggcttgtctcccactctggaccgtcagccggcctcgcggagacccgaggggctggcacgatggctgcagcggcggcggcaacccagcacggtctcaaaatgctcatatttttaagtggtctcatgcattacgtatgctacaacttgactttctccttagtgacgtttttgagatttacccattgtgattcaggtagctctcatccagttatttttacctgccataacatgttccatttagtaaatatattctattgaatgaatattacagtttacccatttacctattaatggacagggaggctgctcccaattttttcactattaaaaacatttgtctcagacccagcacagtggcttacgcctgtagtgccagcactttggcaggctgaggcaggcggatcgcttgagattgggagttggagaccagcctgggcaacatggcgaaaccccgtctcaacaaaaaat

SEQ ID NO: 75066 - DNA, 1216 bp, Homo sapiens
tattgtcctgttagggtctaagttaaactatcttgggtatccatcctctagataaagtcctgtcaggagcactccagacataattgattttgttatatcagtttatatacatttactcctcgtggattctttggattgaaaatgatagttaaaaaaaaagtggttttggtggggtatagtatctagctgttactctgagtatatgtgattgatgacaccagagtttattatctccatttctattttgagaaacttgagagattgtttttcacaggaaaagagttttattttcattttgattattctgtatcaaacatttaggagtaatctttagaagaatagattaagaacaaaaactagcagtacagtttctttctagctcttataatttctaatctttttggatatatattttaagtgagccttttatttttagtctttaaagacaaagttagactcacttttcaattttttcttgatccatcttattaaatacagtgaggacagaattcctgtagggaagtgataatggaacttctcattgctaacataatcagagtaattgtgtttggttgcaggaatctatagagagctctgcttagaatctgtaaagaacaaatatgaatgtgaaattcaagcttctcgccagcattgtgaggtactgtcattttgcataacttttaagctaatttcatctcttcaagccttttctgagtgtagtagttaaaaaagtaaactaagtaaaacaatattaaatagtactttagctcatcatttgtgtgtgattaaaaaaaaaaaagaatagagttgcattggaagctgtattggagataggacacaaagaaaggaccatagaaaaaaactgagataattttagaagttttgcagctgttactttaaaaagactttgcaacgattatgtcacctggcattactgaaaatattagtataattagtataatgtggattagatttgcgaaatatacactcaatggtgcagttaggatgttgggctatagaattagtttctgtctgtctagacctatttccacatctttgggcagaattctctatttatgggaaaaaaaataggtatatttttctgtatattctgtttattttgcatttaacccatttatgctgaaggttgcaatttttttgtgtgtgtgaaaaatcagatcttggtgatgaccttgagcagtaggatataaataac

SEQ ID NO: 75067 - DNA, 1038 bp, Homo sapiens
ttggggcatctctttaccagcaacctggatgtccccttcacctctcctctgctagcatcttattttctccttaagtttggtagagtgtatctttcagtagcatcctgacaaaggatttctagaagttagttttttgagatttcttgtattgcttgtctattgctttataattaattactccaaaacttagtggcttaacacaacaataaacatttattattttgcagtctcagtggccaggaatttgggagcaacttagctggatggttctggctcagggaatcccaagaagttgcagtgaagatatcagccagggatgcagtcatctcaaggcttgattggaggctggaggatccgcttctaaggtgactcactcgcaggctggcaagttgttgctggttcttggtgagaagccttagagaacccatgtgagaacatgggcctctccacaggctgattgagtgtcctcataacctggtacccaggttcttccagacttagtgatccaagatagcaagacagaggtgactgtttttatggcctagatttctgccagattttgttcactagaagtcagttgctatatcttacccattttttttttttttttgagatggagccttgcttagtcacccaggctggagtgcagtggtgcaatctcggatcactgcaacctccacctcttgggttcaagtgattctcctgcctcagcctgccgagtagctgggattacaggttcctgcaccacgcccggcttattttttccttttttgtagtagagactgggtttcaccatgttggccaggctggtcttgaacttgtgacctcaagtgatccgccagcctcagcctcccaaagtgctgggagtataggcgtgagccaccgtgcctggcccatcctacccgtattcaagaaagagtattagtctctaccatttgaaattaggagtatcaaaggattattggacatgttttaaaaccaccacatctttcctgtctgaaaacatcttgacgctcacacttaagagtatggaattct

SEQ ID NO: 75068 - DNA, 2023 bp, Homo sapiens
tctgactaatgccagatgatttctggaatttaaaaatagaagttgtacttaggacatttcctttttagaattaaaagcctggggaatgcttggaacatgtattaaactctgcttctttcggtatatcagatgcccgcaggggaaaaaataaaaagtataattttcaattgaaatatggcaattgatattttaaatactacttaaaattcacactagtaattgataacatacctgcttccccttctggtacttaattagtcaattgatgatttattgttcattgtttagctttgtttagtagttatattaaaaacttagtgattatgtaaaagaatgtaaggaataaatctttttattacattttaggtttgttatttaagaaatatttttaggccttttttacatatgcatggattgatgttaattgttaatgttctgaccctttgttcttctgacagtgttttattaatataacagtttttgaactgatccctttagcacctgtgaaactggaaaaacatctgcacagtgctagatctgaagagggaagactatattatgatggtgaatggtatatacgtggacaaacaatatgtattgataaaaaagatgaatgtcctacaaggtaaaaaagcctttgttatttcagtgttgctcagtattgtcatttacaacatcgttgtcagtgaaatatttcctgcctccatagtgtgcctatatcattagttgcttgtggatccttttttcacttgacatatggcttgattacatgtgtgtacagcagtgttaatatgtatgaaccagacttcatattaagtttatgaacacaaactttaatgcaagtagaaatgttgaaattatttagccaggtagctgatcctgtttcttaattcttttagtaggtgaatcgttaggatcgtgctataatgacccttaaacctgactattatgaatttttggtggacctaataatctttaacttttttggatgtgttacaatattttagataaaaagaatttgtatcaattagagtaggaaataaatggaaaattaataaaacccttaagattaatagtaattaaagtataatctagggctgggtgcagtggctgacatctgtaattccagcactttgggaagctgaggcaggattgggtgaggccaggagttcaagactagcttggacaacttggcaagaccctgtctctacaaaaaataaaaaaattagccaggtgtggaggtgtgtgcttatagtcctagctgcttgggcaggaggatcgcttgagcccaagagtttgaggctgcagcaaggtatcatttcaccacaccattgtactccaggctgggcaacagagtgagaccttgtctctctaacaacaacaacaacaaacaacaacaacaacacagtgtaacttgaaaactgccttttaaaagtcctagtaatatgtctaggcttaaataaagtttatataactatttgtatagccttctaagttttatctggttgtgaccttttgaaaatattgttaatcatctttcattctccagtagtgtaggatttaattctcagagtagtaaacttctgtggtaacaaaatatggttttgtaggtgtcagtggtaaataaaacaacttgagtttagtctacagtatgcattttccaaatacagtggttttaattgtaagataattttgtctttaaatttttaggattccaggaacattgtgtataataacttttcttatagaagctcattgaactactagtttatatatgatactcctggattcttctgtttatgttattgtttttgagatattttactactacttagcataaaagttgtttaaaaagagatgaggccaggtacaatagatctttcctgtagtaattccagtacttgggaaggccaaggcaggagaatcacttgagccaaggagtttgagaccagccctagctggtctctttgtagagaaccccatctctacaaagtaaaaaaattatccttagtcccaactactc

SEQ ID NO: 75069 - DNA, 1876 bp, Homo sapiens
tgttatctaaatttaccttattagtgttaccaaatgtaagtgccatgagagtaaaaaaatgtattcaataacttaatattctcactgaatcatgagagaatgtgtatttgtaggtagtactctaaatagatctcattgatatgttattaaaagaaacagtaataaaaattttatcacgatccttacgttgatttgcctcttaggtccgatgaccaataggtattctgtatatggtaggggtttctttctaaacatttttctttggttttaaaaaaagttatgcaaatttgtcttatctttagtaaactatgactacatttatctgcaatttttaaaattttccatatctttgtcattcattgtgtgtttgtaaataaggccgatagaatgtttcctataaatggtttgtactagtacattagtgttaaaccagaactgaaatttaaacatatatatatatgaggatgtatatatggcatcatcagcttatttagaactgatggccataccttacaatcttgttttacccaaaattaagctattggggttgaaagctaaaaggagcacttttgtagaatagcaacttttcttttcctctttcttgattgtatggtggggtggtgacctatttttacaaattatacctaatgagtaaaattagtgtaaagtgataacatgcttctacctgtatttctagtgaccctttagcggcaggtatttatacctggtatttatgatgcagtatataagtggtgaacaataactgacagtattgtgcttgctgtacatgtctggtcttttgaaacagattttagtaagcattttccagaggtaaaactgtgtccttattctaattttattcctagggcaaagtagacagggattatttccttgaatctatttccaaattaatatttttttctttggtatttctacactttaaggccatttggtgcaatttagaaagtgttggcctcccttccgctagccacattcaaaattaacttccaaaacctcaggaacagtacaaagaattgaaaccctcaatatggcagcacagccggctgtagtgtatatttagggtacaccaaatcaggtattcctggtggtcttgtgcactttaatttctgttacaatgagttaagaggatgaggaagaaatctacttattaacacttactgcagaaatgtctgcattattccgtttgttttcttattattttacctctccaaacatcttcctgtgcagatcactacttcatagttgccaaattttaaaacacttaactgctgaaattcagtgtcagcaaagtgatattacgttgttctgtttctaattaaccttagcaaatgtacataatgtcaaaacccaatagtatttgacagtacttatgtatacaatgtttgataagcatttttaataagatttgtatttttaaatttagtatataataaaaagatgtgtttcagtgtgatttgtagtgtcttggattacttatgtgtatttagttctttttataacctatccacttgtaagaaagatttgaattggtttacgttaatagatatggagtaggctgggtgcagtggctcatacctgtaacctcagcactttctggggtatatttagatgttcaagacagctaagttatacttaattttaaaatatatgcatatgtgttgtactttgattaaaaggtactgtataagttaatgaaattctaaatagaaaatctttatttttttatttttattttttgagatggagtcttgctctgtcacccaggctggagtgcagtggcacgatcttggctcactgcaacatctgcctcccaggctcaagtgattctcctgcctcagcctcctgagtagctggg

SEQ ID NO: 75070 - DNA, 1054 bp, Homo sapiens
tcccagagatctactttgttcttgttaatgaccacatggtatttatttttatggaataaccacatagaattctatggtgtggaatgccagcacaatactaatgaacattgaggttgctgttttccttccgtctttcctccctccttccctttcttccttcttattaaacaaggctgcagtgaacactcttatacatatatctttgatgctaggaaagagtatatttgtagcataaatttccagtagaattgctgggtcaaaaaatggtagggaaaatttgtattttattagatattgccaaacttccctgcaaacaaattgtaccaatttgtgctcctactaacagcatatgatgatgcctatttctcctaatcatcagaaacactgggttagttaatttctaggtcattattgaagatcattcttctaccttctctttgtttttctctgggctgcatgttaggccatcattctactccttttagaagatttcattcactcattggcttcagctaccatttaggtcctaacaaattctaaatttaagcctctacccttacccgagttatatattcaagttgcccattgggcatttccatctgttactcttaacacatttacaacttaatataaagaaaaccaaatattatctcctgtgcacattcctctcccagtctggaatgtactctatttgtgcttccacccttgatacacacaatgactcacataaattcagaccttggagaggttgtggcaggtagctaaactcatgaattttggagccagattagctggatgtgaactctaccatttatcggctgtatgaccttgggtaacttcttttttttttctttttctttttttgagacagagtttcgctcttgttgcccaggctggagttcaatggtgtgatctcggctcactgcaacctccacctcctgggttcaagtgattctcctgcctcagccccccaagtagctaggattacaggtgcgcaccaccacgcctggctaatttttgtatttttagtagaaacagggtttcaccatgttgt

SEQ ID NO: 75071 - DNA, 1022 bp, Homo sapiens
ttatactagattcatcagtgttcacacaaaggtcatatccttacatatctctttgaatttgtgggacacatatggtgtaccacttctatagaagaaatattttcattttagaattcaacttttataacctttggcaacatgtagtatcaatggctctttgttgttcaaaaaaaaagtaaaactgtaagctatccccaaggatattcagggcgttgctatagcaacagaatctgcctcccagcaccacaagagaagctatgaataaaagatggtgttctaaggacaacagaatagaagaggttgtttcgatccttctaatacctgatatttgctgttattttgttaaatgcaaaataaaaatcttggggaaaggcccagtttcaatatagaaaaggatgaatttctatattgtacttcagatgttgtgaggaaaaagacatgctttctgaatagtatcagcctgtggtaggaagaccagggaagggccaaaatatttgatttatatatttttctgtttagttttgtacttcaggtgaagaacctcaaagacaaatgtgttaatcagaaatacaaaagaatgggattattttaaattctgacccaaaatagtttcctgattccatatttaaacacaagcatactttacataaaggtaccataaaacaaaatgttctaatttcagcttgcattgtttattctgaatccaattctttcatgtatacctacttggtcatcgatttttaatggtttcaacatagctacctatctacctaccaacctagctatgtttcatgatactgggtattttaggacccaaatctgaaggtgaaacacaaggtttcagttgattcagaagtgaacgaactttgaacctctctattccctccctcctcacccacatgtacatatgtatatcttgccacttgtgtcttcatatcatgtttagtttttatgaagcttattttgttgtatgaagctattggtaaaatgttattcagagaggaggtgaagaacttacccct

SEQ ID NO: 75072 - DNA, 1089 bp, Homo sapiens
aggtgagaagtcctctgtaagagacagggctgggtagcctgccctcatcctctccaaagcccgagttcttgcctctgtaacaaatggcagatacatatacagaacagctaagttaggcagcagatgagtaggagaaaggctgagataaccttgagtaaaaacagaataaaggggaaaatgtataggccaaaggggaaaattaatcggcaaaataaaagcatgaggaattaccctcttgaaaagagcaaaaaggcaactggcttcttgaatgaagagatatagagatgatcaactttgaatttttcagcacattacaagtacaaccgtaacagaattgccattgaactgcagaattcaagagatggtcttcttgcagaggtactaatattaaagatgaactgctacagaaaagaagcctacttactaacttactttacacaacccctctcacatgccctggtatttgacatttgcgcgtgaggcttgatcagcatcatatcctctgaaagccagctgcctttagtagatatggctgcctggcaggataacactccttgctatagggaacagaaggtatcccgtccccaaaagaaaccttcactcaggtttatgcccccaaactctttggagggagataccatcaccctgactgcatgccctttctaagacacaggctaatccagggttagttgggcagacaatggtcacccgtatattgagatgtgaagagcatgggaactgtctcctttaaagcagcctccctcctgcccagtagggatcttgaattaatatgtgtggttgagtctttaccccactcacttcattcattttgggtactcccctaccaaaaactccagggaatggagcactgaactgctgagctgagatggggagagtgtggtggggaaggcgctggcccagggttatcagcctcaacaaggccagctaggcaggaagcaagtaaatctatttaagtaaagaggacagaggctgcatatccaacataccacagagtgttgtgtacatagagtgtacaatcgatgtttcttatataattgttgaggtgttatgagaagtagggattaggtg

SEQ ID NO: 75073 - DNA, 2294 bp, Homo sapiens
atttaagccttgttattttatgcctttaaatttatgatatagtcaacatatatagttgctcagttttaagattattctcatgagggaaaaaaaccatttgatcatgcttttgaatattttaaatatttatagttcatttggcactttatctgcattaagatacttcagaatcttattcagcaatttgtgtcgttattgtttacagcagaactattcactggctgaacttgatgagaaaattagtgccctcaaacaagccctcctcagaaaatcaagagaagcagaatccatggcaacccaccaccttccatgaaaaactcctctcatccttgtcattttacttttttgtatacatatgtgtaacttacactgttattaattcaacggatatatatttatcaatgtagacttctctgtgaagtcaaggtttattttcacatgagtccagcttgcagcaagtaatcttcaaatattccagtaagttttgaaataatgaatgcattgaaaatagcattgttggaatttattcccttctgttttaaaggaggtattttggaaattgaaaaacttaatttacaagtgctggtacatcttttttcttttgtggaccacaggaaggaagatttattttgatattgatactttaaaaggactttatatttgtaacattgatgttaaccagtttattagtttaaatcagtactttgcatataataagcattcaacaaaaatttattgactgaaatgaattttaaatgcatgtgtatgaacttgtttttcttaatctttaagatgtcagtattcatgtaaataaacaatagatccagctttatccctttgacggtgtgactttgatcaatttacttaatctgtctttgttcttatttcccagtctgtgaaatgggaatgacaatagtagagactaccttattgattgttacgaagaagaggtgagatcttgcatgtttgaaactgtctgtcccaagggaattgctcagtagatgttagctaatattataaaaccaggtctgtttttggacagcaattaggatattacaaagaaattatagtacctctcttttgagagcctcccctttacaataccccagttacattaggcagtacatacattaccacagttataaattaaacatttgaaagatgcagctacagttatgtggaaattctttcatggagcagttgttcaggtcaataattgtttggtggttcactcctgtaatctcagcactttgggaggctgaggtaggaggatcacttgaccccagaaggtcaaggctgcagtgatgcactgtattccagcctgggtgacagagtgagacactgtcttaaaaaacaaacaaaaaaggtttggttgcaagaatcagaaatctaccaaatagcttggaaaagagttgttgctaaaaaggagcagaaatctggaactttattgcaggaagtacagtgaaacactgtaggatctagaaagtcgccagcaattaatctctttctgtgtctctgactgcctctcattctttgtctctgtcctctactcaccttgttttctgctctccctctccttttgtctctgttactctgcctttgttttttaaatcttacacatagtcatctatgtacctactatattatctttctgtggactggtttctctgaagacctttttatctctgcttccccacatggagtgacatgttagtcctgtcttcattagtcctgtcttcagagcctcggcttgttgtgtttgagctgctatggtgcaaactctgaactcagctctagaacttcacaactccagtgactgctgcttacctcatgttttgtgtttcttagctcatattctccagagattaaaccagactcagtgtgaccaggcgtctcagtcagctggggccagatggggccgaacctcttcgtaagaagtttgcagtgtacacacaaccttgcgaaaccatttgtggcagccctgaaattgtggtcacctcatagaaaatgtaggcattggaatcattcccaagaagataggggctagttggattccaccaatgacttaccactgtatttcatttctgcaaagcaaacttttatccctcaagatgttcttttctagcatgatcctgtattataagtacagctacaaatacctattccccactctgcatctggtccatgtgatcatcatcctgtcagaaagacatcctccacatttagtgacacattttactatcagcacaccagccattcagtagggaaaattaaaataaaaaattatcaattag

SEQ ID NO: 75074 - DNA, 1056 bp, Homo sapiens
ttgccattcaaaagctagtgcttgtgtgaaactaagaaaaagtctagaaagaattcattaggccaaagtttaaaaggctcattagtggatcagtgagaatgttgttagcttcaactaagaaatttgaactcaaaactggcttaaacattatgtaaattataaaataggaagtccatggtagcacaagcttcagatttaattgattcagtggctaaatcataattgtgagaaaacaggtttctttcccctcttaactctgcttggtgttaacttctttcccaggcagatggcaagatggctacagcactttcaggtgtcttacccaatacggcagtatcctgaggaactgccttctttaagggctttctctcaaaagatgtgaggaagctttttccagaagctctcctcttaatctccagcagacctctcctttactcattggccagaactggacccatgcccatttcagtcactgacaagaccgggaagccattggcttgggccacacagagaagtagtggataggtagctgcttgcataaacaaccacagtgtctactatagtcagtccagggtgtgtgtatgtgtgttttcaccccttggcctcatataccagattccgtttttcctttgtctgttgtcacttcacttgttcaataccctaggatggaaaggttatgaaaaaaaactaagcagaaaatccccagagcacctctttccgaaatcactcaggctcattagcagcgggtagttgatgggaaaatatgtattgccaaggatgagcatgttgctgcaatattactattatatattgttaacgtcatcctctttagagggtaacttgcagaatataaggtagatgttggttacagacagtaattggtattggtaaattggttggttttttttctgtcagggttcccaaggctgtacataatttgtacagtattttataaagaaaaaaaaatgatgcttagatttttctaaacattacctttttttttttaatctagagcttttctggaaaaagaagaaaagttcaaccacctcaagtaag

SEQ ID NO: 75075 - DNA, 1036 bp, Homo sapiens
aagtctaaaatgcattcaacacctctaacctaccaaacatcatagcttagcctagcctaaaacatgttcagaatgtgtacactggcctatcatgtacagttgaggaaagtcccttggcagcacagtacactgtagagtatcgggtgtttaccctcataccccatggctgactgggagctttgctcactgccactgcccagcatcacaagagagcatcgtatcacatgtcactagcccaggaaaagatcaaaattcagcatttgaagtacagtttctactgaatgtctgtcactttcacagcattgtaaatttgaaaaaccttatctagccatcataagtcaggaactgtactgagatttccttatacctaaaacaaacagtaaagttaatctagtgtatccacggtagatatggtatttctaagtgttctttttatcaaaatattctgctcagagctaaaacaagtccaaaaggccacattttactgtttttaagtcactgagcgactgatgaccttattttcctcattctaatatttcttgctttggttctatgatacagtagtaatctgattgtttaatagcatggaaactatcaatatattacaggttaaacgattaggagaacaaggggaattttttttttttttttttttttttttttaagatggtgtcttgctctgtcgcccaggctggagtgcagtggtgcagtctcggctcactgcaacctccgcctcccgggttcatgccattctcctgcctcagcctcccaagtagctgggactgcaggcacctgccaccacacccggctagttgtttgtgtttttagtagagactgggtttcaccatgttagccaggatggccttgatctcctgacctcttgatccacccgcctcggcctcccaaagtgctgggattacaggcatgagccaccacgcctggccaagggcaattatatttgcatcaagtgtataaaaagccacctcttaggaagttaggagactgatcaatcgccaaattaaacattgattcctta

SEQ ID NO: 75076 - DNA, 1002 bp, Homo sapiens
tgatataagagttctaaagatctttattcttcacattagccatggaaagctttaaatgtaatgttttcaaaagtttaagggcatggccttaacagtccatttaaaagaacgatcttagagtatttccaaagacttactgattttaaattatgatacttgaaaacagtaagtaccaacatgcttttacaagtatattgtttagtttatagcatttatcactcatatgtttatacatgtttttcactttatattttgaaactctcaagggcaggaactatgtcttgttcatctttgagacacagaatgtagtcaatatcgagtagatgtgcaaatgaatggataggacttggctgatagctcattattggactttgaaggtgtgttaactttgttcaaagcactgactgagagtaatttttagtctgtaacagtaactcctggttcttaagggaagtatcgggggaggggaatgctgaaaatcaggtcaacatcatgtacacaggccatgtgcgtgtgaacgtgtggtgggtctgaagcatgagtgaacaactggattcagctagaaaattagattgtaaacatatttcagagggccttgaaggtcacactaaccagtttgcacttctagtatcattggagcacaattaagttttagagaaagagagaaacttgtaatttaggtccctgtctggtggcattatgaagtctgagttggagagaaattggagtcaaggaaactagtttaggaaacatgtcattatccaagccagagagaaatgaaggtctgaatcagggctctgggactagaagggaagaaaaacattttagatactgcacgcatagaatcagttgccttttacaactgaaagaaagcaagccagtcatggaagaggcctccttacccttgagtttccttagagcactggttccctggattcatatgtgtgtgtgcatgtgcgtgaacgtgtgtatgacagtcatgctctgcataaggatgtttca

SEQ ID NO: 75077 - DNA, 1007 bp, Homo sapiens
tctttcagttgtaaaaggcaactgattctatgcgtgcagtatctaaaatgtttttcttcccttctagtcccagagccctgattcagaccttcatttctctctggcttggataatgacatgtttcctaaactagtttccttgactccaatttctctccaactcagacttcataatgccaccagacagggacctaaattacaagtttctctctttctctaaaacttaattgtgctccaatgatactagaagtgcaaactggttagtgtgaccttcaaggccctctgaaatatgtttacaatctaattttctagctgaatccagttgttcactcatgcttcagacccaccacacgttcacacgcacatggcctgtgtacatgatgttgacctgattttcagcattcccctcccccgatacttcccttaagaaccaggagttactgttacagactaaaaattactctcagtcagtgctttgaacaaagttaacacaccttcaaagtccaataatgagctatcagccaagtcctatccattcatttgcacatctactcgatattgactacattctgtgtctcaaagatgaacaagacatagttcctgcccttgagagtttcaaaatataaagtgaaaaacatgtataaacatatgagtgataaatgctataaactaaacaatatacttgtaaaagcatgttggtacttactgttttcaagtatcataatttaaaatcagtaagtctttggaaatactctaagatcgttcttttaaatggactgttaaggccatgcccttaaacttttgaaaacattacatttaaagctttccatggctaatgtgaagaataaagatctttagaactcttatatcaaaatgtccaacaagtattattaacttttgtcataaatcctgttttatacacatataacttattttggagttttatgtctggtcgtaaaatgagaactttacataatctgattacattttataaaacaaatacaaatg

SEQ ID NO: 75078 - DNA, 1689 bp, Homo sapiens
ggagaaatattaattgaagaaaataatatgacatattgcaaccactgcattgaattatcgtcatttgtcactatgcatttttgtcctcccatgtaactatcaaagcatatcagaaatataaattgttctacatggaagctattcaatatcttgtaaaatgaatttaacatgaaactcctagaatataggaagcataaatggggtttggagagaggaagtgtagtacaatatgtccgatagtgtataatacaaaaatacgacctaaggacttcattctgttttacttttgttttttattttcttaagtattttccattcctttgcataagtgtctttgcatggtattttaagaataaaaattgtgaaaagaaagaattattcaatagtatctcagatttttttttaatgtatttaggtggtccagtgccaagagacatttatcagagaattaaaaaacttgaggataaaatccttgaattggaaggcatctctcctgaatattttcagtctgtagtgagtataagtgtcttttaaaaataaatgaaaatgttattgtattctggattctttgtggtttaacagtcactcattgatctataagcaaaacactattttaataattcaaagatgaatgaacacagtcctgtataggggatatatctaattccttaaaatctctggttctgaatatttttaaaatttagaatttttaaaaagggatacttctattatatattacccacattctcaaacttaggccattttcatggcatagtaagtcagcctgggtggtggttgggcctgttactctgaacttgctaccttgtaaaacagaggcttcctctgtaaccttgctctttcagtgatccctctgcctctttaatctctcttccccaacaggctccttctctcagctcatatgcagttaatactaaacaaacacacacctcaagctgccactcttattctttaccttaaccaccagactttctatgtttttgtaattccttaactctagcattcattcattcttaccccgttttccaagaaccttaagaaacagtgttgtgctggtaagttagtatctttggcacatcaacatttttcagaaaaatgatcctgagctcattgtgttttcctcagtcttctgaggtgattatgtataatacctgccttctctaagttttgttttttttttaaagcagtaccatattagaactaaaataatatcaaagtgagattataccaaaactcctatttctgaaaaattatgtgagatagcccattttagcatggatcatataagttagtggtgaaaatatatttaaaatttattttaggtatgacagcaatcttccaaagttatagattgagtataagagtgagttacagaaaagaagtatttccagaagaagaaggcaggtcacgtaacaaaagggagcagcaagtcctaaatgacaaaatttcagagaagagttttagtgatttactactctcaaatgtaaaatgaggtttatgaaaatactaagggctgaagcaaagatcaaatgagataatgctgatcaaacacttagcatactgcttagcacatggtaaaaacctcattggcatttatttagttttataactacaaagtagctgtataaacgtggaaaagtcactctattcctctgatcttcaagatgtcta

SEQ ID NO: 75079 - DNA, 2752 bp, Homo sapiens
ttggaatgaacatgtttcttgttgcctctaatatctcatggctaattattatgaacatagaattgtcagatgaacctagaaatgactcatatcacattggtacactgattctcttaatgaaataatataggctggtattgggtcctgaatttagctgtgtgctactattaacattacacatgtgcatctctaaatttggtatattttcctgttagcttttcagaacaggtgcaacaatggcaaaatctcaggtactacaaccaactacaagcgactatgagaaagggtttgttgagagagcaagcacatgtgtcactaatgttattcctctgttctccctgctaactctattattataaaccaccaggggatagaaattgacgagaattgaaatgctcagcaggattccttggcccattcaattctttgctggctcaaaacagtgctagcaagaattgctgtggagagtgactagcagtcatacactcacaccatgctgaatttctcactgatggtcagttaatctatatgtttggaatatagttctggaatggatgatagcttctttttttaacccttagccccatgaaatggtaggaagagaatggagaaaggatggccctttaagcatattttgaggtgcctccaaaaaaaaaaaaaaggaggaaagatgtctatttagtctctagatataaaagctaagtggatttggaattttatgcatactatttgatttatcaacagaactactaaggaaagttcaactgaaaaaaatacaaatgtattttaatatgttagtgtgttccttttaatacctacaaatttaacctaactataagcagtggaatttttaaaaatcaaatttcataggggggaaaaaataattttttttaaagaatctcatttaccagccattttttacaaaatattcaggggaattttacaggagatttactgccaatgtgtggcctttaaacattatttcaaacataagtatatattattactatgtagtatcgtatgttaatatataacaattatgttaattagttgtattatatgttaacatctttccaattttccccttttgtaatttatgcattgatacttaatttgaaagaaactacttttcagcttggaaaaaaatagggacaaattttcacaatagacctttactaaaatgaaacttttttgaaaagtggtgggataagaagaagtagatgacttttgtgatgaagggtttttaaaatgagcactggaaatctaggtagagtggaaatgtatgtgtacttgaggttttgaggtcatctttgtgtggagttctgaaataaaaatgttaaataattctttttgttggatgttcactaatttggtcattaaaataaaaaatgctgaattaaaagaattctagtaaaaatgatgagttttatttctacgatgaagtagaatttaaatactctatggtagattattttctccagtggcccaaatagtgacattggttttcaaaattgtatcaatttgtgccacttaatgttgatggcttttctgtatataaatctgaacattaggtaagaatattagatattatgataaattttgacaggtaaagaaggtcactaaattctatcctatgtgtgatagtaatttattgttactattatttattaaaattattatgagtaaaatgttaatatgaattattgaaagtttattaaaatctcatacatttgaagggaagaatatatttaaacttatatttatctaaattctccttagaaaatagttgtgcaagaactgatgcgatttttaccccttaccccggatttaaaagtcacgtaaaaggtaagtaaccaccacatgacatctgagtcactgacagaagtctagattattagcaaaatggaatagaaataactttcccatctaaattttattttaaaacaaaaacatcttgccgtccttcatacttgtggttagatggtctttatgaaaaaaatataaagtgctgttaaggaataagaatttctgatttttgaaatacaaatgtatataggctcaaaagtttcttaatttagtttctagagttgtgaatacatacggaccacagactagacctgaaggaattccagggtcaggtcataaacctaacagcatgcttcgagactgtggtaatcaggctgtagaagaacgactacaaaatattgaggcccacttgcggttacagacaggtaagcaaagtgctaagtggcacctcataatgaacctttgcaaatggttaaaaaattgcagttcatttagtcaccaaattttcatttagctcctaacatttcttgaacagtaagtgccagtcactcaggaagtgttatgtgtatgtcaattcacttaaaaggtcatagtacccttttgagatggtggtggtgttatcactgtacagataaataaattgaagtttaaagagcccaagcaaacatgcctaagatactaagtgacaactctaaaaaaaaaagaaaaaagagatagtccagtcttgcccaggttgtacttgaactcctaggctcaagtaatgctcctgcttcaacctcctgtgtcagtgggactacaatcatgtgtcactactgcaccctgctcaaacccaagtcctcactgggtgcagagactgagtctccctctccatttagtcaccatgtctgttgattctgttttctaaataaatatctctcaaatctgcccacttctgtcttatctctac

SEQ ID NO: 75080 - DNA, 1783 bp, Homo sapiens
atgtaagtttgcagtttatctctaatcaaagtgtaaaatgtgaagtgtcaaaaagataagtggaaaaactggattggtcagtttactgtgattaaggtgttataagatttcaaaagagtagtatagcgaacaatggaagcaaaattgtaggtatgaaaaaaataattggaacgttattagtgttagtgtgttttgactaatggaataggcattaattttcagccctccattcattgactttgtgggaaattttaactgtttcatgttaaaagtaatagttaaccctgtttttaaagggcagagcagtgagctctagaactcaaatgagacctcattgtggggagtgggggaggggaacagtaaatgagtaatatagtttaaattctacaacaggggttttccccctgtagtatagtgataggcctctgcctgttttcagctatagatcttttttttttcttgttcgttttcttttttaaaatttaattttatgaccaaaagatatcttgccatgtcaggaaaagtctgagtgttcactcagcctaacacctatatatttcatgtctatgcttcctcattcacattggccaactgcagtttcaagtggagaatctccagtgatacagtgataatgcagggctttgctgagtgagagcactagctctcgtgttaaggaggaaaaatactaagccttagtgttctgaggaggcatttgaatgacatgttaattaagtggcattggtgccagaggctgaaggctttgatttggcacaaaataaaagatgagtgacagaatgattctctcaaagaaaattttaaatttccttaggttttcttttcttttttcttttcttttttcctctctccttttttaaaaaacaaatttatagcaaatgataatggttacaatagcagagaatagtgagtacttatatgtggtcagatctatgtgtcctggtataccaactttttatatttattaactgatattaagtatttcatttacttagcagaaatttatgtaaatatattaagtgtgtaattaattttggtcagattgaacctcagcagatggaattgtgttgttctcagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaagtaagaaggttttttggcgggggcgagagggtattattttaaaaaatcttatgtttacactgttaaaacttgttgtttgtagattgacagacgaatatctgcatttattgaaagaaagcaagctgaaatcaatgaaaacaacgtcagggaattttgcaatgttattgattgtaatcaaggtaactacctggaaattaattttcatagggttttaagcacaatttttatagttgctctaatcttttatttattttttaaatgaatagcttttagaacacaattcaatttatttcatggatttagttagtaattaagacagtagagtttccttctgcttaataatagactatattgcaaactggttttcattttggttacacaaagtaaatgctaacattaaaaagtgtttatcacaggtgaagattattttaaagttcctttaggaaatgaaggtgaggtacgagtg

SEQ ID NO: 75081 - DNA, 1517 bp, Homo sapiens
catgtccctagaaaagtttttgatggttcacttttattcattcaaaagactgcagatgggcgctctcattgtaaaattttcactcattttgataataatcttatattcaggttcttggtagttttctggatatgattttattctattagatcaccaactgatagaaatttccatataatgagctgtcacatcttagcatttacaaaagatctggacatttcatccagtctgacaacttatttcactgtggtggagaagtctttgtttttcagcttcagacttccattgctaaataatagttttttatttgaaataaacatgttgccatttatccctacactttatatgtatgaataatcttgacttttaaattagtttaaaaatcggttaaaagttaaaaaactaaaaatgtgatttggaggacatcagaataatgatatatttctgatatgtatttgtgtacatacttaaagagaaagatgcatgttaaaactttcacaaaacacttgtacttcctctgtttaaggctctgagctagaagtagtaggattctgaatagggcaagcctatattggactccatccaaaggtttgtatatattgaagtatcaaaagagccttcatcttttcatctttcatgaatggttttacctctaaaatggtcccattacacagacctaagaatagaatttgaacgacatgtcattttgtttttgtttttttatgaaaatctgtagctttcttggccttttgaaatggtaactgggtagagcatttcagtgtattattaaaaacttgataacttagagcaaaatagacccgttactctagaaatcttatttttgtgacaattccatatgtagagcttaatcgtgtaatttttgtgatgttgctggtttgcccctttgaagcttgacctcagagatgatgtggtgaaaattacaatcgattggaacaagctccagagcctctcggcattccagcctgcattgctctttagtgcacttgaacaacacattttatatttacaggtaaatttcttgttagaaatgataacccgatattgaaaatagaaattgattgtggttaagttagttggagtatttgacagttctaaacactatattaatagtgttgctaataaaacgttatttacatccggatttaatctaaatctgttaatttcagtagtgatcaggacagttaagggaatatagcccaaaagaccaatgtgggtatgagtgaatgaatgcaattctattcaattctagacctgcactgaaaattcaatacagttccatctatggtgggttataattaagcaataagacacggcaggtgtgtgtcatgctatgataatgattccatgccttgggtgagtttggaggctcatggagtgctttcagtggttcaagaaggggcattatcccagcatgacacatcctggagtgtctattgcaattaaacagtttcagcatagtttttaaaaagaaagtaatttctatgacattaatgtct

SEQ ID NO: 75082 - DNA, 1016 bp, Homo sapiens
gtccttcctcggcgacccgcgcgctcccctccctctccgttaatattctccgataatttccgaggcaaagatttctatcttttgggcgaatttgtttcatctctcttgaattcagaaatggagccttcaaaagtcttaatgtgtgtttattttttctagcattcaaatgaatgcgaagccacggattgaatcccgtcactctttgggggttagcttctcccgatatttcacacggaaaacaaaactgggtccctcttatttgtacttgtccttaacctttgcagcaactgctgtagatgcggctctgtccattctctaatagattttaccaggggctggtgacagagaactgatttcttttctattagggtttagcacatctttgttgaaggcctgtagaatgaccagggattagatttgcatctcttagacgccctgtgtggtctttgtgcgaagcttgtaactgttaaaaatgacttgttaggaagcgtgtgggctctcatcgctctccttttgacagaatgattgtgaaattcagattggccctgtaggatttagcccacagattccacctgaaccctaagcaattagaccctaatctccctgcaatcatatttgagttaggatttgttgcactttgtttacttcaattaaaagcagtggaataatttttttccagcttttaaagtgaaatctccaggcataaaaccttaggacttcttagaaatgcttttggtagtgatgaggatttcttttccgtgtggtttcctccaagtcctcatgaccatccccttccttctcccatttaagtgactcgttttttcccctgttgctcgccaatgcccaaagcgtcttcacaggggctgaattcgcggcgcaagggaagaactgtgtggagatgacgcccagctggaggggcgcccaagctcaggccgtcgcccaggtccccgatggggatcctatgtcccgccgccgcgcggagctttcccaacacggcccgctggctgactggcccc

SEQ ID NO: 75083 - DNA, 1094 bp, Homo sapiens
ggagcattatcttaaataaggctagtcaatttaccaatgtggtgctgcatgggagcagagaggactaacaaaataaaatagatctgccagaattttgatgttcaggagacactacaagaatcctccctctcctcactgagcttggcactgattaagagaaaagtgaatatatattcaaatagcacaggtatgcgcaacaatgggaggacctaattccacaattgcattttaattatataaatatactatgcatgaatgtactacacatataagtgggtatgaaacagattttggaaatgttgggttcttttaataagaaagaaaaactctgatttataatcccacttatcaaacccatataggacaaatattttctttgtaagataatatggaaagcacagaaatgtgtaaataagctatgctcttaaatctatctgttttcataatgacatttgctctctcattagtagaatagtagtgtaatgaataggagacccaggtaaactattaaaacgtaagggaggaaatctcatttgcatcattgtaaactataaccacaaagagaagttactgagaccatattgacgtggtggaaagaacaattccccctttatccttgctttcccttctctgcagcctctgattgttcccctcttccaagaatcatgtattggaaaccacaaccatttctgccattaacaaggtgaaaactagactatggagaaggtcataagggtatagacagaaggaattggctgcttgtttctcacttggcaggatatgtgggtttgggcagggctataaggttttcagggaaactctacctcacaagcaccactacctaaagcttgtgccaagtaagccttagaacatatgtgaatgattcattctaaactgatttcagaatgtttagttgccttcaatccttctgaaaaggcatcattgcaatttgtgcagcattaactttctcccaccattgtcaccatatgatatcttagtcaactgatctgcagctacaaaggaggacctagaattctaacttcttagcaattaatgatgctgtgaagccacaggcagataagtaattttctgat

SEQ ID NO: 75084 - DNA, 1049 bp, Homo sapiens
gctccagagaaagtaggtcttggagtgtgcagtggagaaggccttacataggaggcccacaggacaaagggatttagactgtagagagggcctctttccaggaggctctttgtgggagcacagccttagtcaaattcatcctggtcctaaatggtcagcagaggtctaaccaagaagccacattcagctgcttgccagtggagtggtcagagccccagcaagttgcccactcaggagccagcttgtgtactgggcaagaggagggcagcagtttcctgtgacagaagcactggcagccataaggtataaactgtggcccacttcctttctctccttttcctttaggctgataaggtccttcctttaaagaggaaaaaaccttaggggaaagtttaactagcactctcatcaccaccaatccatttcagagacctaggctgtcagatttttgggggattttttttgttgttcacaagataagctggaaaagataaatgtcaatctcctttgtggtctaaagatgaattcttacaatttctgacaaaagctgaacccaaggcctctctaccagccactgtgagaacagttaagatctcccatcctggatgaaagtacttcaaacccatcacccatcaccaacatcacaaggcagattcacactcagcaaacttattgaaacgtactgtgttgcaggcatttttaaaggtactttcacagttgatctcacagaaaccttacactgtatacataatactcccattttatagataagaaactgcggcttggggacctgcggcttaaggtgcagacatggccaagtccaagaaccacaccacacacaaccagtcccgaaaatggcacagaaatagtgtcaagaaaccccaatcacaaagatacaaatctcttaagggaatggaccctaagttcctgaggaacatgtgctttgccaagagcacaacaagaagagcctaaagaagatgcaggccagcaatgccaaggctgtgagtgtatgtgccgaggctatcaaggccctcgtaaaggccaaggag

SEQ ID NO: 75085 - DNA, 1033 bp, Homo sapiens
tctcatcccaaaccacacacaaagaaggaaagcacaatttcgacaggtcttgggaaaactcgacgaggccaagtatgaggccacaagacaccgtttttagttccgcgttctccctcttctaatcctattaggttttgtccagacaacgttttgctctttcagaagagaaagagcgttctgcgctcgtcgtcttggattcgacaaccataagcatcccgttagggcaaccaccgcagcagactaagttcgactactttctctccaaactcctcccgggccttcttcccaagctctctctttctcctggaggccccgcctcgcggcccggcagcgcggcacgcgcatgcccggtgctcgccgcttgcgctctcccctgcggcgcgccgccgccccgtaggccccacgcgccgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcaggtaaacggttgggcagggaggtttgggcgacggagaatgatagtggtgggcacagatcagccctggagttttcggccgcagacttttccttggagaaggagaaggggccccgcggaatctgtacttagtgaatgctgaccccgcgtggccgggagtgatggggctctctcgaaggtcagtgtcgtggggtcctcaggtggcagacagctctttctgggtatggttttggtattgtctccagtttcctaatactggacctgagcagctgagcatttattcaagggtgtattttttttgtttttttccccttaagtcgcggttagtcagaaggttccagtcctcgctcaacctctgatcgactctgtgcccatgagagagtcgttttatatttcatttctcacacgtggaagtgtgggcgaagaatgaggggcttctttaagcgcgctaagccatgctgtaaaaagatactg

SEQ ID NO: 75086 - DNA, 2237 bp, Homo sapiens
atggcccagaatagggtctattttggtaaatgcatcatgtgcacttgaaaatattgtgtattctgccattgttggatggggtttttaaataaatgttaagtgaaatggattaatgtttaagaaaaacagaggctgtgtgtgatggctcacacccagaatcttagcacttttgagaggctgagttaggcagatcacttgagcccaggaattcaagaccagcataggcaacatgaagagactccgtctctataaaaaaatagaaaaattagcctggtgtggtagtcccagctagtcaggaggctgaggtgggagtattggttgagcccaggaatttgaggctgcagtgagccataattgcaccactgcactccagcctgggcaacagagtgagaccctatttcaaaaaaaaaaaaaaaaaagaaaaaagaaaaccagagctaggtaatattaatagtaaaggtggtaaaagcagatgttacttaggaactaatgcaataggggaaaagaaacctcaatatagaagtgggttgggttcccatgagcataggcaaatgggactttacagctaaggagcagggagggggtcagtggatggaaagttactaacaggaatcatcagggttagagaagattgtggttaaaccaacttgacaggattcttgctgaagtcaggctacagtgatcaaagatggaggattctcagtaaactgacttagcagaattcttgctaaaactggatgatgcagagacagacacagaaacccaaaaggttgagggctagtatagtaaagggttcaaaggagcctcattaaagtttggtcaaggcaagatcctttttatttattttttatgtttttgagacaggattttgctttgtcacacaggctagagtacagtatactggtgtgatcactgttcactgcagcctcaacctgggatcaagtgatcctcccacctcagcctacagagtagctgggaccacaggcgtgtgccaccatgcctgcctaaaatttttttaatgttttgtaggaacgaggtctcactatattgcccagactggtctcgaactcctgggctcaaacagtccccctgcgttggcctcccaaagtgatggaattacaggtgtgaatcactgcatctgactatggcaaggatctctgtcactgaggtattaagtcttctgtatccctactgattttctgagcatgtattctgatgactgagagaggtgtgatgaaatttccgactataattatggatttgtctttctcttttcaccagtttttacctcaggtactttgatgctgttttgttaaatgcttacatatttagggttgcttatgtttagctagtaagttgaaacttttaatgtacttatttagtttgagtaatatctttgttttatattgtctgatatgaatatagccacccctgctttcttttgattagtatttgcatgcttttttcattgtgctctattatcctaaataagacatcgttaggaaagggtagtttttggaatgtttttactttgtgtgccttttgttattttaaataacattttgattttagaatgtatcattttatcaaatgtgacctaagatcctttaattttattttaaggtatgaggatataagtgttcgtcacataattagaaaaacttttgtattattacgttacattcttggagggaatctgaaaggtaatttcctgtggatatttttttgaatttgaatgctgaaatgctgttttgcatcgtctcaaacatgtacatataatctaaaaaaaaatttaaacatcgaaattccttctttttaatgaattattttttgaagtatgacaaacttcttctttaagcagcatgtcttgaaagtaattagtactttaatacttttattatcttttaagtttaatgtaaattgaagccacttccttaatttatgtcaaacagcttattgccagcatgggagtgcagatattgtgtgttatagcttatgatatcccaaagtagaacattttattcagtggcatgagctggcaccatgggctagattattctaattcatttgggtaagtgaactgcagcttagaaagttcatgtacaaaaatgcactgtcacaatttccttttgattctttataagtaagaaactggttttaggatttcagcatcttaatttctattgtctttatttcatgcaggtaattaattttcatcttattttaaattaaaatct

SEQ ID NO: 75087 - DNA, 1024 bp, Homo sapiens
cccattattcatttttgccactaagactaaactaaccaaaaaacaaaacaaaacccaaaaagcccattggttatatgaattaacattacagagtagcagaccaattaacattattaaattaagtcaacaacatgaagagatatatacttaaattccatattgagtttatgcagcgatgtagaaataaaactattaggaggaaaaatctgttacggtcactactgattatatacctctttatgctggtgattgattttaggggcttttattaaattaaatttacatactttttgtcatgattcaaaaatggggtttgactcaaagtttagttacattaaggattaaaatatttttacattaaaactatatatgttacaaaaagactgcatggtctcatttatatgtagaatctaaaaaagttggatttagaaataggaagatgatggttatcaggggctaaaggttggggatgggagtgattggggagatgttggtcaaaggagacaaaatttcggtttgacaggaggaataagttcaagagagctattgtaaaacatggtgactacagttaataacaatgtattatattcttaaaaattgctaagagagtagattttgtgttttcaccacaaaaaagacatgtgagataatgcatatgttaattagcttgatgcacccattccacaatgtatatttcaaaacaacatgttgtgcataaatatgtacaattgtgacttgtcaagatacataaatatgcatttaaaaatcattattaagaggtgaattttgataatcttaaacctgctctaacaggactaaaaattttcaccgaatttttaagaaataaaaaaagttttgctatgttatttattaataggaaaaggtcaacaaagtgttgagaaacgctgcttctgcttttgtatatgtctctagctgtttgttattgtgaccagtggaactttgaagagagttttacagtgatgcttgcagggtgttgctccatatctctatcttgtggagtagc

SEQ ID NO: 75088 - DNA, 1091 bp, Homo sapiens
gatggtctcgatctcctgaccttgtgatccacccacctcagcctcccaaagtgctgggattacaggcgtgagccaccgcgcctggcctgcttaatttacttaatacttggacagaaacactgtgcaactgtattagtattaattttatagataatatttttagctcagttgatttgtcattttgagatagcttttaaaaaaatgtgtcttcagaaacaaatttgtagttgaacatatatttctggatcctaagaaactataatgtggtaaaaaaaagagtacaacacttacataaaatttatagttgaaattataattttaagttgcaggaagaataaaactaattgtttcttcaaggaaatttgtatgtatagttcagcttgttttattttttcttttcataatgcatttttatcccatgttatggaacatctgttttgggatcatatttttactacatgcttttcattaatgaaaacatttattaagaatgactcaagaaattaaatcagcttttgtagtttctcagaaaaattaatggaggaggctgtgacattcttgataatgaacaagaaattggaactataagtctaatttattttactatctttaaaatcttcacttctagtaattgtattctataacctgtaagctgactttaatattacagtttttaaaaatgaagtacgtaggttgcatgcagcactgtcctttgggattgattactacagtaattttagcaaattacatagataaatattgtattttttggtgtttctttgagacatgtcttactctgtcgcccaggctggagtgtagtgtgcaattatggctcaattataaaattgtcattacatgtttaaaactcaaagtatggcttgttattaggatatatttattcttccgtatatgcctctgtttgttaaggtcttctttgttagtatttattgttaaactacagaaaatatggaaaatcgctaaatggtttttgttcaatttgagaaaaatctgttagtaagcattataatatatgatgaattaaagacctaaatgattatttttaactttatttttgaaagacattttctgat

SEQ ID NO: 75089 - DNA, 1088 bp, Homo sapiens
aaagtaacctgaattacaatgagagataaacagaatatttacccatcccttatgaggtgctgctgatatgtaaatttattcttctactttgcacaaatatacttttgagctactgcttaaacactttgaggtccttagtcaaacagttttaatgatgcctccaatattatgaaagtgtgacatttgatgaatgtctcatatagttttgatatctgggcacatgtcaacaaaaaaaattgagcattggtttgttatgcaacacctagataatttataattttactgtttatatccatcttgacattttttatctgccaaaggcaggtttcatttggaatcttaatctgagatttatttggtggatctggaaatcatagctagggttcccacaggaaatggtccatctaccaacagattaaatggcagtcctgcagttgttaggggagctctgcatttaacacacatgcatactcattcagtcagcgctgtggagaaaaattaaagtagtaacccaggtttaggaacaatgtagctaaaaagtcccatatttgctgaatgacaaagggttatatagcagcatttcattttattattcgtgcttgaatttcttgtttgctttgttgagtctgctgacgaatactaataaatgcctgcaacaatccagacgagagatgcctggcaacaaagctatgcggtggacctccctgatcttctccagttcacaacctgaccttttgaaaaattggcttggctaagctgcagaatttgggtgtaatggttattgttaactccagctttaggatttattaatttgtgtgatcaagacttacctatacttcaaagtttcaaaagaccaaacacaatcatccatccattagaactaacattgtgtttcagtgattcccgcttagtatctgactggtgattcttctattttgttttccaaatctaaatatattcttaaacaaaatgagtggcacatataaagaaagtttgttttttcctctttattattggaaaatttatcttttatagattatttatgaaattgttgaattcacaattggtatgtcttcattcttaacaaa

SEQ ID NO: 75090 - DNA, 1011 bp, Homo sapiens
taagaattacatatgcactggggacagtggctcacacctataatcccagcactttgggaggctgagatgggatcgacctgagatcacttgagcccaggagttcgagaccagcctgggcaacataggggagaccttgtctctacaaataataaaaacaaattagccaggtgtggtggtacatgcctgtggtgttagctactctggaagctgaagctagaggatcgccagagcctagaaggttgaggctgtagtgagccatgatggtgccacctcactctagtctgagtgacagagtgagaccctgtcttaaaaaaaaacaaaaaaaacataagaaatcactgtctgtgctttccaatgtggtagctatgggcaccatgtggctactgagcacttaaaatctgggtagtccaaactgagatttgctgtaattatagtacaaaaaagaatgtaaatttctcaaagcaattttttaatactacatgttgaaatggtcatatttgagaaatataatattactcattatttcttgtttgatgagcttatgagaaaattaaaaattgtataagcaatttgagcaatgtatcttttggatagtgctgatctatatgattaaacatatcaccgggactacctcattctgccaccaaccttttctttacttgtttgcaaaggttattcatattgtctgcctccctcattctttgtcatttcccctgagagcagatagagtttttaatttacctttacatcctacacagcacctggcactgtgttggtacttaataagtgttgaataaagtactcattttcaatacttgtttgctctccatatattctttagctgattttctaattcagtatttctggccagatgcgttagcttacacctgtaaccccagcactttggaaggccaaggtgggaggattgcttgagctcaggagtttgagagaccagtctgggcaacatagtgagatctcatctaaaaaaaaaaaaaaaaaaggaaacctaat

SEQ ID NO: 75091 - DNA, 1144 bp, Homo sapiens
cgggcactaaggaaagcctctatatcattaacagaccatgctttctaacactaacataacattgtaagtaactcaaatgaaaagcaatcagaaatagttactgaaagcattatcaaaataacaaacattgcccctagggacatatttttaaaaaactcttaggccccacattcttcagtttatgaagtgccatatttcttcaaaaggaaaaaggatggtccatggaccactgccaactataaaagcccccaggtccccatgacagccccacaactgcttcagactcttaagtcccaactctttttggcctatttgagaccaaatttaccattatctacaacttatcccaatgcttatctgattacagtaggagtaagactagaaactatatgtttaaagctaaagagtgtttccaaaaatatttatttgactgaatgatttaatatgcagttatggtgtttaatatatcatgtgttatttgtttgtttaaatacagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaagtaagtgctcacagccttagatttagaaggaattggggccaggcgtggtggctcatgcctgtaatctcagcactttgggaggacgaggtgggtggatcacttgaggtcaggagttcgagaccagcctggccaacatggtgaaaccctgtctctactgaaaatacaaaaatcagccaggtgtggtggcacatgcctgtaatcccagctactcaggaggctgagtcatgagaatcgcttgaacctgggaggcggaggttgcagtgagctgagattgtgccactgtactccagcctaggcaacagagcaagattgtctgaagaaaaaaaaaaaaagagaaagttagaattggaagaactttttctccctcccttcttccctttcttcctctttccttctttctttttggtgttggctaa

SEQ ID NO: 75092 - DNA, 1117 bp, Homo sapiens
gccaccacacctagctaattttttgtatttttagtagagacggggtttcatcatgttggccaggctggtctcaaactcctgacctcaggtgatctgcccacctcggcctcccaaagggctgggattacaggcgtgagcaaccacatctgaactgcagtagttatttttaagaataatgttggtcctctgaatttaatttgcctgttcatgcacatatacacataaattaagtgtatattgggatgtttttacaatttctgtataactacaggtaattattactttataaataacttaaattttaaatttttttctggagttatctatctaggaagttaaatataatataagaattaagaaaaaaccaaaaactttgaaattaattatatttttgcaagacatttgtcaaataagaatccatgatttttttcaatgtgctttagcttcagcagaaattggctaaagaagataaagaacagagaaaactaaagtttaagctggaactccaagagaaagaaacagaagctaaaattgctgaaaagacagcaggtatagtagaggagtattaacacatggcttgaagaatcacacacaaggttattatatgatgtatcttggtgaatactagcatactggcttatttgccaaaggaggggaagctctcctttttttttttttttttttggctgcttagaaaataggtggctttaacatcctggtactggtattagtgagagctttacctgtattcatactgatttgggcattaaatgcattgttaacaccatgtcaatccaatcacaaaaaggttgtttgttttgttggaaggggctgaacaaacaaggggaaataatgattaccagtgcctctacctttcaaccagcagttcaaataccacttattgttttagctcgttgagaggaaatacttctcctttgtatgaagatagtcacatattcattgccaatggaaacctacatttgattaaaaaatctgttttgtgcaattaataagttttcatctgatgacgtagacgctaatagaggtaatattttccctgagattaaagtgaaaggttgccaaactttcagattatgaatgattaccttaaatatat

SEQ ID NO: 75093 - DNA, 1045 bp, Homo sapiens
ttaaaagatgtttaataaaatatttatagcattctaaattgatgaaaataacagtgttatttagtttctctggaacaaaacaatctagttaaaagagatatgtccaaccatttgcttataaaaatgacacaaaatgaaaattcccaaagttgttttaagggataaattttcaaagtatatctttcctctttaatattttacttctatctcattttaagaagagacttaaagtatttttcctataacattagaaagaattattgttattatgtcaaaataatatgaattgctgaagaaattcattggtttaaaacaacaaaaaatttggtaactgaccctttctttggtggacttttgaaccttttcatattttcccattttatgtatggtcttaataaacttgtcttaaataaacttattttctatctgatgaataggaggtacagtcaaaaagcaaaacagaacaacaaaaactaccttgtcagtatcttaatagaaaaaagagcagtataggactatgatgacatctaatgaattctttatttcttgtaatgtgaaagaacaaataatccacatatgcatggatgtttgtttctatgactgctcatttttatatttgaaataaaaagtgtatttggcaaaatatgttataagcacgcacacatacataagtattataacgtagttaagcagaatatatatgtttaaaaagatcaaaccatttcacaataaaagaaatacttataaaaacatctgaactaaacattggaaacagcaaataggagacaatctgtctatagattttaaaaataaaatgttaattaaaatatgaggtaccctaaggaaatagtaggcattttcttagagtatgtaaaatatagagatttatatttaaagatattcatataatattagttgcaatagcaagaaaattaaaaacagtctaaccataagggaattattaaataagttatgatacatttataatttgagacattttgtaataattaagaatatttgaggatatgagaaaaacttcataact

SEQ ID NO: 75094 - DNA, 1060 bp, Homo sapiens
aagacattttattgtttggcttttaattaaaaattaatgggttactgttaatagattttgaaagggcactaaactgaaaaatggacaagcaaaagaagaaacaaagtattggattattaataaaatcacagttgagatatagatatttaatatcactaatacattttactcaaatgtgaattcaaaataaaagaaatgagatgcaaaagatttcagcttttctgcaatatgtacctatgataaactttcatgtagactgttccttagcttcaagtctttttcctttgtttccccactggttttttcataacacaaatctgttattctaatgtgattttatgatagtttgaaactcagctctgtcccctatcatgttaaaatctctgatggttgactacctttcttttcctttctcacatcaccatcattactgtcattgtcaccatcattgatactgtttattaagcacttaaatgtttcagaggaactatgcttacttctttacaaatcaaacaaatatttattgtggactcattatgttctaggcactgtgttagacactgaatatagatcagcatataagacagatttgggatctcaggcatttttttgcctggtattacttctcaatcataatacaccatacatgttgtaagtagtggttaaatgcgcagacttgggattcagacctttgttctaatctttttgacacttatcatgtgtaatgacagcctcactaagcattagttaaaaatctactataggttgttgtgatgcttaagtgagataatgtttacgaagtgcttaacccatagaaggcactcaataaataataattatgatgataagatgatgatgtaaccatcttgttttctcaagacttcttcatctaatagaggacatactcaaagtgttcctaattgtgtggttatgtaaattactatcccatactaattatatagataagtatgggatagctatttatatatggttttgtttcacaaggaattgattgtttatttcttttgttaaaatagtttacaaagaatttttatttatt

SEQ ID NO: 75095 - DNA, 1054 bp, Homo sapiens
gttgaatcacatatagcatgtccaaatgataaaatttcacctgctattttatattttttaagaatactgaagaatataggaacatatgctgcttattttaattacagggttacaaagctatactaaatatttttctcctttaaatttttatgagtttgtactactgtttaatcagaaaaagttatttacaaagtaattgtataaaatgttgcaaagtccagttttaaaaaaacaaatagtctggtctatgaaagaagttctggagtaataagttgaattcagcattgttatgccaaaaacagaaacatcgaactaatttgagtcggttttggttaattttctactggtgtggggcatctaccatctattttaaaatttccaatagccagtttatgcaaagaaggaaaaattacaattattaaggaaattaaaatatataatgtttgtagttctagaatatatatgtggtggttttataaatgttaattgttctcatatttgcaagaaatgaatttaacatcattataagtcttctccagatggttatttctcatgtaaaactaatggtagatattcatagaatttgagattctttcatatgtagtaaagtctggtcttttacaaaattattgtgtatattatattgcttagaattttccaacatgaattattatccagttatttaatatgtttaaaatcctaatgatttctttttccttctttttaatttagccttttatatttacataactaccataagatgttaacagatggattctttttcctgtgaaatgtctatcctcccaattatgttatttagagaatcatgagccagtgtttaaactagaatgttatccaaggtactgtctcactcgtactgtattttaaaagtagtttgaaaagtgtggaatatggatttgccaatagacttgggtctactaagaaaatatgtactctgccttgactcaataaactcatacttagtgtggttcagcttcttcatatttactcttgcccatattagaaaacaattagcttactaaacaaatttgag

SEQ ID NO: 75096 - DNA, 1305 bp, Homo sapiens
taggtaacagcaagagatttttacttcaaatttagtgtaattatttgtcattgcttttaagggaacatagttaaactttgtaataaaaatactagccttgttttacttatgatggtgtccaaaaaaagagaggaaatacagtttctgataaaaatggaaagtccaggaataaatataatgatgagaatgagtgcttttatcactggggaactttcttcatctaagcacatatgaacaattgatccttgtagtcatatatagcagtaaacattaataacttaacagtctgaagtcagtgcagaagatatggagcattattgaaagatggagtcgagcaggtggcactttaatatgttcagtgtcatggttgactctaaagactagtcgaatgaaattacttgaggttctaaagatttaaaaagcgaactcattttgctgcactaaggaaatgctactgatcaggctttctgtgtcccttttttctaggctagaaaatattaaccctgaagaaaatgacatggtaagccattctctgaggagatttcttgatgtcagtcttatatcttagaggcttaagttcaattgagtgggtttcaagaactaagatgtgggaaaaagaagaattgacacactaataatgtacatctttgctgcaatatgaaaattcaataacttcactcagtcaatttacaattcacatgtgcctattaattaaaaccctatattaaataaaatatattaaaacttcatgtctgactaacatataatggtgttggtagacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaaggtaactctgcatatatctgtaaaagcatatacttaccattttcctctctatttttttaaccattaaaaactgactttggcccagatattcttaattcacattaatttttagcacataattaataccacagtgattagctatattaaaataattatgtattttattatactactgttcaaaatatgaaacctcattttaaataaaatttaatgcagtctcatttcttaataaaattaaacttgttttattacagactaacttgttatagaaattgttatattttttcaactaatcacttttatatgggacttcttacttaaattacagttttctgaaggctgagactatgtctata

SEQ ID NO: 75097 - DNA, 1010 bp, Homo sapiens
cttgcctgttaaggccaaatcagtgatcttacatttctgttttctgaacactatatggagaatctgaactcatcactattttctagaaatgagtcattctatatatctaaatttattatcactcttttaatttctgtactcgtttcttggttttattgttgaaaatatttctaagatatttatattgctcctttagatgaaatataatgagcacaccttttgtgataatttagtggcttattttttttatcaaatattgtaatgaaaagtacagatccagagatctttcatgttcaacattgatagaaaacccatggaagaatcaaggggtaattaaagaaattcagctaaacatttcactgttcagattcctttaccaatataggctgcaagcctataccaagcaccaagctgaaggagtaaactaagtgagaggaagacatgaatccaatctagtgatgtaatgaagaaaattctaggaagactgctgaagaatgcatggaaagtgcattggtctgttctttttgactctttctgcctttaagcctgtttttccctcttactagaacatacttcctctctgcttgttgctcacttgtctgcattatacttcaaagccattttaaatatcatctcttctgtaaagatcactcacatgaagcaatattgataactatgtcatttgtgcccatattttaccttgtatcctgttacaggccttatcacactgtattacagttaattgattttatgcctggctttcctactatcatgaacttgcatgaagatagaagctgtttatttatttgtgtcaatcacagtcccttggatgtgaagttacttattatgtttgtggaattattgaacttggctattttagatatttcaagatacatgaaactaaaagcatttagtgaaatattattcattcatccacattttattgagtacctgttatgtgctgtgtgttgggaactcagcaataatccagatataaaaggttcttactc

SEQ ID NO: 75098 - DNA, 1048 bp, Homo sapiens
ttgtttttttttattatactttaagttttagggtacaaaattatagttttaaaatactagttgactttagggagttgaatgatagactgttttcactaagattgctcttaagttaatcaccactcaatagtttgaatgatgttcctggacttacatatacacatccataaaacaactttaagaacattaaaaaaaaaagaatgcgggtaaatgattgacttcattaaaaactagaaagtgtcctgagaactgtctgaggtctctaaagcttttgctacagtagttggttaatcagtacacaaatatttacttgcttcctgtagataacactagttatcatacttacatgttcagaaataatttgagtctgaagtctcaatgagaatgactttttatataatattcaacttgttgatactttgatttgtcatacgaacttttagttttagccttgttgtaatcttagaagttagagttgcttctgttaggatttaacaatgtttgggcagcacatattatacaagaaaattaagaatgagcacttaagtaattgacagctctgttgagattacaacatttataatggcaaataaagtttgcaaaccaagaggaagcacctgtgattccaggagtataataactgaaaaagagcttaataaactattaaactgtggctatcatccagtaaacactaatactctttcctgaactctgctttgtgttttaaaatagtataagaaacatctctgtccttttatgcaataactgccaacttaacatttaggttatactgttgtttgtttatggattttgagaaaatccattgaagtttacttaagaaccaactcattacaatggtattatttactgaattttattttcctgatcattagctaactacagagttcaacattacaaggttataactgtacaaaaaggatcaaaacaccacatcctagtagttgtattagccagagaagtagtcatcatcttagaaataaatgcttttgcagcactgaagagattataaaaaaggaataagccaaat

SEQ ID NO: 75099 - DNA, 1067 bp, Homo sapiens
attacagggatgcaccaccacgcctggctaagttttgtatttttagtagagacagggtttcaccatgttggtcaggctggtctcgaactcctgacctggtgatccaccctcctcagcctcccaaagtgcagggattacaggcgtgagccaccgtgcctggccgcaattcacaattttttaaatgaatagctttttatgaatacagttaacataataatcttagatagtattacgaagaatgataatagcacagcttactaaataaatagctatacatcttggtatctttaataattttaagttcactcatttttctttgtgacttaaaatgttccttcaaattagtcttttatggataatttaatagtttaaaatatgaatataaattactatattattaaatctctagttatttattttaatatagtattttaggattgtttatatgtagttaaaatatatatttatatatatgtataaatatatagaaacatgtcattgcatggcatatattgcctggtgggtgctgatatgttgcctaatggatgctcaataattatttattgaataaattagttatgttatatataaagtataaatatacacacatacatatcagctgtagtgtatgtggtttcagagattcatccacttaatttttggtatttgtaaacctcttattcttgtataagtattcatctaaattaaattgttgatattttgccagagtttgaagaaacaagttacgttttcaagtttaaaaaaactctttattccaagttattgtaatgtggaaaaagcattgtaattattatttctacatctaaaatggagtgatttttaaaaactcttctaaatgaaaaggaataaaaacttctatagtcgtaagtactttcaaacatctgcagttcagtgtacataattcacattgacaccaaagtttggtttctgttttgactggaaaagtctaatattatttttgtctgcaaaggaaagagttgtatcacatccaagtgggaagatgtttgattataatataatcaagatgatttgtgactcaaagcaga

SEQ ID NO: 75100 - DNA, 1044 bp, Homo sapiens
atcgtgagtacacacgatagtacagttagtgctatgccgtgttcattttctcgggtcataatttgtgtccttagtaacacacactgtgatttgattgcattctgaccaaatattttgttactggctataaaagacagagacacagtttaatatgtagatcatgtgtctcctgaaaataaataccacataatatgtgtcacaaaattttcaagtaaatttttaaaaatgtgataggtgaattaagttatcatacagctgatgatggaatagacatggcaatgtaaaaaaatctgcactgagtcagtattttatcatatttggagaatttagtttcaacaaaactatctgctaaattaaattaatgttgattaaaaatgccttgatattatggttattttatttatttttaagtgtgttttgattttataattgtattatatatgtatgaagtgtgtatactcaatttcatatttgtacacaaacatcattttgcaatctaagtcaatatcaggagtctggtaagactttttcttctaaaacattttgtatactcaaagttgtgaaatattgatacgtactgcctaatatgatttgggtcagaggcagaagaaatcagagtagtaagaaatgtcattttggatgatagctgcgtcatgattgtaacataataagtaatgattttttattcatctattatgacaactatccatttgtcaaataatctagaaagaactttttccagatcttaaatcagtatgtgtccttattagttgttttgtaaatattctaattttaaaatagataaattaaggaatggtttttaatgttttcctcaatggtgtgtttagtactttatttctttaatcccccatgtgtcttcctattgtcctgatttgcagcaccccattttatagcctgtgtaattattatgtgaagtgttttacatatttatattgaaatcttatattcaaatggcaagatatttcaaaaattttttgaacatagatgcttctattggctcattgaaactttaacttattattt

SEQ ID NO: 75101 - DNA, 1628 bp, Homo sapiens
ataaaattgtttccttagatatttctaaaatctagaaatatttctgaacatataccttataatttttatttttaaatattaataaaatgtgatcatacaatatcatattgtagtttgtttagaatccaatatgatttttagaagcacagttttattcaaccaacagatagataatcagaaccatttggtcaaagaagtaaataattttaaatatggtttgaccttaattttataaaactatttttgtgatttatataacattcagattaataaactaactgaaaattataattgaatttttagaatactgtaagcaatgtttttatttattgtatttaacattacttttacttaccattcttgttgcaaaaaaaaaaccttgtcttttagagaatacaatgatattatttacattaattcatgtggcttggtgaaaaaaaatgctataactcctttacttaatgggattcttcccctgtggcagtgcaaacggttagagcaggagcttcatcatgtgaaagagcagaaccagacttcagcaaacaacatgagacatctgactgctgaaaacaatcaagaacgtgctctgaaggtaaatctccgttccttcttgcaggcaaattaaggttgtaagcccttggtgccagctttctgtgctgcatatatcagttgtgtacatttcagcagaagtgagctgtggtgtttgccaacaaccccttctttaaacacagatacagcacccttttgttatggtattattttatttcacgtatgtgtacgtgaaaacaacacattttctgaattttgagtggtggtatattaataacttttggtaaatgtttattctgtttcttttttatatcattaccttttgtagttaataaaaagtgaccatactaaaagaaaaaaaattaaatcatgggcctttgctttgcatcaatatttattataataatttttaaaaggacttgtaatattcacagaactgacagtccttgaagaatatgtgtttgggaaatgaatatgtgtttgaagagcgtgtttgggaaatgaagaggtacttagaatgttacaataaaagagagagaaagatggtaaataataaattcaactagaactttaaacaagtgaaatacacatttcatgacaaaaagttctgtctcattgtattatagatcgagtaattatgaaaaaggacatggttttaattctactaattgtatttttttcttaaggtgcttgtgacttttcattctactttttatcttttgcctagttcccagtatagtgcctgtacacagtagttgtctctaccctcaaggtgcttgcattctcatgctaacctgttaaggtttaaaaaaagaaatccatgagaaacagaaaagattcatcagtttttattgtacaataagaaaagatttgctaccaagaatattatattctactttgctgtcttaaatttgtttttttgctgcatattacagagcaatatcatggcattagctgtgtaattcactaagctggaatcatgtaccaaaattgaggaaaatggtgacattttaatgtagaaaatatttttaatctgtctaagaagtacgagatttggtggaagtcaggtttttccacaa

SEQ ID NO: 75102 - DNA, 1598 bp, Homo sapiens
tggtcaggttttaagtctgaggtgcctcttttaaaaattttcatactgtaatagttgctggaatcttacttgtgttagtcatttactggtttttatctagatctacaagttttcagataagtactttacttttagaaagaccaagaaagaattaccaagaaaacttgagtattctaagatatattaatatcatttgttttaataaattctgctgtgttaattaccttcaccttttgagaggttgtaaaatgtaagtagtaatcttctttctaattaagcaaatgttttatatcttatatttttgtaaatttgatttttaaatgacattcctttactggcttttgttgctgttgctgttaaactggatttttatatgctgaaagatatttaacatacaaatgaactcagctcatcatggcagaggaagaaattcattgcctagaaacagattgtttgtgtactattagatggtaatataaaccaacaaaagcaaggaaattaacttcaatactgacacactgccctttccttgctcttttgtgcccatagataacatgcatattttataataccagagtatagtggactcagttaagaattgtcaaacttaattctaaatgtctttacttcgttggtttgtcacaacattattattttgtctcaatactatataatgtcgttcacatttgagatgaagcaatgcatggatggatctgaaaaagatggcaaaactttacttttctcttatttattattgattgcttctgcttagccaaatattatatagctctgatattagttcttcacaatttttaaaaaggtaatagaaaatgataaaatatctgaggaaattttgggaaaaatatagctactgatataaaattgtcattcagttttatttttattcctattcattaatttttattttattatttaaaaaggcagacatctctttatttaaagcttacagcacaaagaaactaccagttttttaaaaaaaattatcaaatatacaaacaagtgtgatttcagagaacatttcttacatggattgcacaaaggaattatttgtgaaattctgagggtaggactaaacctctcaaaataacctccaagattaatttgggaactgattgatacttacttggccattcccttaacagtacctgtttcttgatgtatatggtgaaatataaagaattaatttttctttagttcttatatttactagttaggttgtaacttatcaattcctaatgaattttatccctgttttttaagggcaattttatacaattataagtaatagattgatatttcagtgtttgaaaattgattccatatatgaattgattccaaaacctgagttccatgttttgtagcagtttgggaattattttactttctgtcttctatttttctctgtaaatgatttctactcctacttaggtacctattaggatacagttttctaaaagagaattacatatttcagttaaagctctgcatttttctgagttgtacgttaaactttccaagaaaaaatcagatattttctgtaaaaactatacgatagaagaaataatctaaatgtggtc

SEQ ID NO: 75103 - DNA, 1065 bp, Homo sapiens
gctttgttaattttttatcctttatccttttatcatttctcaagttttctttttatatcttttgctttataggagtggtttttaaaaatatgtttataaacctacaaatgtaattttccctttaagttgatttatgtcttctttagtggtttggaaataggttgagtttcagcctacctgtcatctcttagctggtcattgtttccaatttatagacttgtgctttttaaataattatatggtacatttttattattttatgacattcatatgactctgaaatattatataaactttattctcaatttgagatgttcctagctatgatattttagtttaataaaattgaggttcctttctgatttgtttcagtatttattttcaaacctctttaattctttagtacagtagacatagcaagatgtcatatattctgtgatgcattccttctacatgcaaattcttgattacagtagcagacatttccatgagattacagttatgtcaagcctggttgatgcaaaagaggaataattctgtcttttgacaataaattgatcttgtttctccatataactggatttttaaacactttttgtgtagttgaaacccttttgagaagccaatgcaaatgtcgagtcttctccctaaaaaaaaaatacaagtttacagaaatttgcatagaattcaaggagtttatgtccttcccaagctcactgatgagctctaggttaagaacctgtattctaggtcttattttatttggataattgttaattgtttagatagttgcttagacagttgttaatgtagtagagaacagataaatcactgagtcaaatacagaattaagtgcttagttaattaatatgtcaccatgttaggtgttaaaaggcataaagcaataattgatcttactagctttaaatataaatagtattttaacaatatcgttcatactccataatggctacacatatatctgtgttctaatcccagcttttcaatggatttgaaatacaaattatagttatctcatttttcccaacagagccaattgataat

SEQ ID NO: 75104 - DNA, 1078 bp, Homo sapiens
ccacaaagtagaccttcactaggggcacggtggtggttggtatttgcgagcggattatctccttttcccacttccgcagttggggcactcacagtatttggggtgtctccagagtcctgcaggagcactctacttccttcacagggtctgtgggtcctcttaggattcctggtttgttcttgcagttattctggagctaaaattcgcaatgtgagcctctgcatgctgctgtgtccatccgagtaggagctgcaatgtagtcctgcctcccatctgccatgatgatctctcttcccaggccaaccttttcgtatcttctctggccatcaacaataatagccattttaggcacatttctagggagactacttcagtttctatagaataaagaaaaaacattaaacagttttgcgtattttgggaaactgaaaagtgaccaaaaacttataatatgaaaaccacaatatcacaggtaagcaaatcacaccccttctagcagtgctatgtacaaggtgtgcaggacattgaacgagtaagatcttttcgtttttctttgatatgaagtttatagactaaatggaaactcccaaaatttacttacatgttatgtaccccagaaaaggcagataaatgaggaaagtctagtctttatttggacaagatgtcaatagtcttttttatgatttcttgggttttatttaaaccatagaaatcaagatgataatgtgaaacctcatttttgaaataagaatacctaataagtagggaaatatttgttgccatattttgacacatcacttgatatactatagaaagcaagattgcaattaagtgctgacagaatcagctctacactataaggggccaacgcatctcttatcaaaattttcatttttgtttgtccataagacaatttagttgcaacctctgaatgaatatgtgtattaataacttcactcagtttcatagaccaatcatggaaaccatacaataatgtgtgtttcatgtgacccaaggtaacagagcagctgctagtattggtgccattttgggaggaaaaataaaacaatcctctgac

SEQ ID NO: 75105 - DNA, 1049 bp, Homo sapiens
aacatcctcataattagaaacttgaatattatatttcagaaagtggtgtctacaaactaaaatgtttttattttttgtttgcttgcttgttttgctgatttctttgtatacatgaaatgtttactgcaatgaaataaattcttttttgggtttagtaaaattgcttctaccagtcacctaggaaatataagctagggaacaagacactggtatttagtcataccaagaggaaatatattgcttcagtgaactgaatataaaacatgatcagtgaaaacacctggaaatcagaaagaacagattttagttatgcttctctttttcaaagaacttaagtgcttagctattattgttagtgctggagaagtaagttggcagtgacatttgaaatatgataaataaaagcctgcagaatgtctgcttctacttgtagcacttgtctgattccttctccagaaattgcataatggaaactaccatagatttaatgccactctaatatatcaccgttacttgttttaataaatgcattctctattgctttgtaatgataaagctatagttactgaaactgtcaaagttacagaaagagaaggataggagctttttgtctttatcacctgtattaataattggagataattactgcagagcagctggctgttggttttagggagcatcaattgttcttcttacccagctgttgactaataaggatagtcaacacatctgtttcaacagctggtaattaacaaaagcctaattgctgcaactcttttaacatccaatctgtgaaaaagaagggatgtagaagaatattatttactttgtgctttgcactttctgaaaccagtttctcttttttctctctcctcactttttttttcttactttgaacaccactgcctttgtatgaagcattgaatggcaggagaacacaatatggtaatccagagcttaacttttttagatctttgttggtgtttcttattgcaacatttctttgctaacttgcaagataaaatggatcaaaagcattttgagtagtt

SEQ ID NO: 75106 - DNA, 1066 bp, Homo sapiens
atttatatataatgtatacagtggtataaaaagaaaatatgtattttggaacaaatgggtctgaatttctatttgagttcactagctctgttataattagaaattacttaagctttatgaacctatgttttatatcttgcaaaatagggataataggaactacctcataggttggttatgagaatagaatatagtaatatattttaaacactcgaaagaatgcctaactgatagtaggtggtcaaaaagtggcattgatttgtagttaagcttggatgttttaaagcgatatcattataggcagaaagtttgggcattttaaaataaagtatataactttattatccatataaaactttatatagctatatatatctatatatagtgtaaatgcacacttaccacaggactcagcaatttcactcttaggtatttacccaagagaaacaaagttatatttccacaaaaatgacctctatgtcgatatttatagcagctttattagtaattgccaaagaactagaaatcagccaaatgtctaacaggtaagtggatgtacagattgtgatacattcatacaattgaatactactcagtggtataaaagaataaactaccagtacatgaaataatatggatgaatctcaaaaaattatgtttaggtaaaagaagctagactcaaaagactgcatactgtgtgattctatttatatgacattcttaaaaaggaaaaactgtagggacaaaaatcacatcactgattgccagaggctgagtgtgaaaagaaggcattgactccaatgttgcacaaggaccatttgggggtaacaagaatattctgtgtcaagactggataactttgtcaaaatttacagaactatatagtgaaaatgggtaaatctttaccttatataaattatgactcaataagtctgacattgaaaaatccatatgtgtacttacttgcatatatgtttactttgataaaattttacctaaaatatgagtataagaagaaaaagtgttatacttgtgtaaaatgtttatactatagtaaaagtataaa

SEQ ID NO: 75107 - DNA, 1058 bp, Homo sapiens
taataatcttcatcacttgtcccctaacctatgaaaaacatgttttccaaagagtacaaattcaaagtataacattttcttcaatgttttgtgttaaaactgttaccctagaaaatacagatataatttttaaagctacgtttgtaattccttctgtcttatatcttggagttcaatacatatgttatcttatttaatcccttcaacatccttgtaaggcatcatccctttttggagaggagaaaactgaaacagagagaaaactaacatcccctaggttacattaaggccatcgacagtggcataaatattatctaatcctcctgatagctgggccttttactttgctactggaccccttcctctactcatgcctccctcagaaatacagctgaagcaaaactggtacttcagcattatttccctaatttggatatgcttgacatgtttattgcacaaaacacatcactgagaccatgttaaaggcaggttaacacagtaaaagaatctgacctgctttggagtttaacagtctttgtctgtgttcaaccaaactgcacaaattacaaccacagttgatgtctggatttataaatacacgccctttgattttttttgaacctttaagctctagcattatatcatatgttaggctacaaaaactaaatactgtgcctaacagcaattttatccatacaatcataacagtttatgtttattagtatgttgtggtattaatattgttgttttatctgtgctgtagcacaatcactaacgtaacaacaatcatatttagtagtaaccattaaccaaatagctattttgagttgtatatgaatttattaagagcctactgtgtactaaagacttttgtgaaacatagagttaacagaggataagatgcaattgctaccttcaaatagattataattaactggagagaaaaaatatatactaaaaatgaacatacgttactatgtgctgttaaatgaaataattggacacttccatggcaagtcacagaagggagagattcttctaagcttgaataaatttca

SEQ ID NO: 75108 - DNA, 1343 bp, Homo sapiens
tcacgccattctcctgcctcagcctcccgagtagctgggactacaggcgcccgccatcacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggcctgtttattctctttgcctagcacttgaccattaaagatttgagatgaaaagaaagagatatggctactaaaaagtctctcttttcaatgcagtcctaataacaaagtgtgaaatctgggactcagccaagtgttattaatatcttaaaatgatttttaaatgttgcatttattaaaatttaatatagcagaaaagcatcaattatagaaatagttctgtgagtatgaacaacaaatgaaaacttgattaaagttagccatatcaagcattcttcacttgaagtatcttgccagcttctgagtaatgctttgatttggtttgaaccttttgtatgcaacaatttttaatgcaagttactacagttctttctgaataatataggtcatgagaagttcatttgtaggtggggcagctgtactactttgggggactgtcttaatagatccatttcattaattgtcatgaattttttattaacaaaaccagtacatcaggtttagccagctgaaaactgttctcatagttgttatctttattgtcagaaagaatattgtgaaaataaggaattactgcacatgctttaactcttgattaaacagaagaatggcactatccatgaaaaataacttaggggcatattatcaagttgacgtatagtgttttcagttttgcagctcccattaactttaaagccttgtgctttaacttcagtgtcttccagttaggaataatgccagagccgtctgttaggtactcaagagttaatgggattaatgtcaagtagcaggatgttcattctctcttccttaagctttattccttaggtatttttagataaatgtccttctaaggaatttcttttagaaaccttaggcaatggtattaagaagcagcagtaatggattggaaaatgaatgatgttaggatgtgcattttatttaccaatgaaagaaatttccttcaattcccatctgataatctttattattaagtcatacatagagctttaaaagtatgatttttttaacttcaagaagtctcaagagatttcttaggcatatgataggccgttatattgttagccatattctttgtgtcttcaaggccataatcactttttacttcctacatcttgtgaga

SEQ ID NO: 75109 - DNA, 1020 bp, Homo sapiens
cactgtaatagaatacatagaacacatgtaatagaatatattttaaccttctttatgtattgttaacagcactacagcattcacatatctagtcaccttcaatttcaaagatatacctttttccttaacaatttttatgtcagttttacactgtgaagcagtgctcacatcaaggtttcttacttcccactacttcttatttgaaaatgtcatcttgaccatttcctcaatatccctgaagttatattttgattaatagccaaagttatgtaagtcagtagttttaaattagaccattttaaaacagtttagaaattgtgcattttaatctttactagccatgtaccttgaaacttttgatttatgtaggtattatatatatttgtaagtttaaagatggggtttatattcagtcagaaactatatgcagttattcacaatgtacgttaatattctaagaacactatgatgtataggtagatctcatttcattataaatcacaatcagtaacttttgacaggatctgatttggctctgtttgcttaaagtctacaaatacatacaaatttcaaatttttctttatatataatccattaatttctatacatgaccaaaattccctaaaacagtggttcccacagaccaattctattttcaaaaaatcttcggatgtgttatcaaccttttattttttagatctcatcaactatcatcatcatttcatttaaaaaaacaatttttatacaccaagaagtagaaataatatcatctcagataatgttttaaattaaataactttactgaatggccaagataaccaaataggaacagctctagtctgcagctcccagtgttgatcgacacagaagatgggtgatttctgtatttccacctgagatacctggttcatctcgttgggactggttggacagtgcatgcagcccaccgagggtgagccaaagcagggcagggtgtcacctcacctgggaagcacaaggtgtcgggggatttctttttc

SEQ ID NO: 75110 - DNA, 1003 bp, Homo sapiens
tggttttggacagagtggttatgtcgaggtaaagggaactaaagagcagctaagagcacaggaacttggtaggaaaaacttctcttaatagttttgtcaaagactatccctaatccccatttattaaagagaaaactgacacatcaatccattaagagatgtttttattattcatgagagatttaaaactttgtgattctttatgctatagtttcgtttccatctacaagtatgcttgcttcttgtggcctggaacaagttccaaaggacttttaaaaatacattttgctatacttagcatacctaagctccacatagtttcttaaagtaaaagtaattacaaccaggcttataaggttagaactcttaaagatctgggttttacactgaaataacttttgtcatatgtcatttttactgtgggccagatttacagtgatatgattcaaattccctcataaactatatgaagagttatatactgtaactatataatgaatagatgagacaaagagatatagaaaaattgtaaacttttaaacagatttgtaagaaaagatgtatcaactcaagaactttcatgctttccataattttctaaaaagaaaaaatccattatttaaaatttacaggagttctgctcatcttaaatttttataacttaattataacatcaaagatcaggttaaaacatttcaattgataggttttgtgaagttgtagattgtcttttgaaatatagggcaccctatatcttttgagcactattgaccaaacacacacacacacacacagctgtttaaagtcttttctgctatttgaccaaatactgatttctgtaaagaaattggtgttacaaagaaattgtgaattctcagcctggttttcctgctgacgagtaagagtctgtagttctcttcgaagtgtcaagggagtcaccatagtgtcacacaagggttcttagcatagagcaaacatacttcccacaaactcagctgcttaa

SEQ ID NO: 75111 - DNA, 1054 bp, Homo sapiens
atccctactgggtcagggatttgccgatgtccatatttgcccattggtaaatttacagaatgaagaatcctttgcttgtttcagtgtaactttgtctgatggagaaatcataaacattgtccatagattaactttattcttgatcatttacatttaaggagaaaaaactttccataacaatattgaatataattacagctgaagcatatcttctttcttccttcagtgttatacattcttgaacaactcaacagaggcacttttcacttcttaacctaaatataatgaaaaaaaaaaaaagctatactattgtagactactttagcaggtctttctataggaagactgaccaaaagtgacaaaaaaaaagattctacaaattccatgtaaatgatattttggaacctactaaactaattttaatttttttagttgctttggcatttatacaatacaaactaatagttcttggaacgtcatcatctttttagtttttcgtttgcctcatacaacagtatactgtgtatatgtaaaagcatatgttatatctctttctgttaccatgtgccatataacaagctatataatggtaaaaataacataaaacatttttagtatcttgaaaaatctttcttaagttaaactaatctgccttcttagctaagttatgtgtatttcacataacgtccaagaagttctctagtaccgactctcagagggcctaaatctttcccagaatgatgggagtagcacagttcaagaacaagaatgaatctctgtataatcacaccacaatgtgaggtgaccctaagacagagaactgatcagatacacatatgggttttaggaagactttctgatgctcttttttaacacagctgtgagaagaatgtggctaagacccagtagtcattcttgaggagagctggtaaaggaaaccatgaggagaagagaatttaacacatgggtgtaagagagtccggcttcattgatgcgatctgaggggaatgcctaatgactggaagaatcaaacttggcaatgaaaacacaaagc

SEQ ID NO: 75112 - DNA, 1035 bp, Homo sapiens
gttattgacaaaatatatactacaaatcttcacattaattaattgactttcttttattcttgaaacctacttttaggaggtcagcagcaaaatttcaacccattactttagaatagaaaatgtgaatgtacttcttattcccaacatatgtgtgtgatatttattcataagcaatattctattgatttttgagagcctgttgggctagttaccaaatatacagtggtaaacacattgtccctacccttatggagcctcatgggcttgttattggaattgagttttcttgggaatgttacatatgatttaaatatcccctgagagacaaagtgaaggagcccaataaaattgtaacttaatcttaatttattctattatctcaatcactttctaatgttgttaggggattaagcaaaataactccattatcttctgttacgtactttcctaatagtatcatctaatacacttagtgctgccatgttccaactggaatccaggggacaatctagatatctaacttacaaagccttaattaagccttgggtaaaattataccaaaggtagtattttaatctagatatctaacttacaaagtcttaattaagccttgagtaaaattataccaaaggtagtattttaaaatccaaaacttgaaataaaattactttagtgatactataaagaaggaaatattgctttaattattctctatgttctcatttttaaaagaggtgaaataaaagtaaataaaacaaagtttcacatattttaatttttatatccaacgtttatgtttattattcaccttagtaggtattaattgatatgattgattggtgagcttcatttttcaaggttacctaaaagatagtagttagtcaatgtttaaaatataggtaattttttggcgccttgtctacttttgatattaatgacattgaaaaaggaatgtcgtatatctaatctaaggacagttgaatatacacatatcaagttttttctgtgttctatttaatctcaacaataaatcca

SEQ ID NO: 75113 - DNA, 1363 bp, Homo sapiens
cattgcatagtaaatgattcattcacaaccttaatgcaagtagctaaatgtattgaaataagtgtcctataaattttgtgtggcatctaatgctgacataattcaaggatctgggttaaagtttgtgtcgttgctgggttttttaacctcaaatacttggcactctgtagcagtgtctctcacagtaatgctttgtttcttaacatgaccgtgaggactgcttggtcacaggcaaatactgtcctttatcagccaggacattcttaacaataattgccctttttttccccttctcacccccatcccaaccccaacttaggttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgtaatctttgttagtataaaagatattaaatataggtgccaagaattaaatgtataatttgtttaataagagatggatatattaaaattacattcatcaaggcatgatttttgtttcactacaaataatgcaaactgttttcaataaaaagaggagactgttaatgtgtacttataaattcacattgtcagtattttttaatattgggtctgaataattatctgaattctacttaagctataagtctctgtcatttttgcttgaaaattagcatgcctctgtcttaaaagagaccatcaaacctattaagtattcttattgtttatctttttttaattgccatttgatttttattgtggaggaggaggatctaatatataatattcaatacaattgtaatgtagaaatataagaatttagaaaaaagtaaacttgccatttggttaaggttacctgcttttta

SEQ ID NO: 75114 - DNA, 1902 bp, Homo sapiens
ctttcttttaaaagcaccaagcctctaattccattgttagtcttcgtggtgactagccgccatcctgattcatctcatctcatagcataaactcctatgtgatcccatcagcctatgaataaagacactcctattatcagggaattctaaggatgtagagtctccctcccagcaaccagggacggaggccagttagattctttttatttaataggaccataggcatttcaaatgatttccttgtctattttaaacatttgtgtataaattccatgatatcaccctatgctttaatcataacaaatatcttttttcctctaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtttttctggctattttgaaatctagtaaaacctgagaagcctaatgtaaaattagagtatttaaaatcattagatttaaaagctactcatttaaaaaataacaactttaagatataattcacacatcatacacttcacccacttaaagtgcacaatttaatagttttgagtat

SEQ ID NO: 75115 - DNA, 1050 bp, Homo sapiens
ttgttttatacagaggtataaagctataaaagaatgtgttgactgattcagctaacttagaaaataaaccaggcataagtttttagatgatttaattacatggtgtttagagctacttacctatggattgattcaattgctttcacgtatcataagcttaggtagatagcttttagctaacattcatttgataagcatagtgttttaaaaattttctgacttatgtaagtattctttcattttacttttaaaggagaagaaatattctaattttatatttattaagaatattttctctactgaaattgtaacttttaaaaaattgaggtaaatggaataatggtctataatttttttagtttctaaagattattttctttggaaaaatctcaagatttttggatgggcaagaaatttaaagtaatttctttaattgttttaaaattagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggtaagtagtgttaatttgtttgtgtgtttgtttgttgttaggtttgcagtgaggtgtacctgcttgccttctgattttaatagattgcttcataaagcagacagaaaggtaaggagataggtggggaaggtatcagtgcttactttttgcattagcttttgagagcaaaacagtaagattattgactagttgcctaaacctggcactttccatcatcttctgtctctagcctagcttcctgaacagggccaggatggcattgtggtggtatactagctttggttgaacaagaaaatgtgaacagcttggaaagtaatatacttttcttaaagccgtttatttactgttaaagtctatgaatatgacatttgtggtaacttacattttttcattgtcttcattctatcattccaattttctagaaaataaaattttatgtaatagga

SEQ ID NO: 75116 - DNA, 1050 bp, Homo sapiens
agttttactacctggcgtcagcctctgaataacttagatttgagcaaggggtttttgtctttttgtttttttccttttaaatacaaagtcttgttatgttgcctagactggtctccaactcctgggccccaagccatcccagagtgttgggattacaggtgtgagccaccatgcccagccatccttttcttactttaacttaaaaattttttttttctttcttaaattttttttcttgtggaattttatttttaggcagctgataaattttgtgaataggattcctttcctgagggatataaattagaacattcttataataacatgttttgttatgttgttaatagtttgtaatcaaatatttttgctaatagtaaacacctgttttaatattaaaatcagtaacaactatcttacgtgtttatcttacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagaggtaagagggacagaaaaaaataaattggtcttgttactgcaatgtgtggcattaaaaaagtgaaaataactaaaaaaatgcatatagttactaaatataagaatttaactaaaagaatggacatctcaacctattaatgtattcgcttaaaatatttatgaatgtttactatatgctagataccatgtaggctgtattagaagattgttaaatttttttttttaaaggagatggaagagactttcagatcattttgtccagccatttggttaatcaaatcctccaaagcatatgattattctttacgtctttaacaatgtccagaagtgattataattctgtagactgtagcttattccagagtttagtgtctgtgacagttatgacattctgtctaaacaaaggctcttgttttaatctcattttcctttgtttttttgagaacataaaaaatag

SEQ ID NO: 75117 - DNA, 1047 bp, Homo sapiens
gcttattatacacagatgtctccagcatcatgtgacatgtcatcagtgctttgacttattgtactgtttttaaatgggaccttttcaatttctcagactacatcttttttttgttttgagacagagtttggctcttgttgcccaggctggagtgcagtggtgcaaccttggctcactgccacctctgcctcctgggttcacgtgattctcctgcctccgcctctggagctgctgggattacaggtgcacaccaccatgctggctaattttttgtatttttagtagagacgggtttcaccatgttggccaggctggtcttgaactcctgacctcaggtggtccacctgccttggcctcctaaagtgctgggattacaggcgtgagctaccgcacctggcctcagacagcatcttgtcctagcattttcacttactgtgattttacatattggcaatattcttttctcaacaactgtgtgacttttccttttctaggtaataagttgtactctgaaatagcttgcttccttagtttttttcactaattgtgactttgtctcaacaaatgcttcattgtttagagattctaaaagctgcttgatgtaatcagcaccttttgcttgtcaaatggctgtgatttgtagtaaagggctttttccattttgccagaggtattgctgaattggtaggttgtcacatatgacacaaaattgaacagtacaacttggattactgtcccatgtaaaacctactgattttccttgtaaaggtggattttttttgtatgtcccttgttgcatgaatacactgaaatgactcagatgattgtaattcttcagaattatcaggattctctgaagacttatgtctagaattgttctcttttatatcttttatctcacatctcaattttgagattgttttttaatttttttttttcaacttttaagttcaggcatacacgtgcaggatgtgcaggttttttgtataggtaaacgtgtgccatggtggtttactgcacagatatcccatcacccaggtattatag

SEQ ID NO: 75118 - DNA, 1044 bp, Homo sapiens
ttatgacacagagcacttgattaagcttagtccctttttttttttttgagacagggtctcactctgtcacccaggctggagttcaatgagatgatcatggctcatcatagccttgacttcccctgctcaagtgattctcccacttcagcctcctgagtagctgggactacaggcacacaccaccacacctggcaaatttaaaatttttttgtagagatggagtctgcttatgttgcccaaggtggtctggaactcctgggtttaagtgactctcccacctcattctcccaaagtgttgggattacaggcatgagccaccatcaccatacctggctaatttaaaaaaaattttgttgagactgggtctcactattttgctcaaggtagtctcaaactgctatgctcaagcacccctcccaccttagtctcccagagtgttgggattttacaagcatgagccaccacacctggctaagctcagttcttaatgcttcatttttacttagcaacctctggcttattctttgaaggtacttctttatgcactctagcttaaacacccttttgagaactctatttgctaagctgtcgaatttctgtgtccagtggcttttgtgtggttggtgtaggctttcatgtaattttaaaaattcttgagtgaactagacttgttttaaaaagttagccatttttatatcatcattcagaacttttttgatttcacctccaagagttttttttatactagtacctctttgaaaaaagcagcattatgacaatattaccttttttttaaaaaaaaaaaacaagaaagattaatcctctcatagggtccactattgatgggacactattagaacaaatgccaacacagttccttcaaggtggatcttttgtttccagatagatataacattaaatatattttgacccttgcttatttaggatagcagaaaagtttctctttgtagcagaaattttccttgaatttcactgttatttagaaatctgacatgacatcattgaaacctgttaactcgtcaa

SEQ ID NO: 75119 - DNA, 1105 bp, Homo sapiens
gcagcctaggtgacagagcgagactctgtctcaaaaaaaaaaaaaaatcctagtagtttctgtatcttttatcttttaaatttaaatttgtgtggtagccaactatgatattgtgggtataataattcagaagcatttctatgctttcttattgtcttcagctgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactggtaagaaataaacactgtgcttttctaaatctgtatgctttcatttgtagtaaatgtttgttgcagataatctctttcaaagtacttaacagtgtatctgaaatactgtatgagaaactcctattcaaattactgagacagtagcacagtaatgaatagtagaactcattaatctcttccagtaaactagattgccttttttccttaaaatgtaagagtgacaattatgtaacctattatttttctattcttattggctggaatgaggttagttcccaatttaattctatattattgtaacaatttttagtgcttttttacatatttcttcattgctgtggctttagttttttactttcattttaatggaactattatatgtgcatctcttaaaagaaattaggccaggaatggtggctaatggcagtaatcccagcactttgaaccaggagttcaagatcagcctgggcaacatggcgaaacccctgtctctccaaaaaaaaattggccaggcatggtactgtgtgcctgtagtcccacctactccagaggctgaggcgggaggatcactgcaacccaggaggtttgaggctgcagtgagctgtgattgtgctgctgcattccagcctgggcaacagagtgagaccttgtgtcaaaaaagaaatgaactggggtagaaaaattatgcatattaacatgcaaaatatagacaagtctgtattatctggttctagattaccaagtcgtgtgctaataaagttattagtagtgttgatttacttagattttt

SEQ ID NO: 75120 - DNA, 1049 bp, Homo sapiens
ccttccaaatagctgggactacaggcgtccgccagcatgcctggctgattttttgtgtttttagtagagatggggtttcaccgtgttagccaggatggtctccatctcctgaccttgtgatctgcccgcctcagcctcccaaagtactgggattacaggtgggagccaccgcccctggccaaatagcatatgcttttaaagagaacagtatgaagaacttatattaatacttttgtaatttacttagcaagaatttaaattttacttttattatgtaaaaattattttattttttattatgtaaaaatgctttattttataatatacttatggtcttaaaatattttaagctcttaacattgttgaattagtttgaaacatgacttttttttttcctgtggtctttttccattttcactttaatataaaattaataaattgtgtctctagctttcaaacatgctatattttatttttacaggagataggaacaggtggcacatgtcagtggaagatatgtggacttagtcccactacaaccttagccatatattttgaggttgtcaatcaggtatgactttctacatctgaatatcaaaacgtacaacgtacatttgaataagtacttactttaggccatgaatagttcatattttttttcctatagtagatataacccaacatttattttctgtattggaatttatatttgtcgttttttatttttcaaggctaaactccttggtgagagtacatattgtaatagaaatgcagggaaacctacaaacgccaaaccttgggtagcccaacttttagtctgttttctttctttcttttttttgaatataaaattgaaggataaatgcagttatttaaaattcccttctagctacacatttttgcaattagatgtctagcttttcctagttgtcagaaagtatatatgacatatgagtctttgtacaagaaggtctaatatgtcaaaatccatagaaaaagtttggaaagtaatcgtatttgggaagatttttttttctgccacaggagat

SEQ ID NO: 75121 - DNA, 2379 bp, Homo sapiens
gttaccttcggaattgagattatttgtggggtgaggatattctcatatatatttgaatattaaaaattagtaatacagcacattttgggaaatatctttaaaatttattggtagttttgagaggtaattttcttctacgattttaacacacggactcagtaactgtgtcaagtatgttgtttttttgttctttccatgcagaggatacatggtaatgggtgattctttcaatacttccttattcaaacaaacttttcaaagagtctttaccaaagacatgcatggacagtttaaaatgggctttggtggtacgctagaaataaaggtaagaaccaaaacttgacatgtgcgatatgttatcaaaagacaacttataggcttgagtgtaattctaaaatgccattaatcaaatttaatatttactttcaaaattgtggttattttatattgaaacctgagttagagattttcttcaccagaagagtgtcatcattcaatgtgtgagactttacttgagcatttctgaacaattgttagaaaagtagaacaatattggtaaaatattctttaactttttaatttttttctttatatagggcttagctctttaaagtatgttttatcttcttttttttgagacagagtcttcctctgtcgcccaggctagagtgcagtggcatgatgttgtctcactgcagcctccgcctcctgggttcaagtgattctccagcctcagcctcctgagtagctgggactacaggtgtgtgccactgtgtctgtctaatttgtgtttttagtagagacgcagtgtcaccatgttggccaggctggtctcgaactcctgacctcaggtgatctgcctgtctcagctttccaaagtgctgagattacagacatgagccaccacgtctggcctgttctatcatttgtagagccaaatctatttatgttagtgctaggttaatgataggaattgttatctaacttaagaggaaactgttttttttaaaaaaaaaaaagaggaaactgttttttacctttcggataatcagtaattgttttatgattagttgttattgcataattctatcatttatttcaaatttggatttaaaatacccaaaggctaagtgcttctaatcctaattgattcttattaaattaactctaagcacattaattttgaattttcattaaatatttattaatcttgttttattgaatgcttgctatatgcccaacattgcttgggaaattacagagatgcctagggatatctaaggtacacgtcttgctatagagaaacttagcattctcttgatagagaggcagggaaagaaaacactgcatgtaatagaatgacataatggtaaattataaaaacactataaaggtttagagaagaaaaatgaacatatataggacacaatttattctagacttctagaggagtgtgacttatagttttttttttttttttttttttttttttttttttttgagatggagtttcgctcttattgcccggctggagtgcaatgtcatgatctcagctcactataacctctgcctcctgggttcaagcaattctcctgcctcaccctcccgagtagctgggattacaggcatgtgccaccatgcccagctaattttgtgtttttagtagagatggggtttctccatgttggtcaggctggtcttgaactcccgaccttgggtgatccacctgcctcagcctctcaaagtgttgggattacaggcgtgagctaccgcgcctggccacagttgttttcttaaagatgttagaggatattgcattttattcaggaacccagtgtgaggagaggcatagaggtgagaatcagcattgtatgtttgagaaaactgcccagtgagagtagatgctttgtatttgaatgaaaggaaatagcttaaatctgtgggagctggctgtagtgtggagacacatgtgtaggcagaagtcattaggtattttgggtaagattcatctgacagtggtattctgcatatgtcaggaaaaagaatctcaagtaagaaaacaaaagtaagctttccaatttttttttttttagacagaaggtattgtgatagcttacattttggtggcaggagagactggggggagaccaatcttggtgacagattttctatgggaggaaaaatagaatagggtgtctaaggttttagattaggatatgtgaattttgggtgggtaggtagaagtgtgaagtcaggatgaggttcccaaatggagacctcgtatgtgctaatggaaatagaaggttaacattaggttggtgccagattttaaatttgacagtgagcatagaagtgcttattgattgattatttttcatg

SEQ ID NO: 75122 - DNA, 1674 bp, Homo sapiens
tctaatcagaggtagtattactaaaatttagttgatgtattttctcataattatttcagtaacctaaaacttactagactagtgagagatgaaatcctgaagtacttggtttgagtgtttcgtttattgtggttgtattcaaaatgtggtttctggggctgttatcatcacgtgtcacctaggaatgcgtttgaaatgcaaattcttcggctccactccagacctaccgaaacaaactctagaactgggacctagcaatatgtgttaaaacaagccctccagctggttctcatatacacgaaagtttgagaaccattggtctgctgtgtgttcagagtgttgttttctatttttaggaaagtgaaatttgtttatcgaactctcacccataaacatttacaaatggctttttatttaattctgtttcttagattcttacaaccagtacagaaaatagacatgaatctcacagatcttctgggagaactccagcgagacccttggcctgtaccacagggaaagagacctttgcgttcctctggggtggcactttccatagctgtaggactgctggaggtagggaagatggttttgttttggaatgtaaagtgtgtgtgtgtgtgtgtgtgtgtgtgtgtgtgtgtgtgtatatataattataaggataagaagaaccaaagtgctttttttcctccctattctctcactcagcatcaacaaagaatacttctatggttttcccccacataccaaccaagcagttctgccttcgataccacctgggtgtcctgtaattcagttcaattctgatactatctaactggagataacatcacatctcacagattgagggctcagtcccacaagactgcccccacttaagtgccagtcacatagtaggttgtcacctatacttctctgatagactggctgtaaattggacactcttgggtttgattaatttgctagaatggctcacagaactctaggaaacactttatgtttctcggtttatgataaagatattacgaagactatagatgaacagtcagatggactagatgcatagagtgaggtgtgggagaaggggttccaaatttctgtggcttctctggggcaccaccctccaggaacctccacatattcatttgtctggaagctctccaaactgtgttcttttggcttttcatgaaggctcactgcataggcatgattgattacatcactggccattatcccctctctccttctggaggttggggtgtggaactgaaagtctcaaccttctaatcaggctttagtcttttcagtgaccagcccccatcttgaagctatctaggagtcattttattaacatacaaaaggcactcttggctgggcacctcatgcctgtaatcccagcactttgggaggctgaggtgggcagatcacctgaggtctggagttcgagactagcacggccaatatggcaaaaccccatctctgccaaaaatacaaaaattagccaggcgtggtggcgggcgcctgtactcccagctacttgggaggctgaagcagggagaattgcttgaacccaagaggcggaggttgcagggagctgagatcgcatcactgcactccagcctgggtgacagagtgagactccgtctcaaaaaacaaaaacaaaaaacaaaa

SEQ ID NO: 75123 - DNA, 1217 bp, Homo sapiens
agttttataactccagtacttcatgactaagcatttctagattcaagaaaaatttagtataacattattttcatttgtctagagagaaattgtgcacatatctgaaattcaaaacaaaggtggcagttcgtagtttggttatgaattacattagaaaatcaagatgtatataggtacaaagtacgtgagccttataactccccaagtcctaacatttactactgttgcaattttacatttatttatctgttgatttgattaatttatgtttctggattttaatttccatgagggaagggactagttagtttttaccattgtattcctgccacatagcaggtgcttatgatatagtttgctgaaacggatgaatgaatataaattaagaagtatggacatttaagttacacaacaatttattttgactgttaattagaaataaagtgtttttgagctaatatgcctcctctttggttatataacaccttgtgcttttctctctcatgatgattattttgtgttattgttttcttgataatctctcccactggattctttgttttctgaggaaggagaccttgtattttttatttttgtgtttctaatgtctagcacagcattttatacatgataaatagttgataaatctttgtaaaagtaattaaatgaatattgcacaagtaatctctttacaggaaatgctggggctctctaaagtaccacttactcaagcaacacgtggtcctcaggtacagcagccacctccttccaacaggtaataaatatgatgaagagaatttgaccgtttctgtagctattttaaacattccatacccttgaacataggcattcagtgatactatattgttaaatatttttaggaatataagtaaattgtattaacatactttttaaagaattgagtcaaaatcatgtcattaaaatggtttgttttttgtcttaacaatgtaaggagttactttagttttgttattttccttattttttattttgaactttggaaaaaacttgtttttgtgtggttttagggcagccaaggtttttattttttcttcttagctttagaggtagcttttcccgctaaggtttctggagtgcagtggcatgatcttggctcactacaacttccgcctcccaggttcaaacaattctcctgcctcagcctcccaagtagctgggattacaggcatgcacca

SEQ ID NO: 75124 - DNA, 1109 bp, Homo sapiens
gagaaaacaattatggttcacttggaccattcagtaatttgtccagcctggctagtttctagttatctgaaaatccaagtcaggtttactaattattttaaaagagtcaaatgaaaccttatgcatgtagttaaataaaatggaaagtgaaagtcccctctgtgtaactatacctcatgttcttaaacttaatttttcacctgatgatatgtcttagatctctctccatgacagtagaaataacctgtttcatttctgaaatggctttactaggattcttttgtattcgttatttaattagttccctgttgactgtcttgtatgctgtgctttaaactacatattttttctttttggtgaattttttaaaagcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggtaaacaacaagaatggtagtttttacctatctgaaaattactctatatatgtttataaatgccttctgtatgtttctaggacaaatttttattatgaataactaatataattgtattataacaaaggctttaaattcagtgctggcttcagttttcttttcatgtgccttaaattgttatacagattaaacacccttcacttttaactatatctttaaaatttaaagtcaaaccaacagtattttactagagatttgaagggcttatgaagagtcatgctgaaggctaagagagagcaactgcagaatattagcttgtttcttttttttttcttaagagttcagcttttttattgaacatgttataaaagaggtttagtcaaaaagaccaaagtccatgtcatcatcatactcctcaggttcttctttctttgtttccactttcttttcctcagctggggcagcagtggtggtgggggcaggaccttctgcaggtgcag

SEQ ID NO: 75125 - DNA, 1019 bp, Homo sapiens
tgaaattaggatttttgtaaaattgaactgaaatatgaactgatatgtcttttctttttttttaaaacagtcaagtggattatcgagcaaaactttgggcttgcaacttttgttaccaaaggaatcaggtaagaaaacatccattgcatgccgggcgcagtggctcatgcctgtaatcccagcactttgggaggccgaggcgggtggatcacgaggtcaggagattgagaccatcctggctaacacagtgaaaccccgtctctactaaaaatacaaaaaaaaaattagctgggcgtggtggcaggcgcctgtagtcccagctactcgtgaggctgaggcaggagaatggcatgaacccgggaggtggagcttgcagtgagccgagattgcaccactctactccagcctgggcaacagagcaagactccgtctcaaaaacaaacaaacaaaacaaacaaacaaacaaatgaaaaaaaacccataaaacatccattgcagatgttaatgccaaaatactagtcatgtagaaaaatgcatatttaaaaaaagatacaaataattatttctcatttaatgaaaatgcctttttaaaaataattaaatgatcaggaaatactttgtttaaaattttattaatctttctagcctataatttgttaaaaatttttgtttgttttctatttgtagtttccacctagttatgctggtatatctgaactgaatcagcctgctgaacttttacctcagttttctagcattgaatatgtagttctggtaagaacctaagaacaaatatttaagaaagttttaaaatttatactgaaagaattgttaaattatgatgatttagaaggaatcatgcttaattctcacattgatttgatggaacatttcaaaggtaagaactgttgaggtcagtttgagcagggtaattcctatgttgtacttatttgatgggtggccaagatactgggtagggtggtgtgatttgctatactgagtagatcagtaaacaataa

SEQ ID NO: 75126 - DNA, 1043 bp, Homo sapiens
gaataatatttctttggtttaatacttttatgcaaacatgttagtattaggggagagagtgcttatcaaataatatcatgttatgaaaagctagtttgtggctgggcatggtggctcacacctgtaatcccagcactttgggaggctgaggtgggtggatcacctgaggttgggagttcgagaccagcctgaccaacatggagaaaccccatctctactaaaaatacaaaaattagccaggtgtggtggcttatgcccgtaatcccagctactcaggaggctgaggcgggagaattgcttgaatccgggaggaggagtttgcggtgagccgagatcacgccattgcactccagcctgggcaacgagcgaaactccgtctcaaaaaaaaaaaaaaagttaagttggcttgtaaaaggactttatttcagatatgccattgtcggacatgggactaagcctggcaaattttgtaattgaattcgtgattttaagattgcatgactcctactatggaaaggtgagggaagtcagggaagtgttgtgcatagccatgtaattggaccaattgagaaacaggtgggattttcttcaaactactgctggaatgtgggaatgtaagaagtataatagatgtgatttagcaagcaaattgatcttagagcagggagattgagaggaaaaaatgtgaagaagagaagagagttgtgcccagatatcactcaggtgatatttagtatgtcttaataagaagtaagaatgtagagatacaatccagccttttaaccagttgtagaaagttaaacctggctattgtctgtgtgtgaatgtcttcctgctaagactcctggaacctttcttagtgaggtttcctaatggtcctaaggcagtggttttcagaacccctaacttaaacattattgagtatccaaagagaaaaaaaaaaggctaaatagaagacaggtgggttttcatatctgtttctgcagtttattgtgatatattgttttggttgaattgtatgaaggattaattaataaattaaa

SEQ ID NO: 75127 - DNA, 1049 bp, Homo sapiens
gtagaaaattaatttttcattcatttggcatcgcataaatctaggttggaattggttcttcctctttggaaggtcagtccctgccctaagagagcggtatattaccacccacttcacaagactgttctaagaatcaaatgagaaaatgtgtttatgaagagtttaagaatttagagctccatgaatgataattacagtaatattgttcattaattcaaaaaacatttttaaggatccctcactactagggatgcataaaagttgctaaccctcggcctttacccagcgttagaagacaaaacagagggtaaaagtcccagaaacgcgttcgaaccaattcagctaggaattaaattctcagatcctttattacaccaccggagccttaaccttgaggcaagcagcaatttgttcatgcgcagttaacgctccctaaactgccacttgctcagctccgcgcctaaggtgtctattagtacgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagtgagtgattcggccctgggcgggtgggctggtcttctgccctgcccctgggtacagccctcggtgctctattcccgttccagtctgttgcgagttcaggtctattcaggattctggattacatcctaacgtgggcgagtttctgttgaacgtgattgcacgtatcaagatgtgtgctcttagatttgttttcaatccagataatttcagaaatacattgtttagtacctcaattggaagtctgaatttttttctgatttcacaatgaactgtggaagtggatcgcttgttttactacacctgagcaaagcacaacagaaatttaatttatcgcgtttattacttatttgtaggatcgaagcagctcaatgtc

SEQ ID NO: 75128 - DNA, 1010 bp, Homo sapiens
tatagtttctttgtatgtccccagaggacaaaattatacaattataaaatgatttctatatctgtccatacagaacaaagaaaaaaatgtatcttaattttttccagtatttatattcatcttaatgtagtgttctgcttacaaatgagaacttcctatcataagaatatctgaaacaaactctttggagatcagggaatattttgaggtatccaatgtcctgtgtctgtaattataggatacaagagataacacctggctctccaaatgaggctttcttgtctatacccaaacataatatagttaaatgttctatgaatttattcatagcagataatcaggcataacattggacatttaaaaaataaacttctggttcagtatttgtctaaatattaattttttgaatttttttttagggaagatggctttatgctttattggcttgtcttgaaaagcctttgttacctgaggctcattcactgattcggcagcttgcaagaaggtgctctgaagtgaggctcttagtggtaagttgcaacttactgtttaaaattaaaagcacccaccaatttatatggtggtaaagaaggagttcagtgaaataggaaaacacatggaatattttattggtggcaattagatttgtaaagcccaaaataatagtagcttaaataatatggaaatgttttctgagataaagaagtctgagccgggcgtggtggctcacacctataatcccagcactttgggaggctgaggcgggtggctcacctgaggtcaggagtttgagaccaacctggcccacatggtgaaaccccgtctctactaaaaatacaaaatttagctgggtgtggtggtgggtgcttgtcatcccagctactcaggaggctgaggcaggagaatcgttcgaacccaggaggcggaggttgcagtgagctgagattgcaccactgcactcctgcctgggcaacagagcaagactctgtctcaaaaaagaagtaggtaaa

SEQ ID NO: 75129 - DNA, 1034 bp, Homo sapiens
tactcacataaggtagcatacagaacaatctgttctgtacttcgttttttttcacttaataaatcctggaaatcatactttagcagtataaatacgttcctcatactttagcagtataaatatttccctcatttctctttttatggcttcataattttccactatgtagacatactatagcttatttaaccagtttcttattgatggacgtttgggttgcttatggtctttggctattaaaaatagtgctacagttaatatctttatacataaattttttgttttttttttactaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcactttttttttttttttttttttttctttgagatggagtctcgctctgtcatccaggctggagtgcagtggcaggatctcagctcactgcaacctctgcctcccaggttcaagtgattctcctgccccaggctcccgagtagctggatctacaggtgtccgccaccaagcctggctaatttttgtatttttagtaga

SEQ ID NO: 75130 - DNA, 1141 bp, Homo sapiens
cgcctgtagtcccagctactcaggaggctgaggcaggagaatcacttgaacccaggaggtggaggttgcagtgagcagagatcgtgccactgcactccagcctgggcaacagagcaagactccatctcaaaaaaaaagaaaaaatagaattgactttattgaatattatgaagaatgcgaaaaagtttttgacatagcagatttcttgactgaaactatttcctatatggaacagaaaattgatgtttagacttgttttctttgtatctaaaatcaaagaattatttgtatttttttttttaggcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattag

SEQ ID NO: 75131 - DNA, 1028 bp, Homo sapiens
caagtcaagattcttggttgtaaataggggaaagaaattctgcttgtaagctaacaaaattgataagctcaaagaataggcaataaccaggggaggttaaggcagccagtaagatagccaagtcactctgcagactgtatctacttagaatcctgcaggcagcagggactgtagacacaaactacctttactgcctccagaactaattctgatcagtttctggcttgtttttgtcactgagtctagattcacagtcctggactggagtacttaattggctgagcttaagtcttaagtcctacgtccatgctttagtttccagggagctgggaaatatatcaatatttttcagtaatttgaacagttcttcaaaatcctttttttaaacaggaatgacttactgatgataaatcatgtaatgttgtatttatcaatagctttactattttagtaaatccttactatttttaatgattttttttccttttagtatttagcatttacgtgtggcttaatcagaggtggcttatcaaacttgggaataaaaagtattgtaacagctgaagtgtcttcaatgcctgcttgtaagttgaattcgcctttcttacaaatgttttagtaatttgttttcaggtctgtttttttttttaatttaactgagaggaaatttaaaatgctgaaactttcattttagttttatcaatgtaacactttagtgtagtaatatgtagcatactacattcattttcagtaatttttgaataatggactaaaatccaaatttataagacaatttaagggatgatttttaacttttctaaagttattcaaactgtaacttttttaaagatattcttctgaatatctcctgcagtgttttaagatagcaaatttccctagaacattgaaaatgctattttttttttttttttttttttttgagacggagtctcgctctgttgcccaggctggagtgcagtggcacaatctcggctcactgcaagctccacctcccgggttcacgccat

SEQ ID NO: 75132 - DNA, 1443 bp, Homo sapiens
ctcatgtgatccacccgcctccgccacccaaagtgctgggattacaggcgtgagccaccgcgcccgggccaggcgggagctttaggtcttattttatcttgctctgcccccgacatcgtggtgagaggggaaccttcctcatatctgggcgctggcctctccgggcttgggagagaggaactcagtgatcatagagctggccgaatgccggggtagaggggaccggaagttgtttttttcgcccccgcccagcggccggatcgcatctcagctggttggctttggttagagctcccgtcagactttagttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggtgagtgctgccacacaaccttgaggtccttttgcggtgacacaccttgtttcccctcagtgctttccttcaacccctgtcccatcgccacccgacgcctcccgaggtgtacacaaaatggtccacctccaggtgtcctaaaccctagaacctgtcagttgtctcctttgaaccgtcatctttcatcgttttctctttcgtatcttcttctatttgattctcttttgtctattcccgtacgtttgtcttgcacgccacagattttggtacttttagtgttgtccctgccattatttacgagagggttaactgcagagcctacttagttttgctggcacttccagcacttgagccatgcactggacagacctgtgccaacctgagaagcctgtccctccttcctcattcctaatgctcagtacaactccacacaacttgagacctgaagcctaatgaaggttgagtttgcaaaggaaagtttgcaggcgttaggataattagggaacataatttaaattaattatttcagaaagtatttatttagtgcccttatgtcagagcgatttctaggtgccagggatatagtagtgaatgaaacaatggccccatccttgtagagatttttttttaatctaatttaatccgaaatgtgatagtatgtagcggttacttctaatatgtgggagtccttattcaatcattgtgggcctgtcactgctgacactgctagataaattaaataaaataatactcctgcctcacagtatttagggaatagtgatttaatgaatagttaacactgagtattggctggtagaatcatgg

SEQ ID NO: 75133 - DNA, 1050 bp, Homo sapiens
aatcattaaccaaggtgagggtaaggaagaaaaggaggcttggctaagtcccactctgatgtgatcacgttaaaacggtgtaaggcacattacatcataggttaaaaggcctagaaaactccgcgctccccttgccagaactgcagactcgcgagcctaagtctccgagaactcagggattgtgaaacccgccccgactctgcgctagcagcgggatccaggcacccgcagctaactggggagggagatgactgcctggctgacttttcattggctcagagtcacaaaggctgcaggttcttcccccttccggtcgctgagtggttgaggccggaagacaacgctcatcgtcattggctgagcccggctgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggtaagggcctaacgggaactcggaactcggagctcggagaggcagccctcaggtcggggtgaattgggggcggggagggcggccagccttaagaagactggaacctcgaggcctgttcgcggggcggcgggtaaaaccctgttgtcgccgaggtggagaggccccaggtcccctccgtagagcgctggtctcaggtccctgaggaaggagagcgaggcctgggtgcgccggcatgctttcttggcctgtgagaagacccggactgctgattcccgctctcggccctgcaggcccggaactgcagcacaaagccccttcccgctccggcggacacccggcccgttgctggccccgagaccctgccgggacgcaacaagccgccttaccccagcttcctgtccacgtgcagcctcctcggggatggcgggatggggacctgatccaggcttgttaatgtgtgggggcatcgaggtgaatataatttctgt

SEQ ID NO: 75134 - DNA, 1470 bp, Homo sapiens
aggagagcaaaattggtttgggcgttagttcacacattgtagtatcctttctctgctggaggaaagaataaaatgggatggagacttgatagaacaaagcttctggaaacgagtcctagaagagagggcatttgcccttggtgtgcagttacataaatacctcagtggtcatttaaattaatttttggccaggcacagtggctcatccctgtaatcccagcactttgggaagccaagaccagcagatcacttgagcccaggagttggagaacagcctagatacatggtgaaatcccatccctacaaaaagtacaaaaaagttacccaggcatgctggctcacgcctgtagtcccagctgcttgggaggatgaggcaggaggatcacttgagcctgggaggtcgaggctgcagtgaaccgtggtggcaccactgcacttcagcctgggtggtatagtgaaaccctgtctcaaaaaaattaatattttctatgacaggctgggcggggagcgtcggaccagaagagaatcacgccaggaaagcgacccggaggatgatgatgttaaaaaggtattgagattgaaagaacttaaatgaatgtagtaccttcactttactacatttaaaagcacaccactcatatgctagttaaattactgagattttctttttctgcagccagcattgcagtcttcagttgtagctacctccaaagagcgcacacgtagagaccttatccaggatcaaaatatggatgaaaagggaaagcaaaggtatttccctgggggaaaaaaactctagtgaaataatgcagttataaggaaaatcaagggattgttcaagcatcctgtagtatttcttagaaaatgatgggtttaaatgaaatggatcctgttgacagtaaattttcttattctgttctttaggaaccggcgaatatttggcttgttgatgggtacccttcaaaaatttaaacaagaatccactgttgctactgaaagggtatttatccaagttttgttttgcatcatatatttaagttatcaaagtagtagattaatgttttttttaaaaaatccttaaagctcttttaagacctaactgtaaacctgaaacaaagccaagtaaaaacttggtttaacttcttatagaacagctttacttaaacattgtgttggaatataacagttgttgatatcatagctaatagccttgaaatttagatatgtgaaaaaaaaaagcctcaagtctccatttccttaaagacaaattacagtcagtaccaagtgctaagttctagttagttggtatcctgaattgaaaatgtgaagcggccaggtgcagtggctcatgcctgtaatcccagcactttgggaggctgaggcaggtggatcacctgaggtcagaagtttttcgagaccagcctggccaacatggtgaaaccctgtctttactaaaaatacaaaattagc

SEQ ID NO: 75135 - DNA, 4844 bp, Homo sapiens
gttttatcatgttgcccaggctggtctgagctcaaagcaatccacccacctcagcctcccagagtgctgggatgacaggtgtgagccactgtgcccggcctgcagatacctttacatagtgaaaaaaaaaaaaaaaaaaaaaattttttttgagatggagtttggctcttcttgctcaggctggagtgtagtggcgtgatctcagctcactgcaacctccgcctctggggttcaagtgatttctcctgcttcggcctcccaagtagctgggattataggtgcgtgcaaccacgccctgttaatttttttgtgtttttagtagagatggtggtgttggcttctgacttcagatgatctacctgcctctaatgtttcacgtaattagtatgtgtaataactttttatcataattgaactgaaatcatatataccttttgttgtaactatttcaacacgtaagtattaaagcaggctacttaacttttagcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctggtgagtggtaatttggaattctaagattggtaatcctttgtgtttacaaaagcactgaccctttaccttttctttagcaagaagaatggaatgaacataatgccaaaataattaaatatataagaactaagacaaagccccatttgttttatattcctggaagaatgtgtccagctacccaaaaactaatagaagagtcacagagaaaaatgaacggtaagtatgcgaagaggtccattgaattgttcatagtgggtaaggtaatatgttcatatgcacacgtttgttttctaaaataattatgattcagtgattggtttgctgtgtttgctttttttttttaaataagataataagatattctaggccgggcgtggtggctcacgcctgtaatcccagcactttgggaggctgaggcaggcagatcatgaggtcaggagatcgagaccatcccggctaacatggtgaaaccccgtctctagtctctactaaaaatacaaaaaaaattagctgggcatggtggtgggcacctgtaattccagctacttggcaggctgaggcaggagaatcacttgaacctgggaggcagaagttgcagtgagccgagattacgccactgaactccagcctgggcaacagagctagactccatctcaaaaaaaaaaaaaaagatacattctgagatgctggtgagtttgtagtataggaatatttgtatcatgatggagtttaatgtgaaagttatagacagtgcttatgcatctgtattccttaagcatttgtgtaaaattacttttttttgcatgctattattgttctgataaaatgctaataagacaaatgtgaaaaccaactcagtttctagatggaaaacacatggaaggatagacactgctaagatgatgatttatctctttgggatcagaaaaattaatatatatgattttatgccaaaactggttctgttttacagaagttttatttttcatcagacataaagattgatctgttttcttcatcagttagaaaatgtgtagttctgtctgccacaatttctagtatgtagatttcccatggatctttgcttttataattttatgtcagtttgtggttacttaattgccataatcttttgtcataactttacaaaaacaaattcagatgaagcttaatgacaatttgtgaccagttataaaattatggctttgaattttcttaatcggtaaattttacacatgtaaatttttattctttagctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaaaccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtgtgactgcttaagactagtacttgtattaactttctgatgctttatacaagagagcacttaaattgcatccttctttgagtttaacactgtagctttagccttgactttgaatattcattttgccttcccttgacaagtaaatggttacagtgaaaatgtgaagaagtatttccagttagtttttgtgtgtatataactcacttgtgtaagtggatgtgttaaaagatctctttttaaaaatccttttattggagtaattattaaaacagtaaatgcatagagctttgcacagcaatctgtatccatgagccagttccaccactagtaccttcatctgtggcttatccagcaaaatgtttcatttcctgtgtgccctggcaggaaagaggttggtaaatagtgaattaaagggatgatcataaaatttaacctggttaaaaagcaccttatttgatgacagtttgtatgcactaaaatcctttatacaaattaagttttgtctactg

SEQ ID NO: 75136 - DNA, 1045 bp, Homo sapiens
ccaggggccccgggaactgccctccatcatccccctagagagggtcagagcatccctctctactcccccacccccctacagtgagtgattctgaagcctactcggggccagagtcccacagagccaccccctccctacagcttcaggcctgaaaaatatactggggatcagagggccattgacagcccagccttctgagtcacctcctgcctggaatcttgccatcagcaacctcctccccagtgcctcctggatcaagctagagactgctggcaccccagaaatgtccttgcccatcctgccatgtctctgttcattcttggatttaacttattgttttttctgcctctgttcccaacccagctgcctctcttgtcctgagggttaggctggagtgacagtatctgcccaccccccaacccaagaaagaggctgctggaaggaaaatgccaaccattggaggtgcccaagagcagaacgggctactgtgaggggtcgtaagagccccatttctggaggcatgcaaatcttgactggacagtcagctctgaaattttatcagggcacttctatacctgtgggagactggactggatgagctctgagccagcttccaatcctacctgaatagagaactcaccgtacccacccccaacacatgataaacacacatcctcactgaaaaaaaaatctctgatctatgtgaaatgttttataaactataaagccattaaaaacactagctcttccactttcaatgaattgacagttaaacctatatagaaagtcacttcattcagttgcttaagtgtacattttgcaactcttcttatcctgaagagtatgctagaaagatatattgctcaagttagatgctctgtggttgctttaatgctcatatgaaaaaaaattaatgactgatatgagcatttggttaacacttaagacttgaaatgttgctgccatgttctgtacctgtgctattcaatatggtagccactagccacatgtgactattgagcctctgacttgtggctagtttgac

SEQ ID NO: 75137 - DNA, 1078 bp, Homo sapiens
ttgttcttcgcttctgtcttgttaatgtacagtctagagatagtaaactcccagtgttcaaattttgttttttatttttcaggtctagtttataatcaagttgtagagatttttctccttaagtgtttctaggtatctttgttgacatgtgtaggggcatttatgtcgccgtgtttttaaaaactggattaaatctttaaaaagaccacttaattattgaggcagttacgattatgttttcttgttaggtgaattaaaggtagtgttgccatggtgtttatgagttcatagtttgtctaatgcatacgcatatatatgtatttaatatgaaaagagcacctttatggagattctaaatggactaagacttagttttggccactagcatcatgttgtctgttaagagagagaagacaaaaaaaaaaatagtacaaagtagaaactgatgaagtgcttacctaagcatacacacacagtgcagggaactaggagctgtattacttagagtgtaaagtgggcttagggagtgatgggcaatgatgcttgccggagatgtaagtaggttccaagtgctgtaggtgttggagagctcttgaaggcttttccgtggttagacttgtggtttaaaatttaagctcttcttgatagtagcatgtagattagatgttagggaaacaaaacttgaaatagggattaagggagaggtgacagtagtaaggataggaaagagggtactgtgtggagaaatagcctctaagagctaaaatatgtttgactttattgattgcatgtgaagggtgagagagaaggaatctagaaggactcccaggtttctggctgtggtaacttattcatggaggtagggtttttagaaagagaagcatatttccctttcttcactaaaaacaataataatcaagatttagtttttataggactgccagtgtacatggagaaatgcagaaatacatggagaaatgcagccagattttgcagttttctctagtctggtgcgttgtatcttcacctgcacagtttttttttttttttttttttttttgctaaatgcgagtaccct

SEQ ID NO: 75138 - DNA, 1164 bp, Homo sapiens
ttgtagtgcagttgctattcacagatgcaattatagtgcgcctacagcctacagcctcaaactcctgggcttaagcaatcctttctcagccttttgagtagttgggactacacaggtccatgtcactctgcccagcttcatcttttttttaattctgggaaattttatttgagacaggatttcactcctgtcacccgggctggagcgcagtggcatgatctcggctcactgcaatctctgcttcctgtgctgaagcaattctcctgcctcagcctcctgagtagctgggactacaggcgtgcactaccatgcctggctaatttttgtatttttttgtagagacgggtttcactgtgttgctcagaactcctggcctcaagtgatctgcctgccttggtctcccaaagttctgggattataggcattaatcaccacgcctggcctaattttgggaaatttttaatgcatttttgggactgctatttttcagatgttgccccttttacttctgacttccctatctcttaacttctatttttcaatttctttatggttttctataccttttgagagttccttaatctgaggaactgaaatctattcttcatctacactcattgtagagtatcttgtcttttaaaggttttcccttttatctctatccatattctgtagatgattgaagtcctcatttcttttctacttgtttgtgttacctcagccctaaggctgatccttttacaaatgaattcccgcctgcttcattatttgagagagaggttaaggaagaaaaaggtttggtttactgtttctttagtcagttcagatctatggccctatggtaacatttctcaggctgttttattttggatattggcatcaagggatatgataataggggcttcttgaaattatttttttagggtcaaatttgtttggggagcaatgggttaaatgaaattaaacaagtatctttagagtaaagttatttcagagtctttaatatgctaattcacaatgtgaatcttcaatagggagtctttaataagtagtatttaggctgggcatggtggttcatgcctgtaatcccagcactttgggggacccaggcaggtggatcacctgaggtcaggagttccagaccagcctggccaacatggtgaa

SEQ ID NO: 75139 - DNA, 3087 bp, Homo sapiens
aaatatcagaggtatgtttattatagtatttaaaatccatttggaataatccaataactaatcattttaaattaaaaaggtcatagaaaataggtcttaattcaatatggaatattatcatgaagcagccttgatttttttttagttgattttttatgtcatgcctttaattgtattaaattggctttatttctcatttttttctttatagtgcttttaagcagaggttggcaaactgtgcctaatgggctctccacttttttttgtaaaaaattgttttggaacacagccatgctcatttatgtaggtattgcttttgtttctcactgcagtggcatagttgagtaattgcaacaaagactgcatggcctacgagcctaaaatatttattctctggctctttacagaactttgctgaccactgctacaattgctgttattttgatattataaaaatgagcaaatgtataaatgaaagttatttaacttatagtacatattttttattatgctcgtctgatttccctaatgaaaaattcttatatctgtttaataaagttggctttctctcttaggcaacctgtgaaaagctgaacaggtccaattctgaacttgaggatgaaatactctgtctagaaaaagagttaaaagaagagaaatccaaacattctgaacaagatgaattggtaaggcttttttatttgaggagaatataagaaaaagaaagttactgagctttaaaaaattaatatgatactggttaaagtattacattattgtaaaaaatgtaaagaatacaggtggttgtagagagcaaaattttctagatccattcttttcacttcccccagatgttactgtgttaaatttcttgcatatttttatagaaattttctatatgcactatggaagtagctcatgtaaataaaaactgaataatcatgtccatagtgtatatttgtaattacttaacatgtatattaacattaaaactttttcttttgaaaaaacctgtcttaatgaaaatcttgatgtatgtgagattatttagtaaaacatgttagtggacttatcttgagcctatataacttaaatgttatgaaatattaaagttatgagatactattgttacgtaatgttcatataaaatcccttttagcatatggctaaataaactgagaaggtttcttaatttgagcttcacttatggagctaaagtgttaggttaacagtatatctaataaacatggcattttggaaactagagtttagtaaatattaattgcctgatactgtgtttctagatggcggatatttcaaaaaggatacagtctctagaagatgagtcaaaatccctcaaatcacaagtagctgaagtaagttgaattagtctagtaggtctgttgcttttggaaataattttagtttaattttttaaaattaagaaataagacacaatagtaggatttgagatataggggatcccagatatgtatttttttttttttaacaatacctaaatgaattagcatggctgtgttgcccaggctggagtatagcagcacgatcttggctcactgcaacctccacctcctgggttcaagcagttctcctgccttagcctcctgaatagctgggattacaggcatgtgccaccacacccggctaagttttgtatttttagtagaggcagggtttcaccatgatggccaggctggtcttgaactcctgagctcaagtgatcggcccacctcggcctcccaaagtgctgggattacaggcatgagccaccacacccagcttgtattttttttttttttacgtgaagtgcttcagaaaagttcatcttttcagtggacaagtgtttattgagctattactatatattgaggactggttgcttgacacttaacattaatagacaaaaaagtccccaggaagtttaaattttagtaggggaggcagaataaatagttatcaaaatttgctgcacagtacatagaaagttacaagaggtttgtccaaggtcacatcgtagcaagttagtgggaaaggcaggactagacctggattctagacaagccttttttctgctacaccatgctgcctctgctgttaatattggcatggttttgcctttgtttaattctgtgttctagggagtatgtgtaaagatgagctatgtattaaattaattgttacaaacttgacattttttgtttcacttaggccaaaatgaccttcaagatatttcaaatgaatgaagaacgactgaagatagcaataaaagatgctttgaatgaaaattctcaacttcaggaaagccagaaacaggtttgtgctccgtagggactcttcaacttgtgaatatgtaattatagatgttcttgtcatcctcatgactgacccatgctagggacaagtataggcttttccttgagagcatgagagcaggacagtctcccatacatatttcagtgtctgtctcttttgtatagtatacaaaagtgtatacttttggcaccctctaccccagggcagggaaagtaagccagggcatttagcattttggtaatcataaccaacttcttaaagccatgccgaaggggtacagagaatatgagtgaggattattgaagttatagatctggggtctaaagatagaaacaattctggtggcagatcacataaggatgtgacatttgccctctttctcccccacatacatagatactcccacgtatatttcttcttctcctttgccaatgtaattgtaacttttcagtgggaaaatttttcagtgattaaattattataattatccaaatattactcacaccagagccacatggtttgttcttttttttttattttttaattttttagacggagtctcactctgttgccaggctggagtgcagtggcgtgatctcggctcactgcgacctctgcctcccaggttcaagcaatttttctgcctcagcctcccgagtagctgggactacaggcgcgcgcctccacgcccagctaatttttgtatttttagtagagatagggtttcaccatattggccaggatggtctcaat

SEQ ID NO: 75140 - DNA, 1462 bp, Homo sapiens
gtgcagtggtgcaatcttggctcactgcaacctctgcctcctgggttcaagcgattctcctgcctcaacttcctgagtagctgggactacaggcgcgtgccaccatgccaagctaatttttgtgttttagtagagacgaggtttcaccatgttggccaggatggtggtatttctaaaggttagttattttaagtacaaaattgcacaatgatttaaaaaataaattttaatgcaagtaaggtatgatattttatatgggatataaggaatggtaagaaatgatcaaatctaagatatgtatatctcaggaaacctttatttgatataaatatatgatataaactagttgaagaatgtgtgtgttattttacactaccccattttgaaagttctttgaaaataggagccatgtttttcttttttaagtagctacataatgccttcttggtatcttttaatgattcacttgtgtgatgagttgcatttttaaaattttcattttcagcttttgcaagaagctgaagtatggaaagaacaagtgagtgaacttaataaacagaaagtaacatttgaagactccaaagtacatgcagaacaagttctaaatgataaagaaagtcacatcaaggtaaatggctctactggttttagtgatcaagttggctagaattttacactaactctgaaatttgaaagctagtttttagcaacttttattttcacaacatattttcataacatatttggccagattttcaaatgtttcttgaagacttacagatttgtcatatgtacatacacatacacacacacatacttatatgaatattctgtgtgtccttttttcttctctgtattttagcctaggtatttaataaagaaataaaaataatggtttctaccatttctcttcaggatgctatctgctcctgttaggaggttggaagagtttgagaaattggatgtatagttatatatattaattgaatatctttaatgtaactggtgtatgtactttgatggagaggaatacttttaaaaaataaatttaattgaaacttgactccagtcataagaataaaaggattttttgattttttagatttttaagatttttaaaaatcttaatgctgataaatacagatactcaagtgtatcaaataatgatatgtaaaactaacgttctataatttacacagtgatgtggatgttgtcatattgaaagtgatgctctcactcataggtgggagttgaacaatgaggacacttggacacaggaagaggaacatcacacaccgggacctgttgtggggtggggggaggggggagggatagcattaggagatatacctaatgtaaatgacgagttaatgggtacagcacaccaacatggcacaggtatacatatgtaacaaacctgcacattgtgcacgtgtatcccagaacttaaaatataataaaa

SEQ ID NO: 75141 - DNA, 1055 bp, Homo sapiens
aattctcttttataaatgtctttatctcagctaattgtttccttgaataaatcaactaaaaatctacgatctttttatacattatgtatctcactgcagatgtgtttggtgtcacacagaatttactctcatgttaattagggcactgttatttgtggcatgtgagaaatgtcatataaaaaatattttactactttttagttgcataatattaatatgtactatatttgatttgggaataactagttttggcttttacttgcagagtttaatagtcaataaatgttaccatttctcaagactacaatatcttaataagaggtggaaaataagagctcttgtgttgttatttatgtggactgatttttaaactataactgtacattcacaagttgtaaagctgttagcataaggcattaccctctctatttttcccctttgttcaatgtcaagactctgactgaacgcttgttaaagatgaaagattgggctgctatgcttggagaagacataacggatgatgataacttggaattagaaatgaacagtgaatcggaaaatggtgcttacttaggtattaagtcatgactcatctccttttgctaaaatggtgactagctcttctatttccttttcgttccctgtgtgcaccatgttctttatatgcttttactttggcacattctgtctgtctgtgacacactgtcctttctcaccatcccttatagtttttagcttcagctggagcactgccttttcagtaagtctttctccagctgctcagacacacttacagcctcctcccttttttttgtgtattatacatatctttattatagccattttcaaaattacatcataatcatttcaatgcctgtttttccctgtactgtaagctaatcaaatggatgaatgactagtttgaagaacaagtgttctataaatacttcaggatacttcttttgcttttgtcagaggttcagatggttacagtacttttaatgttagccattcaaattattattgccattgatggttgtgctctgaagttggca

SEQ ID NO: 75142 - DNA, 1511 bp, Homo sapiens
ctgaatggacactcttgattaaactgcccattaattccatctctgatatatgtaaaactgatttttctgttctgtgcaaattgcttctgcccaggtgttccttggcttagtaaatggcagtgtcctttacttagttacttagggtggcacctcaagctgtttttgacttctctcttgcttttatatctcctatttattctgtcattaaatcctgtcagcttttttatagcctgaatctgaccactttttaccatcttccatattagtctagtccaagtcatcaacagttaatacccggcttattatagtagccttatgggtagtctccttctttccgccctttctcctgcactgtgttttctctgcaacatgcaggatgacccttaaaatgtgaattgtgagtatggtcactctcgtgctcaaaatccctgagtgcctttatatcacactcaacccacagcttttatatcttggcctacaagacagtacaggattggacccttggccacctctttaattttagcttattcatgttctttttcctctcagtaccctccatccagcactggcctttttgatgctcttcagcacattgaccttagggtcttttgtgcttgttccttctgcctggaatgatgtttccttatatatttgaatggctcagttcttcattttattaggcctgggttcaaatgttacctcaaagaatccttccctggctactctaactaaaataatacctgctactctttattcccttattttgcctcatggctcttattgtcctctgattgattgcttttctttcttttatcttccttatgttaaatacaagctctgagagaaaattattttcttcacttctgtattcccagtgcctaaagctacatgagacgtgtggtaactgttcagtacatgtttgttgaatatatgtacaaatatgttcagtgcctttatatattggagtgaaggagtgtgtgtgtgtacatgctgttgcctaaatgcctaagtacactgaagacccttgagatatctgaagactctagattttcaaatagtgccatggcatgtatttttttttttttttatcataaagggtaataaaatgtaacagactttcaggttcctttaggctcttaatgatagttattacagttgttccttattatttatagaatctgtatttgtgaattgacttactagctaaaatttatttgtaaatcagatcagtacatgcaaagcttttgtagccattcatggacatattcagaatgatgaaaaatttgagttgcccaatgtgcatgttcccagctgaggtcaaacaaggtgacactctgctttcttgtttcagctctcattctgtaaacaggtgtcctttttacagtatatttagtgcctcattttttacatttttatgctttttgctggtgatttagctgtttaaaatgccccctaagcatagtgctgaactgctatgtagtgtttttaagcacaagaatgctgtgatatgt

SEQ ID NO: 75143 - DNA, 1415 bp, Homo sapiens
attgtaattataattgtgtgtgtgtgtgtgtgtgcgtgtgtgtttacttgcctggaagcctaatcactaaccaatataaaaattaacgaaacacattttattaattggtgacttcttactagcaaatgtaatgcttgtttatacagaaagacttgataagtgatagtcataatagtttttattaaatatatctttgatcctatttttaagataaatttatatagaaaactcttgaaactattagtagttctgtattagacacaatgctttacaatttcggtttataatattaaattcaacaccaggaatatttacacagatactttttttttccttgtaggtgatgttttcagtggtattttagaaatcatttgacaggaatcaccagttttttcacaattaaaaatatagaattgattatcttttgacatgtattaagagaattataacattttttgtttttaaggaaattaacagtagaggaaaattatcggttagagaaagaagagaaactttctaaagtagatgaaaagatcagccatgccactgaagagctggagacctataggtattaaatacatttttctggtttcttttttggaatgggaagagtatctaaaaaacttaatgccagaaaaataataaatcaaatgaaaatagaaaacattttaaaatctgacaggtggtacagacaaaaaaataatatatttttgtctcatcacttttcattcagatttcttggtcttgagcaattatacagaaaatataaagaggaaaaatgtttttctttcaggttgtgtgatttttaaaatctctcaaagttgaatatggacaattctattttatgttagtgtcaatatgaatagatattaattttaaggtccttcctcattggttcaaattgagaagaatgtatgtaatattagtgaatcaataggtgtgccacaaaaagaagagtgagccatagagcatttggaagtatttaaaagactataaatctagattttaccttggtttgatccttactagatcccaggaaatagaaaatatagagaaaaaaagattcagcagtatcccaaatagttgtgatacttcattttacctcagaaagagcaagcttgctttttatccaaaataagttatcttgttaatctcacaaaagtaccaagtaacattttacttcacagtggttgctaatttcctagaattctattaagactacccacatctggccgggcatggtggctcacgcctataatccctgtactttgggaggccaaggtgggtggatcatctgaggtcaggaattcgagcccagcctggtcaacatgatgaaaccccatctctactaaaaatacaaaaaattagttggtcgtggtggtaggtgcctgtaatcccagctactcaggagactg

SEQ ID NO: 75144 - DNA, 2032 bp, Homo sapiens
tcactatctctagggcagcaagaaactgattaccctagttaataagcagtgggagataaaggtgttttggtcagaataattttagaggatctgtttgttctgtgtagatattaaaatagtgaagagcagcttgtagttggtagaggcattttttcttgtggtgcttctcttggatgagtaacttagagatgtttgttctttatttgcagattaactgaaacagagcttaaatttgaacttttagaaaaagatccttatgcactcgatgttccaaatacagcatttggcagaggtagtctttttttttttacccctcatttaaaatacatattttacatatatatatatattgcacatatagtttctattagtgtaagttaacactgttatttatataaatattttagattttagaaccaaggttctagactaagctttctcatagactcacaagcttctaggttttgtttcctgtgcagtaatgaaaattactgttgcttttatttctcagtgggattttgtaagatgatacatatttagtactttgagctccttgaaaagctaggtgcttggcacatagtaaggtactcattaacaattttctgtgagattgaatgaataaggagtgcttacatggactagcattgtgactgtttatatattaactatactttggaatttgcttgtttaataattaaaaaatagtttctaattatttaaaagtatcaatttaaaatgtgggaaaaactcagtctgaggtttgattgctttaattaccctcaagggaggaccaattttttttgtaagatatatttaatatttctgtccattgttgagttagggtctgcagtgatctcaaactattgcaaacagtttaaattttttcataataattttggttgaattggaattaagcttctaaggtactgaaaaatctatatataggtagaattccattttaataaccttggaaagttataaaaatcacttttgagagtaaaatttcattaaaatgaaagtctgtttctacatttaaaaaatattagattattacgaatttcaggtagtaacaaagtttggattggggtgaagtatatagaaggatttttttttgtctgaatccaacacaaaatttcaagaagggtaactaatgctttgatcttttcttgtagctggtttgaatattataccagctacactcatgttttaaatttaacatgttttaaaaatgttattttggtggtttttgtttgtattttgtttttgatttttgactttggaaacaaaaccattatttgagagtggtgaagtttgtaaagtggtaggtgtcttggctgtatagattatagataaagtgatttagttgataaattagtatttgtaagctgactttttactggtaatgaatcaaaagtaaattgtgatcttgcttcagagtattttatgcatttttctcctcttcataatctgagcattatttaaacaattcatggcccaatacagcctatctggccctgatttaaactgagtacttctatgttgcaactctcaccagctgaaatgtctgggtgcatactgccagtaaaaacaaaccaaaaaaaaatctaactttatgctcctataactctaagatatatctccaatatcctttgcttaatataaatgattatttatcatgatctttttattcccagttcgttgatgtttttattgcttaaagtgtctatttgatagacaaatatcgaaaacaccagggtctgtatttaattctgttctatattagcaaaatcaaaggatacattcaggacatagattaaacttaaattggcaataggatgacctgatggtaattgtcgaaatgggattctaactctgtagtgtagctaagtgaaactatgaatttaaatatgctgttttaattattccagagcattccccatatggtccctcaccattgggttggccttcatctgaaacaagagcttttctctctcctccaactttgttggagggtccactcagactctcacct

SEQ ID NO: 75145 - DNA, 1011 bp, Homo sapiens
aaatcaaaagtcttacattttcagttccaagtatgtgttttataagagctgatggcattcttcaccagtgaaacattcccaccctttgtatcagtgattttaacagattgaatttgagataggaacataaagtaatgaatctaaataaaaacaccaaattaaatccaacaaatcaaagttcatatactcagatgggtattactcatctaaatagtatctcaggaagtctgtgtacttgttagttgaagctgccattactccacatatttttggaactcttcctttggaattgctttcaaataatatgagaaaatcaacttactactgtatggtcatgagatattctccctttgcccatatcctgtttgtatcctctttctccaccctcattttgcttcacttagaactgttcctgtccacctcccagtccccccagtagattgggccacagcctggggtccctacagagcctctgcttgtgttgattttgaactggaagctcctagggaaagggactgccctatagactgatacttagagccttagggaggctttgcattgagcacttcaggaaagagactgattttgacattgacatgtctgctgcaagcttatgacttagttctctaagtccacccccacccctccattttttaccttggcttacactaagaaatgtattttgtatcatgtcatattgtacactaacataaacatgattgaaatataattgaaaccgctacatgaaatagtacttgccattacagttttgatgctttctattcaattttatcccgtttcattaatttaatcttaattagcattattttttaaacttcacacatcacaaatgagtaggagctagcagtctgaaaaaacagtgccctagaaataagggtataattggctaaactgcaaatatgagtcactggaaattgaattacataagtcaaggattgcttgtagtcaattgaatatttggaatgattaaaatttacatttgatttctcc

SEQ ID NO: 75146 - DNA, 1127 bp, Homo sapiens
tcatgttttaactttgagatgcagttttttacatggctcttaagttaaactgagtacatttccaaaagagtttttctgaaaaatactttagtagcaaaattagtagaatagatatagaactgctaagatgactgttttaaaggaatcatgctcatttggactattgatatattagtttaagcaacaaaatcatttatgctttttatttaatcatttattatattttatatttattttaaatattttatatttattttatattatattttttatttaatcagttcttataattactttataattatcctgttacatcaggcataggaatcatagcaatttactttctacactgttatttttcagactttgtatttataatttatgatttaaccactgattttatgtgtaaaacaagtatataagactttttaagatgaaacagatttgtatgtttttttttctttaattaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggtatgtaaagacaatagttattatttctctttgaaaggcagctgggatgtggaatacacaggaatggaagaagggaggagtatatgtttgttctctcttaagaaaaatcatcgtacatttttgaaaacaacaatgataaataatctaaacagaatgatttgagataattgttcatattatagaaagctgttttctccctaaatggaatgtttttattgtttttgttgcttgtagaggtaataatgcatgtttactttagaaaatccaaacaacacagaaatgtgtaaagaagtgaaaaatcccttttgtcatcttagcgtgtccttcccagaatttagttgtaggtatatatcttttagagatttttttgggtatacatttatacacatagctgttcaaattcttttaatcactctgtgcagttgtaccattcatcctcttttgtaattgtcttttttcactgaccattttatctcaccaaaataaatatatttacca

SEQ ID NO: 75147 - DNA, 1183 bp, Homo sapiens
ttactgaaagtttgacaatgatgacatctgaatgatactctttctgctttgatgacaaattatcacctgttctggtaaatttcttgctgtgcttacgttttttctctttactttttccttatgttagtagatgtttcctgggtcttttttgatacattgatgtatttacttccatccattattaaaatggaaagttaatttacatatatataaaactaaattctgttttcacatattctaatttacacatagtaattgaaattttcaaaatccaaagtagcagattatgcttgtgtttactataaaggttattgcctatagtaaaatatgcaattcttctgaaattgtctactgttgtcaaccaagaagatgatgagtttaagtgttagaatacaggtcaaaagtgtaagttcaatacgttaaacttaagtaaacttgatttatatttacattaatgaagacattttaaaaacttattttctaggacaatcatatcctgattcagcccttcctccacaaaggcaagacagattttgttctaattctggtagactgtctggaccagcagaactcagaagttttaatatgccttctttggataaaatgggtaagaagtactttgtgcttttcttctttaaaaattttggtggcacactaaagaactggaagttagaataaagaccaatataattgctatctctagtagttcctaaggccaaaatctctttcctgaaaatgtcctggttttatgtttcttgttatattgtacacagacatggcatccaaatatatgttggtgggttggtttgagcaccatggaaataggtttactccatatacctatgatgataaattttactctgttctatgactaattttctaatttttctagtccacttacatgtgttctgtttagtaatcagggaaataagccaggcaaatgtgaatggatacataaaaacccaccagaaaacaatttagatgcatgctctgttgatattgtaatcagttatattaaacatttcatgcttagatataactaacatgtactgagcaatctactatttgtcaggctgtcttttacttaaactacctcatagcaacccattaaagttgggaaatagatgtatgcagtgtatcaaccagaagtacacaacgttaagaaaataaaaattttttttaa

SEQ ID NO: 75148 - DNA, 1030 bp, Homo sapiens
gctacaagaggagaggtagttgtggtcagagaggattgcatttcttgatgataacaaagttcgggaacatttatttcggaacagtagctaaatttcagtagctagtctctcttacttaatggaggaataaggacggaaggaagaagaggaggaaggagaagaggataggaggcaaacataaaaggagggaggaggaaaagaaggaaggagggagatgcttcctcccagatgtcttcttagcattctgctccagcaggattgcttaggaactagccagagaaataattgccacatgccatcatagaactctgagtctgccagaatttctagggacctcaagctgttcttgtggccgcaatataggatattggtgtccagctggcttatgtgccaacaaggggagtgggaaaataccaattttgtgatctggagatactctaggaataaagtgataaatcatgtacttttcatggtttaacttttatgtctagatgggtcaatgccttcagaaatggaatccagtagaaatgataccaaagatgatcttggtgtaagtattgaaagagtggaattgtatgcatgtattcagaagccttctttttttttttttttttttttttatggagtttcactattgttgcccaagctggagtgcagtggcgctatctcggctcactgcaacctgggttcaagcaattctcctgcctcagcctcctgagtagctgggactacaggcgtgtgccaccacacccagctaatttttgtatatttagtagagacggagtttcaccctgttggcgaggctggtcttgaagtcctgacctcagatgatccactcgccttggcctcccaaagtgctggtattacaggtgtgagctgctgcgcctggccctgagccactgtgcctggcctgtgccttctaatctcatgctttactagaatagaaatatagctaataatctaggttttgatataaagctgattttctctttttgattaatatactttctacttagcgtgaaagctgttt

SEQ ID NO: 75149 - DNA, 1078 bp, Homo sapiens
cagtacaggttcttaaagttaaaaaatgtcttttaccaatctctttgaacagtgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagc

SEQ ID NO: 75150 - DNA, 1453 bp, Homo sapiens
gatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaaccaaatcgtcatttttacagagagatgcaaagcttcagtgaagacatttagcttttttttaatgtagaattcctgtggttacatatgcaagtagggtcctattatgtttttttttcagtagtgtgaattaatccttttgtgctgtgtttaatcagtattagctttatagaattatatatgtatattctacttcttgatcaaagaacgtagtcgggtattggtttagaagttcaaagtgacaatgtatagggctttcacggttaatggacttgttaccaaaccttaaggatatacagccgaagattgtctgaggttgctggctaactttatttttcactgagttactctgcctttttgacgtttttattctttgtgtgtcagagttcagagctcaggagccaaaatatttttatacatatatagatatatatccatagcctggtagatttatatgcaatgcactgcatccatgcattctgatagcatttcattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggcccactctggccagccagatactgctagattgtaatatttaaggtcgaatttcgacctgtggtacacagctgtgctgtggctcagtcagcaacctcagaactctgaaaaaacaaaacaaaaaaaaaaaaaaaagaaaaaaaaaacatgcacctgtttcactgtgaatagtgaatgtaaaggaaagaaaggaaaaactgaaagcttgttctatcacaggtatgagctgctatgatacatgaagaacattccatgaagtatgttttaaaaccttgttatatctgagaggctttaaaagcctattaactgtttcagggca

SEQ ID NO: 75151 - DNA, 1030 bp, Homo sapiens
tcctctacttgcctttgctataacataaattgtatgttatcctacttttctactaaacgggtataagtggtgcttttcttggatgaggaacatatttctacgtgtttaatagatctttatgtttaatataccttattcattatattttaatgtgaattttaatggtatttactgtgggttgaatcgaaattacctaatgaggaaaaatagatctcaaaattgcatgcttttcattgcctattttcaaaagtcagtgttaaaagattagaactaaatgttaatgggatcactgtggcatgtgttttccttatagaattcagcaactgtttgaagaaatcctgagtaatagtaggcaactgaaatggctgtcctgtgggtttatgctggaaatagtaaccccaacatcactgtcatctctctctaatgctgttgccaacaccatggagcacctcagtttactggacaataatattcctggtaacagcactcttattactgcagttgaactggagcgatttgtgaatctgcactcacttgccttggatttttgtgactttacagctgagatggcaagagtcttaactgatagcaaccatgtgcctttgcaacgactgtctcttctggttcacaatgtttctgtaatgcacaagtctctggacaacatgccaaatgatgagcattggaaagccctgtcacgaaagagcaccagctttcgggtctatataatggcttttgatatcaagagtgaagatatgttaaagattctgaaacccagtataccactagagaggattcattttgatagctatatcacttgtgtttcaggggctattgttgatcttatatccaggcaatatgacaagttcctcactcattttattttaatgaatgatgtgattgacacatctggttttccagatcttagtgacaaccgaaatgaagatccgttggttttattagcatggaggtgcacaaagctctctcttctggcaattcatggtaggtgatcttgttcattgtaatctgatac

SEQ ID NO: 75152 - DNA, 1191 bp, Homo sapiens
cctgtgcgtttccacagcttttcgcaagacattctatttccttactttggttttatctggcaggagaggccattgaagctaaaaacagattaggttagagactttctcagagttgaatgtatggctagaggaccaactgacccaaaagttgcaaagtttcagtcagtgagcacttactaatgagaccaaggttgagggtgaattcaatgagtgagtaccaattagatttttctgtactgagatcaaattgcacttttatgcaaccatgcaaacactgtatgtgcctttgacccaagtaagaacaagacttgataagtgtctagttccttttaagtattttaataactggttggttggatgggtggataacatacaggcaaaatggagatatttcacatctttgctttgtagcttaattctcctgtccttctcttccttacccctacaatttttattagcatcccaatctgcttctctataaggccaccgatgcctgcccttctgggtcagctatcacttctatgcaaaaacatcacacccgtcatccctaattttaaggtttgcttgtcatctactattagcatggtgttgtatgtcatgctgctttggtagcatattcattctgtttgtctcaaaatgtagtgtaattgcatgttgtttgtactaatgatacatcaaagggtttttggaaataagttaatctcatctttactgttgaaagtgttttgagatactctgtgatattggaaaagttaatatgaatattaaatccataaataagactagtttcctttaaattttaacaaatctgaaaatgttttaaaccacattgtttatcagtgactagtaaagcctattatttctttctataatcacttaaactatagacttgggacatttgacattgctctttacatttccaagttaaatttacaatggttttgctttatgatttctgccattctataagtagaaaagagggggtgtgaatcataccagatcataagcattctgcttccaggctttgtgctgaattcctttatacagttcatacaattcagactgttattttgttttgttccagttattttcatgtccctcaggaaaataattaaaagtataaacttgaattgtgtgaacttttcaagggtgctgatcttcagagaggacaattggcattttgttttgctt

SEQ ID NO: 75153 - DNA, 1016 bp, Homo sapiens
ccaccacgcccagctaattttgtatttttaatagagagagggtttctccatgttggtcaggctggtctcgaacgcccgacctcaggtgatcgcccgcctcagcctcccaaagtactgggattacaggtgtgagccaccgtgcccagcctcaggattttttttattacagggtttccctctgtcacagataaaatctgcaatgtaattaatataaagcctatcaaatggccatctgtacctcaaaaaaagactgcagcttcttaaatggtctttccagagagcatgcatagtgcgcgaaaagtggctcatttaaatttttttgctatgttgggaggcctaataaccacatttgatttgagtctttagatggatttattttcgtttaaacatattatgcatttaatatacaaagttacaattttatgtgttctgttttaaacttttaaaatgtaggatgaagacactgtttgaagagatcaaagcatcaattaaaaataactataaccaagatcgatcattttgtaggcctgttcttccttgggggggtgtttttactatcaaagctggccgcaaagcagtatcctgtacaccactctatgttgaaataagactgaaaaatacctgcaccatagatggattcttgatgttattatatgtcattcttaatgaaaatgaaaacttccctagggaactctctcttcattttggtagagagtttgtagactgttttctttacttaatggacacctacagttttacaactgtgaagctactttggatttgggacaagatggaaaaacagcaatacaaatctgaagtccataaagcttcattaataattgatttgtttgggaatgagcatgataattttacaaaaaatcttgaaaatctcatgtctaccattcaagagagttactgttccaactggcgatgcccaactcgagtgcaggaggatcagcagcgcacaattaatataaagtaagttggtctaacgtctgttttgtcacttttacttt

SEQ ID NO: 75154 - DNA, 1048 bp, Homo sapiens
gttttttttaacggatcaggtacttgaggccaagaatgattattacttacatttaatcaggtaactaatcagctgctcctctgattctgggtcctagttccttcccacgagaccagattgcctcttttgaatcttctcacaaatgttttaaattatcatagcagcaactggatatatcaggattgtttatacaaaaatatgtttctttgaaaatttcataattagtgtttgagttcaactggtttctatactatctgcaagaaattctgaatgtgtcataaaggttatacttggtataactggttttgctaataaaggactgagctgtaaaatttgttataatatattaagatataaaatgttgaagcagttcttacatgcatttaataattattatagtcctccccaagaaattccacatggaaacttgataagactggctgtgaatgagttattctgttccaagattgaactgtgtgaagagcatgggtgagtatacaatagacatttaaaatgacagtatgtatgtgtttataaggaaacctaggcagatgtgctccttgaagtactttatgaatcttattaacctagtttactatgacattttacagtgtttttgttacggagtatatcactacatagaatatggtactacagctgattgatgaatacaaagcaaataccttttcttttttccccccccactgctgagtaggtacaataaaaccttggttaactggaacccagctaattgggaccctcaattatctggatttttttctgcactctccatttaggagaaagaggtaaatgacaactaaaaaacttaacctagtaaaagttgagagaagcagaacatattcatcccaatctcttaaaattttctgtgactacattattgtataatgagaattaatatttagaaggatgatcttattgctgattaattacaaaaggaaaggtaaaaatatgttctgttaattgtacctattaagtccagaaagtgaacgaatatattgtagcaacaaatactgaaacagatggtttt

SEQ ID NO: 75155 - DNA, 1128 bp, Homo sapiens
tttccctgtaaaagttttcttacgtgtttactcttttttaaaagaaacatacaggttataagttcatctgttaaaatatgtttttaagaaattcttaatttccacatttccaattttattacatgatctatagagatggatatctttttcagggaacagaatacaaacaatgtcaatgtttttattccttagttatgaatttaaggaatgtttatcttaacaaagtattaaattttctctcatactatattatttaatttgcaggtatttgttggaaggtgccacattatttaacaaagaggaacatcattattctgcagctttccagattggtggacattggatgcactatgatgggctcagaaatgtgaatttaattttgttaaataaacccccagagtttctcctcttgtcatcattggtttatattcgagcaacagagaaataaatatagattgatgctaaaagttgttttccctcctgcccatgctctcccagatgaagggcttttattttgtgtatacttggtatccaagaaaatagttcaactatactagtttcagaagtgtattttcagtgtttaaccccaggtaaatgttttatatagaggatctgtgcaaaaatgtttgtaatttttttatatttcctgagttatttttatatgagcatattttatgttggaataaaatatatcttgtggcctttgtattttttatttatatgtacctcaaagatttttacaattctgtctttgaattcaagaaatactttgtcatctgaattctaaatttttctttttggatattcgagtaaaacctaggtaaaagtattttaagtttatataatttaacagttcaaaatatatctgactgtatttctttgccctacctcactataatccaaagtgcactatttgatctagtatggatttgaatgtacaatttatcgatggcttagtttattagttcgatttgcctagtatccctgcagcaattttttaaaatgtctgagaaatttttcagagcttaaactatttctttataatggcaaattacttttaactacttcctaaagtattataaacctgccagtggattttaagtgatagctaagcttccaagcttaatt

SEQ ID NO: 75156 - DNA, 1053 bp, Homo sapiens
tttgtaaacagcactttaattagacatgatttaattagataacaattattccatggctggatatgtactggattttcacttacagtacattgatttggtgttgatacacatttgaaaagagtgaggaatacaatacatttttaatacaataggtttacaaattttcctactggtgtgaatatggagtcaaataaaaatccagtttacatctctgcagagagaaaaattgttatccatatgtcttttatattatacatctttactagagataacttattgttaattttgtcaagttatgtgtaagtcccatttatttttaaatactaagcaaaaagttccaagtttgccttaaaatacaagtgaagttaaagaactggatgataatgcctatatttttgccttatgaattgtgctgtgtattataaaccagcaacggttttgattttaacaggattctgaaattttgtagctgtagagtactaatatttgtactctcttgcaaagaatgtgatctagttgtggattatgttagtttaaatgtttttgtatatgtattttacctctgaacatgtacctttttagcatcagggttttattttatttatgtttacacactaaagtgtcatttaactagttaagaattgtattcttttttattttaaaggttatttgtgtgtatcattgtggtaatgttctgtaattattatggttaaatttcatttaatgtaaaatgtttaaaataaaaatgaaaaatctactttgtatatgtcatatgataattgtgaactgaaccaagctaactttgtcatgctcagctcttagggttttatgcatagataggtagtagccatagagtagccactcctttacatcttcattagcaggttacagtgaaaacatgtcttaggcccggcctggctcagtggctcacacctgtaaccccagcacttttggaggctgaggcgggcagatcacctgaggtcagtagtttgagaccagcctggccaacatgctgaaaccccgtctctactaaaaatacaaaaattagctggg

SEQ ID NO: 75157 - DNA, 2398 bp, Homo sapiens
gtcatagctcaccgctgcctcaaacttttggcctccagccatcctctcacctcagtaactcttacttttattataaggattttgtttttccatcaagctcatattgctccagtaggccccccatacccacaggagatatatattccaagacccccagtggactgaaactgcagatagtaccaaaccctatatatgtaatattttttcctatacatatatatctatgataaggtttagtttgtaaattaggcgcagtaagagattagcaacaacaataatagaatagaacaattgtaacaatatattgtaataaaagttatgtggatgtggtctccctcaaaatatcttactgtacagtactccctattttctagtcatggttgacttcaggtaactgaaagcatggaaagcaaaaactcagataaagggaggactactgtatattgcctgtataattaataatagattgttaaaatgtattttaataaaacattaaaatacaaatttatttttagtgagaaaaagtatacttcatggttaacatgtttctatcttctttttgccaacctttcctaggagttggtgctgctgtaatcgataactacctttatgtcgtcggtggtcactcagggtcttcctatctgaatacagtgcagaaatatgatcctatctcagatacgtggctggattcagctggcatgatatactgtcgctgcaactttgggttaactgcactttgacaaatgtgaactctcggaaatagtatggtggtgaaacttgtactgcatgaacatccggatggcccagttttctgaaacccacaagctgcattgctttctttttaacttgaagtagcatgaaggctcaaaagttttgttgggtacttttaattgagaagtagttttggttgctcttgattacacagtaaatcaataatcaaaaagaaaaaagagaaaaaaaaaaagtaaagactttgccaattgaattctgcactttttcccccaagactgagatgtactagttttatgttcataagtgtacatgtagacaaaacgtggctgctttttttttttttttttttttattttagctctccttccctgataaccatgattttctaggatgagcgatgctttaggtgctggagtgtattgaatgaatggacagagtgctgatactgcttcttggatgtaaatgcttcacatttttcatttgttttaaaacaaacaaagggctgctttttattttggtacttttaaaggttgtaaataacatgccaataggtagtcatctgaatactttcctgctaaatggttttagggctacggatgtaataaatttttaagacaattgcttttattatcatgatatttggggccctattttaggaaatcagatatttactgtttatgccttttgtatatgggcaggttaacgttggatgaatttaattacctatctatgctatggttagcatggataggagtttaagcatatcaggtgtttcagtttttcttcagtagtacagcaggcctcccagtgctgatgtaaatatttgagcagtgtttagtaccattcttagtgcatattaatttttttatatatccttataattttagttttttaagatctttgctttttcaaagtgttcagatataaaatggtgctaactgtaggatttataacaaggctataactgatgtccttttggatgttcagtatgagatatgcatgacatgttttgatagtcttttgcatttttaatggcttgattcatttgtgcttattaaaaatgttagtgattacgccaatgttaacatccaaaaatcatcagaatggcctgtgttatgcttttcatggttcctgaatagtgatttaaagaaagttacacttttgatcttctttcttcttgtgctagatattacatgtctttcttaaaaacagaaatatatgcattaaatataaagcactaggcagttatgcattactttgtacatttcttaggtaactgaatattttaaggttattgaggaaaactggaactcgatgtttacttgagtaatagttctaagttgagttctactttgattaaagaaatgatcttttaaagcaaaattgtttgctgtagccagtgacagcttatttaaagaaagtgtttaacttatttgattttagcatgttttagtaaatgtctgttagtcttaaacacattcacttgcattttattattatgtcggtacttgtattttggaactgtagtcatttgattttcttttccttgattttttttaaacctgtttgcgatctccttataaagtctctgcaagataatttttcttaagaaaaaaattcatattatattcttaagtgccataatgttctagactattgttaagaa

SEQ ID NO: 75158 - DNA, 1985 bp, Homo sapiens
ctgttggttggcaaatagtgttgtttgttctacatataattttactttaaccaagtttttcccctcatattttcattttatttcagtgatagctcagacttgaatttaatgcaggggaaacaaaatgaaaaagttggtaaagttttgatccaaaagtccattgtcagagatttttttggtttggggcatctcatgtaaccttttgggcttccatttcctaatatctataataaataagttgaatgatgtgattgttaaatctcttctaactctgaaagcctctagttctagtatttactatgaagtatttaaaaaccaatgaacagacaaataaattacaaatctgattattctgtactatttgaaaagcagtgtttttgacaagtttactttgaaataactgtctatgcttttttatttttctgtagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaattttgaagctgtttgccagactgaagagttttttgagcttacacatgctgacttggatgaaattgtttccaatgactgtttgaatgtagctaccgaagagactgttttttatgcattagagtcttggatcaagtatgatgtacaagaacgccagaaatacttagcacagttactaaacagtgtacgattaccattgttgagtgttaagtttctcactagactatatgaagcaaatcatcttattcgtgatgatcgcacttgtaaacatcttttgaatgaagccctaaagtaccactttatgcctgaacatagactctctcatcagacagtcttgatgacacgacctcgctgtgctcccaaagtactttgtgcagtaggagggaaatctggactctttgcctgtttggataggtaaatagaaggctttcctaaatgaatgatgctaattgattttatgctttttaaatgtgcagattttctatattttaaaaatagtttgattttcctttttacttttctttgcttctttttagttttttttcttcttcctaaaatacttacgtgattgtttttattatattgtcattcattctttacaatactctcaattattaaccatctccccaagtgcacactttatccacctggttactcacaaacttttattccattttctctctttctttctttttttctttctggaaccatttacatgtttatttgagtcagaccacatcagaagagatttattattgtcaattatatcagaagatagcaaagaagagaactaggaacctgtggtgagggaactggggacaggaatgggtttgaatgaaaacagttcactagaagtgctaccaaagaaatgagaaaaaataggatactgatataaattatgtactttgagtgtaatttgttttcttcagtgtatttttaaaagacagcattaagaaatatgtttttccccccaataacttagattaggaattgtcagactttttctataaaagaccaaacagtaaatattttagactttgtgagccatgtaatctttgtggcatctacttaa

SEQ ID NO: 75159 - DNA, 1448 bp, Homo sapiens
ctttaataagttaagaaattatgagcttattttatacaggattgaatcagttttcttgatgtatatgagtgatatattttcatctacttaggtttatcttccaaagccattatgtatttctgtcttcagtcaaaactataattttaaacaaaaatccaacttgtattacatattaattactatgtataagttaacagaatttcacatctgttgcagtttttcagtggacagggattaattatgtaacttagacgcctgtcataacatggattcagaaataacacagaagaaagcaagttcaaagtcattaccacatccagtaagagctcttgacaggcttctaattttacttttcttttgtttgtcaataaaagtcaaatctcagataaaaggaaaatatcctaacttattccataggctcactgatagaattatataccattattagttgaattatcctatgaggaaagttgaactgtaggaaagaaatttaagaaaagagcagatgtgatagaatattctcctaatttgataaatcatttcttattttctctttttaaagaaaactgtcggtttgaattttttttttaagagtaatcttgatttctgttcaccatttatttactctgggtgtgatctatatttatatagtggcagataagtgcctcccaactgatttcagcaccactgttttgtggcttaggtgtcaattaagtagataggtacaaaactcgcaacttgacctttattaacttggtttcagagcctaaagttaagttactgtagactatggaaagttttattttaattttaatttcaaatggatactttttattcgatattgactaatgcagttaccaagattcagaatactattgtttgttttatcattaaaaaaaaaaaaaaagaacaaaaactatggcagagatatggaggaacctgatataccaaatctgcttttaggcaaatactggaaggcaatgattgttccatggatccttctttatttcattttaaagccctgtgtatttttgtatctaatgtgtatttattttataaagattttatatgaatgatctatcctctggatttccattctgcacatttttaatttcttgtttgagttaagattttaataagattaagaaattctgagcttatttaataaatgaggcagtgtaatagaatatttaagaattacatagacagagtgccaaggtttaaatcttgccttggacttaatttctctgtgcctcacatttctttatctgtaaaatggtggtaataataacagtgcctattatattgttgctctgaggatgaaaggaattaatacatgttaaaagcttagactgttaactggtacattatgacagtcaaaggtattctagatgctctttcatagaattatttcattttatgagaagtgataacaattataaattgat

SEQ ID NO: 75160 - DNA, 1650 bp, Homo sapiens
gcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctggaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcaggtatgcttctctaattttcttgagtcgaaagtgtgaagaatttaaatgaaaatatgcccgtgatgacttaagggtcagcctgcttgagggaaacatgttatgctttgttttaaattgattttaaatccatctgaatgttggtactcattataatggtacagatcacaaaggaccatttaataggcttc

SEQ ID NO: 75161 - DNA, 1033 bp, Homo sapiens
attgcttgaggccaggagttcgagaccagcctgggcaacatagtgagatccccatctctacaaaaataaaaaaacttagccaggcatggtggtgcaggcctgtagtcccagctacttcggaggctgaagtgggaggattgcttgagcccaggagttccagactgcagcagtgagccatgattgtgccactgcactccagcctgctcaagagtgagacccagactcaaaaacaaaataaaacaaaacaagagtaacatgatgcctagccttactttggttttttttttcttgcttcagacctggaatcagccatttttttcagaagtcctagtactgcctttttattgggcagtggtatttgaaaacaaaagtctgagtatagatttgctcattgctatttcttgccattgtggtttgaccctttcagtggacagaaccaaggagtacttgttttttgtttgtttgttttttaatgcatttatattaatacctccaattcaaaactagtactgcagggttctttctcatcttcctttattccatatttgaatctcccttcgttcacaataaaatccctgctacccaacatcagtaatatttattcatatgctgtatcctacagtaacccccctccccccacaaaattgctagaccagcaacagcaaccaactacctactaagtaaagtttaagatttcgttacagttctttttgtatttagaattattccacagtcagaattttgtggtcaaacttttcttaaattaagtcttttatctatgtaattattattcaaacagcatgatgaaagatgaataggagcttgctaagtgtggataggtcccagtgaatttcagactaaaggaatagcgtgtttagagacactgattatgtgaaagaacttagcaaattaataagagaatggggaatttttgcacagcaaacacaaggggcctagtgggaagtagcagatgatactggagatgtagatggggtaaagtatggagataatatcttgcaaataatgagtttga

SEQ ID NO: 75162 - DNA, 1039 bp, Homo sapiens
aattgaggtcatcattgttgaagaattttgaacatttgattcatgctctcatttagttctttaactgattatgtgcaacttcaaaattgtatcctggcacctttgttccttaactatcatatggggtttatgagaaaggacttggaaactatgaagtactatacatatataaagtattatttactggttttaactaagagacctagtgtaagaaaataccctaagggaactatgacataggttgccatgttatttacattgacatttaggctgcagaatatggataatagatttgcctcagtaagaacagtgtagtagaatgcttgcttgttcagtgaccttcaactggcacttattgtctagtactcaaacaaagatagcatagtttgaggggttacgctgctccgtcagatcattgtttttgtcatttgtattctctccttccttgttgccagagtctgctgtaggatggtaaggaacagtaaagggttggggtgaagtagtaagaaaaaacaattagcatttctcttctggaatgaaaagtactgttggtgtacccgactaaatatggatgtttatctgtatcattatatatttgataaattaaaatttattctaacctgaatttcataattggatctaagttattttgtcatatttattaccaggaagaattaacacaaatttgctaatttatgattctgttcttatagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtaagtacaagttgctgatgatggtcatgttgaactaacagacttctcttaacttcatagtgcattcaatgactcatagaactttaatctagtaggcagttcagattcaataagttatttattgaagatctgataagaatggacacttagacattattatctcataaaa

SEQ ID NO: 75163 - DNA, 1449 bp, Homo sapiens
aatcgtttaagtattaatatagggcaatatttgcttaatacatcacccatatttattaaggtgcttttctaagtcctggaggtctgcctaatagagcttgcattctacttaggaacgagaacagacattaaataaatacaagacatagtaagttatctggtgataaatgctatgaaggaaaacaaagcgaaagaaggccatattcaggaaagaatatttgaagcaaaccactgtatatcaggagaagagaataaatagtttcaggaagagggaacagtcagcacaagtaactaagagagaagtgtgtggggaacatgtttgagaaataccaaagagaccagtatgtctggaatgaaataagagaggggaaaataagtagaaaattaaagacataataggggtgcttatttaaggcctagtggacttataagtgaactttactttttactctgaatgaggagcattttgaagaaagaattgacatcacttgtttccaggctcattttggattttatttttaaaatagatgaaagtgtattagtctgttttcacactgccataaagacatacctgagactgggtaatttatgaagaaaagaggtttaattggctcatggttctatgggctgcacaggcttctgcttctggggaaacctcaagaaatttacaatcatggcgtaaggcgaaggtgaaacaagcacgtcttacatggtgggagcaaggggaagagagtgaagaggaagtacaacacgcttttaacgatcagatcttgtgagaactctatcatgagaacagctccaaaaggagaaatctgccacatgatccagtcacctcccaccaggcctcacctacctccaacattggggattaccaattcgacatgagatttgggtggggacacaaagccaaactgtatcagagagcaaggtcaaaaacaggaagactgattaagaatctgttgtagtaatcgtggctagagttgatggaggctttaaccaggatagcaagaatgtggtaagaagtgattggattctggcttggcgcggtggctcacgcctgtaatcccagcactttgggggccaatgcaggcagatcacgcagtcaagagactgagaccatccttgccaacatggtgaaaccccgtctctactaaaaatacaaaaattagctggacgtgttggtgcatgcctgtaatcccaactactcgagaggctgaggcaggagaatctcttcaacccgggaggcagaggttgcagtgagtcaagatcgcaccactgcactccagcctggcaacaaagcaagactccatctcaaaaaaaaaaaaaaaaaaaaaaaaaaaaggtgattggattctgattatatgtcagcggtaaagttgatatagtttgctggtagattgggtatagaatgtgagaaagaagtgtcaataatgctgtaaggatttttggc

SEQ ID NO: 75164 - DNA, 1076 bp, Homo sapiens
aagccaggtctggagaaacgttccatgctgagagaaagagtgtaggaagaaactgcttttgcagatattcttcaacatacctgtcttttccctgttctttactagtctgtcttctgtcctttaattcctgccactaatctgattttctagtatcaaaagctgtatccctttcttgcctgcctacctcactgtacttaaacacttatatttatttccacctaaattacaccaacatttatgaaataaaatgtattcatgaaataaagttaacttttgcttttatgttttctcccttcctttcttcaaaaggtactactgggactcatcaaacaaatctttctgggaaatgtgcacaacttggattttcacaaatatgtggtaaaactggcagtgtgggttctgacttacaattcctagggacaactagcagtcatcaagaaaaaggtataagttccaaatttacttggaaacaaatgacttataaatattatgtggggattccaacactaacttatatgatattttgtgtactcatactcatcacaaaaaataaaaggattttgttatatttttaataacttttttcataattgttaccctaaagtattagttttcataatctttatataaatacaactgattaaaattagagtttagatactcatggtggagatgagtattgcatttgctttgatatatacataatagtggtacatatttgtgggggacatgtgacattttgatatacaatgtgtaatgatcaaattaggctatttaggatatgcatcacctgaaacatttgtcatttctttgtgttgggaacattacaaatctactcctgtggttattttgaagtacataataaagtattgttaactatagtcaccttattgtgctatactgagcactagatcttactccttcttattttattttatttatttatttatttattttgagatggagtcttgctctgtcgcccaggctggagtgtaatggcaggatctcggctcactgcgacctccgcccctgcccccgggttttgagcaattctcctgtctcagcctcctgactag

SEQ ID NO: 75165 - DNA, 1025 bp, Homo sapiens
ggagaatggtgtgaacccgggaggcagagcttgcagtgagctgagatcgtgccactgcactccagcctgggcgacagagcgagactccatctcaaaaaaaaatagaaaggaaatatttttaaatctctaggaatatatgagacattgtcatgaaagcatcagaacctgttaatagagcactgtaattgaaatgaggaaactgaaagttttaattctatatgtaaatctgtgactaaatctcctatatctctctacctagataagattttggtataagtagagattttaaccatgtcagatatgaattaaaaaaataaaggatatataatatatacagttgtttaagtcctcagaagaatgtttgctttattaatatacgtacgctaggtattttgtcacggaaaacattttttaaaatattaaaggaaaacttaagggaacccctaaaagattacaaatagactttttatattcgttgaagaataaaaagatcaataaaaggcaaggaagaagtaataaagaaaaaaataataaatagtacaaaataagatggtagaattaaaatcaaatgtatgaatagtttccgtaagtataaattggcagaacttacaacttaaatgacagaggtgatcagatcttgtttttttagtttttcattgaagtgatctttttaagagcattacctaaaatacatcaagataggttgagagaaagtaaagcatggaaaagatacactaggcaaatgttcagagaaaagcaaatagaaacatgttgatgatagggaaaatatgcacaccaaaactaaaaacatttttagttctagagaggatcattgtaatgagaaaaagaataattcactaaagaaacaagacttctctgacatgtgtgtatatgtatacatatacatgcatgtatgtatgtaattgataaaattacaaggagaaagttaatttataaatgttagtacaatattttaatgggataaagaagttttgaattagaagatacagaatatttgaataaca

SEQ ID NO: 75166 - DNA, 1065 bp, Homo sapiens
cagcctgggctacaagagtgagactctgtctcaaaaaataaataaataaataaaaataaaaagatgttgaaggaatcctctgcgtccctcatgattttctttccccagccattgatgtaagatgtttcacctttaaactaccctacaagtccagtgttcaatttatggcatattcagtcaattttatcactttctcttagcactatactttgattctcttctattaattcctttctgtatttgtttattgtacaagatcaaatattgtatcgaaagccgaggctttattcagcttgttctccccagtgaccagctataatgtgctttttttattttaaaacattgtattttaagcacttgtgactataactccctcttctctaaaattagaaaaagaaaaagtaaaatatctatttttcatgcaggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagaggttagaaccaaatatttttaatgacttaaaaatatttgcaattttctataatatagttgctatttaaggaaaaatcaagttctttttatcctataatatcttatttctaaaaatatgttcattatagaaaatgtggaaaataccatgaattagtaggaagggaatttatcacgccagttcccactaccagaataatttactgttaacactctactgtattttcttcaagtattttttctatgcatacattattcctttttaaattaaaagtatgaataataatatagcaatacactcatgtactgacccttccagtgaacagtttgtcatatttgtttcctatatttaaataaatgaaacatagcatagttctctcccca

SEQ ID NO: 75167 - DNA, 1017 bp, Homo sapiens
aaaacctagtaatagaattgatagggcatagaatagatgtatatttaactttttaagtaactgctaaaacagttttccaaaatgattgtgtaacttttacactcctaccagctatgtgtgagagttatccttgtttcacattcttgctaacatttggtggtgtcattcttaaattttttttcctttgatttaatcctgaaccagaagtaaatatttaaaattaaaattaatttcactttagtgaattggaacttctaagaaatatacgtaaatagagattgcataatcaaaggagaggtagtgttctaaatagatcataatgttttattccagcagttcatagaattaaactgaatttttgtgttccattcttagaagtttgtttcagccccttattttttcctatacatttttagcagcttgttttgtacttggaagttttatcttccaacagttcctttgttgtaattacctaggtagaataataggtatattagcaaaatgaatttggaatgacagcatggtctggtgtttacataatgttataagacacaaaatatatttttagcttttagagctaaagtccttttatgatcttccatgaagatgaaaatttatgttctataatcctacagttgcaaggttgtgtaaataatttgaaacctacttaagaagaaaatttcattttatatgatttggatacatgatgtcctgtattttctcactgagttattctcttcagatactgaattctgttagaaggtagttcagcacaccctcatttatggactgaaatgcctttaatgaatttaagatttccacatttaagattagtggctttagaacaattattcttatccagcttgcatactgccttaagattcatggccaaagaaagccactactactacctgatttaaagattttgtccttaggtgggttggggaggaaaaattgttgaaaaccaccctcctagagactgaaatttcttctttcatccaagtcaactacacttaa

SEQ ID NO: 75168 - DNA, 1034 bp, Homo sapiens
gtgatcctcccacctcggcctctgtagtagctgggactacaggtgtgcaccgccatgcctggttaattttttagtttttttgtagagatggagttttgcgatggtgcccaggctggccttgaacttcctgggctcaagtgatcctcctgtcttggcctcccaaaatgctaggattacaggcatgagtcaccacacttggccttgatttggttttagaatggattcttggatcatttttttttttccttagggattatacagtataagtcagagtcattttctgtggcaatcctgtcttgagtaattaagaattggccatatgttaaaaaggttggtagtccaaaaggtgaactaagaatagcaaaatatatatgtgtgtgtgtgtgtgtgtgtgtgtgtatacacacacactgttagccatagtttttcaagtgtcatacttattgctcccttattatctaaaaggtctgtgagttaataaggagaatagacaatatgtgatgtgagtattgaacagcactaaatcttaatgtttattgaaattactttgtttcattgcaggtcagacatatttccaacatttgggtcaaaaccttgtccaacaagactttcttctgcaaagaaaaaaatttctcatattgctgaacaaagccccagtgcaggtattctatgtctgtttataaaaataatttataaaatatgattttcaaatgatgtaaaaaatgatagcaagtgcatttcagatttcatgttgttgtgcatactggttaagactaatcatttttttactccttaaaaggtccttttgacaggaatatgatattgttttggaagaaaaaaatatttatttacctgaatcatcaatctcttttaaagctcaattggcatacctatggctggctcctacacctagattttttatgtagttggtgtggagtgttatttagctggtgttggctgtcagaattttgaaaactcctcagatgattctaatgtgcagcatagtttgggaaccactggacatcccgaaagac

SEQ ID NO: 75169 - DNA, 1050 bp, Homo sapiens
actaaaatggaatggaagatcatgtggattaataactcccagatgcccagttaggttgtagccctggagtaaagttggggcaacaggaatataattttcctgtggtagaacctgagaaagctttgctgttatcattaaccattcttggccaggcgtggtggctcacgcctgtaatcccagcactttgggaggctgaggtgggtggatcacctgaggtcaggagttcgagaccagcctgcccaacatggcgaaaccccatctctactaaaaatacaaaaacttagctgagcgtggtggcaggcacctgtaatcccagctgctcaggaggctgaggcaggagaactgcttgaacccgggaggcggaggttgcagtgagccgagatggcgccactgcactcctgggtgacaagtgaaactctgtctcaaacaaaaaaggaaaaaaagaaccattgttaagaatggtttttttaaacttagtagcaagtagtacctctgtgactactctgtccattgcttaagagatcctattacagctgcattttaaaaatttcccttacaataaaaaaaagtggttttgaagggtataaatatttaaataaatgttaggttggtgcaaaagtaattgtggcttttgccatttttaactgcatactccttttgcaccaacctaataattagaagatgcacctataatctaaaatatgtaagtaaataaaaagctgttattttcatgtgaatagcagctgtggtcattataaggtcaacttctgtactatgttatttctgatttttttttttcttttttgaaacagtctcgtctgttgctcaggctagagagcagtggtgcagtcttggctcactgcaacctccacctcatgggttcaagtgattctcgtgcctcagccaccctagtaactgggattacaggtgcatgccaccacgcctgggtaatttattttgtatttttcagtagagacagggtttcaccatgttggctagactagtctcgaactcctggcctcaagtgatctacctgccttggcatcccaa

SEQ ID NO: 75170 - DNA, 2001 bp, Homo sapiens
ctaccaaaaaaaaaaaaaatacaaaaaattgggcaggcctggtgctgtgcgtctgtagtcctagctacgcaggaggctgaggtgggaaaattgcttcagcttgggaggtggaggttgcaatgagccgagattgtgccattgcactccagcctgggtgacagagagagactatctcaaaacaaacaaacaaacaaacaaacaaaaaacagctcacagcaaccttttctttatgtgtgcttaccacttataatatgcagctctcacttattatcatgaactgcattctgccacctcttatattaatgccctattagggtatttgtttttatattttataattatttagcatgtttttcttactaactgtgttgtttgattcttgaaggcaagagccttgccttaaactttgttgtctagagtaccatcacataattagttaatgactatttggtggttggttgatttcaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgtaaggttatttgctaattattagaataaatttaagcttacagtatgtcattgttttgtgtatatcagatgtggggtggtgaaagtatttcaattaaaatttaaaaaatcttagtacagttgaaattttgagccttggcaatgtggcaaagccctgtctctaggaaaaatacaaaaattagccaggaaaaatacaaaaattagcccgagaaagtagagagcctattttctctaggaaaaatacaaaaatgtagctacagccatgcgtgcctatgggcccagctacttgggaggctgaggtaggaggatcacttgagctcggacggtcggacttgagctgcagtaaaccgtgattacgccactgtactccagcctgggcaatacagtgaaactgtctcaagaaaaaaaaaaaaaagaaattttgattcttaatcatttaaatatagattattcgtccttcccacttaataaaggcattcttatcctggggataaagtatgtaatatactttgtattctccatgtactttatattttacatgtactatatatacatatatatgtatgggtatattctgttttctaggacacacttaagtagtgacagactaatatcctcagacacaaattagttatctgagatgaagatattttaaatatcaaagtccctgaatattttcagactttcaactttttcatgcaggctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtaagtggaatttaagttttggtattttttttttctagtaattgtctaaagctggtgaaatgaggtttcactgagggtaatatatgactaagaatgaaatatcttatataacaccgaaatttgcaagttctgcctttaattagctttgtgacctggaagcagccctcagttttctgcccctgtgaatatcttgattatctcaaaggtccagattatctcaaggatctcttctatactcctggaaatattcctgttttactgaggagtggtatcccattttatagtagataactgagatggtgattctggtttatattacatcatgatccaaaaaggccattgcatttgtcatttattcagtctatccttgagtacctactatgttttgtgcttggtcaagagtaggctctatgtttcctggtgttgttttttaaaatattgaatacatgttaggtatagtagcaactaggaaaaatcagaggttgaaatgaaaaatcatgtg

SEQ ID NO: 75171 - DNA, 1102 bp, Homo sapiens
aataaatgataatagtgcttttttttatttgctattctttcaggattgggatattccaaagctggaggattttatttatacatgttagtcttagatatgaagcctaatgagggtccatctgaaccatcaaaaaaaagtgaaaggggtctattatattctttaattggtatatcatcttcctcacataacaaaaactggtactgatttatcactatagtaatttaaggcatcatattttacctttttacattttttgttagatatatgatgaattttttgaaagcagagattctgtcttatacctctttatataagatcacaggtaatggtggccgtagatctaagtcctgcctctcccactcattagcaatggaaccttaagtaaatttcttagtctctgtaaaatgcaattattttctcagctgcaaaataaagatagttagaatacctacctcagctttgttgagataattaaatgcagtaaagtttgcaaagcatttatcccaaggtctggtgtatagtatttaataaatgctagctaatatcattaacaccttgttgcctttggattttaaatgaccaactctgaatatgtaattagtatgcaacatcaagtgaaatctcttatatttgtgatttcaggtaacattttctcacagataacatggttaataaacaatttttgatgatagtttctagtgactaatatttcctttctaaaaatatctcttaatatggaaaaatagccagtaaatctttacctacttataaaagcccattctatttgacccttttctttttaatatctccactgcacgtgtctcgcattatatagtgctctcaaggatattatcctgagcactcaaagaggatgatttgttttctcagcttatagtacagtgccttacatctggaaaatgcttggtcaatgtcttattatagaggaaacatcattcttattactacacatggtcttagaatttgtaataggccactaattctatatcgatagagaaaatcaactagaattctacatacagatgccatgaaccttcatcttcacttctcagttataaaacaggtatatatccacatttttaca

SEQ ID NO: 75172 - DNA, 1073 bp, Homo sapiens
aaactaatagtactaagtttccataataaatattcatcacaactgtagtcagaataatgtttgtaccctttgtatgaaggactcttggccaggcatggtggctcatgcctgtaatcccatcactttgggaggctgaggcggatggattgcttgaggtcagaagttcaagaccagcttgaccaacatgatgaaaccctgtctctactaaaaatacaaaaattagctgggcattgtggtgcgcacctgtagtcccagctacttgcgaggttgaggcaggagaattgcttgaagcagggaagtggaggttgcagtgagctaagatcgtactactgcaccctagcctgggcaacacagcgagactccatctcaaaaagataaaaattttttttaaaaaggttctctcatagtttatttaatgtattttgttttaggtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattggtaagttcaccatccttaacttaaaactaagcagagttcaaaagctttctgtaaatatttaattaaaaatcttgaaacacattttctattaaaataatcttagaaatgattatttagttcttaggcatcagagtcttttcagctcattaatgtagctgaactctggccctaatagtactttattaccagttgtattatagcttacatgccataaacatataatttagctttataatggattatgtaaaccctttgataatgagatacaaatttcaccatttctcaaagtatttctctgtgaaatataattattaatagtcctggaaatacttacctgctcctattgtagtgatagcagccaaccaaccagcccagccagtaactcaagggagacaaaagacagtggcaatgtgcatcccacgtgtttcagcgggagcatccacttactgcctttgtcccatttcctcccttgttccttcactatctct

SEQ ID NO: 75173 - DNA, 1166 bp, Homo sapiens
ctgctatccctaaaaaaggctgcttgcaaggttagctcttcgctgacatgggaaactaggatttcaagaggattcccactatgccctaactgataagatagtttactgcgcctaaattgtttgggcaaacaatatggtttatgctggaggcctggtttccttctgggagtctggaattttggtatgtcctaggcagacagtccctacattaccagctcccagtgaaaactctagacatgaggcctctaataagcttacttagtagacaacatttcacatatgttgtcataactcattgctgaaggaattgtgttctgtgcgactctactgggaaaggactcttaaaagcttagatctggtttcctctggtctttgacttgtgcacctgttccctcagctgattttgtttggtatccttctgctgtaataaattttagccatgagtaaaagtataggctaactcttacgagtcttcctagcaaatatccaaatccaggggagatcctggggacccccaggagagatactgtggctatgggttagccacagttttttgcattttatgcattttggaaaatgaatgcataatgagatttttaaattatgtttgtataatagtttttataggaaagtacaaatgaaattaccttcacctttctttcactttagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaaggtaaggacttgtcagaattaattttaatgtgggtatggtggctcacgcctgtaatccaagcactttgggaagccaaggtagaaggatctcttgaggctaggagttcaaagttcaagcccaacctgggcaacatagcaagaccctgtctctacaaaaaagaaaataaaaatttattttcatttgaaatctatgtcaaatgaagtttatcagtttaaaacattgccctaaatcttagtgttttatataccttctctctatatctatatacaaattacacaaatttaaaatggaatgtaactaataaatt

SEQ ID NO: 75174 - DNA, 1034 bp, Homo sapiens
ttatatcttgagtttatgaaagttaaggattctgaagagcaaggaattattgttaaaagttttcaggttaagagataataatacaaatttaactctgaaattgcatctaaaattttcataataaacctaaactgaaactaggttaaatctccacagtaaaacttacaagtctacttctagtgtgaaaagagataaaaacagaaacttttctaagttcttagagttagctaagctaacctccatcttccagaaaacaagatgtttatcatatttacagtcagtcagtcagtcatctgcctactgagccacatttttcagcctttattaggatgtcttttggggtgatttttgaggccttctctttttgttacaagaagatttgacacttagatttagtacccaaatttttataaagttcctgttatccaagttcaggcaaaataggatgttgtgtatatatttaaactgagtaaagtaggagaaatattatgacatgccaagatacttataaatacaatagctataaaaatcattttactttaaataatttaccaatttattttcagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtaggtaagaaatcttacttcggcactcaaattattttcactttcttttcatgttttctgattccatccatactttttttgtaatgctgaaatcctagttattcagttttttaaacttaatattatcataaaactttctattctcaatggttttaaaattatttttagtgattaaattctgtcccattaaattgactttcttttcccttatctgtgacttttatttctttttctgcctcaacctcacatctg

SEQ ID NO: 75175 - DNA, 2779 bp, Homo sapiens
gcaatatcggctaattgcaacctccgcctcctgggttcaagtgattcctgcctcagcctcctgagtagctgggactacaggtgcctgctaccacgcctggctagtttttttatttttagtagagatggggcttcaccatgttggccaggctggtcttgaacttctgacctcaagtgatccacccacctcggcctctcaaagtgctagaatttcaggcgtgagccactgcacccagcccagtctctggaacttctaagcaaacataattagataggttagcaatgcaaaggagtatctagtagaaagaaggaaagcaaaatttattatttcattagtaaaacgtgaatacaaagggccataaaaggagaagaaaaaaagcccttaaaaatagggtacttggttacattagtagaaataatacgggaaaagtaaaaagacattaaaatcaaattttggttcttacagaaaactgctatttcaaagtcatgtttgataaaaggtccatgggttaaaactgtgtacatttttgtttcactacatttggaaaacatcgagatgaatttgggttcattttctctccttaccacttttgcatgaactaattgttctatatgggattctaataccatatttgaagatcccaatctttgagagaaaggtttcttacattgcttcttttaagaagcctaactttttaggacaaattacataaggaagaagcttagtatattttagttgctttttatttagcagagcttgggcttatttattaagaaaaaaccctgttttttatatttttatgtttcagatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttctttagatgtgtgagaggtgtcctgtttttccaacttccatacatgttaaaatggaaaaaaaaatatatatatatatacagtagtatcgacctatcactttcacttgatctacttattatgatactgacctatcactattgacctacaaatagacgtgggttatcattctaactttgtaggaaattagctgtctgacctcggacaagtcacttaccaggtctgggcctcagtttcctcatgtctaaaatgtaagagctagactagaagattttaaaggtcctatcctgttctaaaattctataattctatgttcattcttttgtacttctgagtcactgaccagttttctaatgtatttggctgtttttaaaattgtgatttaaaaaaatttatcctggccgggcgtggtggctcaagcctgtaatcccagcactttgggaggctgaggtgggcagatcacgaggtcaggagtttgagaccagcctggccaatatggtgaaaccctgtctctactaaaaacacaaaaatagccaggtgtggtggcgggcacctgtaatcccagctactcgggaggctgaggcaggagaattgcttgaacctgggaggcgaggtcgtattgagccagagatcgtaccattgcactccaacctgggcgacagagtgagactctgtctcaaaaaaaaaaaaagccaggcgtggtggctcgcgcctgtaatcccagcactttgggaggccaaggtgggtggatcatctgagttcgggagttcaagaccagcctgaccaacatggtgaaaccccatctctactaaaaatagaaaaattagccgggcatggtggcg

SEQ ID NO: 75176 - DNA, 2353 bp, Homo sapiens
aatcacatctttaagttaattaatacttgaagttaataaataatactgctcagtgtattagtaatgatgccataataccatgtgaatttatgctgattcaaatgttgtttttttcgtttgatactcatatggccttctgtttgaggacttcagattatttagcaactgatttaatctgttcagaaataaactttgctacagctggaaagcgtgaggcttgagaaagcaagttttggacagggacgtatgaagctcatgttgaaacttaagtgttttaggctgtatgggagcttgaatggagtgaaaagaacaagcgtctactgtcaggttttcctcctccctctagatttataacctcattctagagttgcaaaagttggaactttccactgttcactctctagtagggataaagtgatggaaaggagttctgttaaagaggactagtacttagattgtgaactttgaagtaggggttgagcatagatggctcataggtggtatgagacactatttgtgtaaagtctcagaatatttttccttgcttataattgaataagaaagaagatgtttaaaagtcaaatgataaaaattgtatgtgctgttttctgtggtatgttttaacaaatctacatggaagataggacttcaaaaaaaattaaaaatagccgaaggaggaagaaggtagtgtagttccagccaaatggtacgttttccaaaaagccgaagattgatgtagacgtttatgtaaatacatatacaaaatctagtttctggaacacagtgtttaatatgtagagactttaaaaagtcggcgtgtgactacttagcccttaaaaacagctgccaaaaccagtggttatgatagtctcttttcttcttacatcccaaatctccagattgccttgtggatgagatttgcttattgcaaagctacttgttttgctctacccaaaactcctttcagtctttagtgatgacttcagatttttatatattgctgtgtttatgaaaaagaatagtcaatggtataatttttaagtacctctacaggaataagaggcatacagaaaaaaaaaaaaaggtattaggtcaaaagatggcatttcactctcgttgcccaggctggagtgcaatggcgctattggctcaccgcaacctccgcctcccgggttcaagtcattcttctgcctcagcctccccagtagctgggattacagatgcgcgccaccacgcctaattttttgtatttttagtagaaacggggtttcaccatgttagccaggctggtctagaactcctgacttcaggtgatctgcctgcctcggcctcccaaagtgctgagatgacaggcatgagccaccgtgcccggcccaaatgtcccatttttaattaagtgttagtaattgaagtcatcctccaaaagaccttttaaattttaagatggcataattgtcactgaaatacttaatgtacgtcataattatactaaaagtgaaaggtatgataaatgtattttttatatattgcctattcactttatgttatgtttcattttatacttgtgtcctttgtgcctatcatatgattttataataaagtgtaatgtagtgaaaaggaatcgactggtttggtgagttgaaaaagggaggacttttattagtctgggggaacagcttttgtcaaggctcagaaaggaaaaatctaagggactctggaaatggcaatgaggaggagtattgtaagattaatacttttggaaagttaagttgagactggatatatcattcagagatatttgttgtgctgttacacggcaagtattatttcaggttcaagggggacagcggtgaacaaaactgataaggcctcattctcacccaatttaatttttttttccttttactcttgttgagctgtgatcaggaaatttaatattcgagtaatattagtttgcagtagtgcagcagtgtttctcagtttttttttttttttttttttttactgcagcccacaataagatgtacatggacatcactaactcaataaacagttcaattgtgtgtgcttcaacagtgtgcccttaatgtgtgcattcactgtggtatatctgtttttctacatttaaaaaatgagaaactggtttgaagcaatctgcatttgaaaacattgatccagaggggagaaaataaatacttaaattataacactagtagtgtgaatggaaagaaggggatagttaattttttaaggtgtattatttcgctctgtcgcccaggttgaagtgcactgacatggtcagcccactgcaacctccacctcctggggcttgggtgatcctcctgcctcagct

SEQ ID NO: 75177 - DNA, 2594 bp, Homo sapiens
gaacagttgttaaagatatgccgttttccagtgattgatagcaaggtaacattcaggcaccgaatcagattcttacctaaataagaaacattgaattttaaatagtatttcttcattgggtagcaggcagtgtacttatttgttgtttgaatgaggtaacaaatccacagttatttggttttcattcaaataccaacaacaaaatggcagttttgtgaagaatttataattttatttacaatataaaaactaatgaaccttctgattctgacttgtaggggattaagactcacattaatatttctttaatagctaaattagggctttttaaaaggtgttgttgaggccaaataattttattggcatttggaagatatttctctttttttcgtgtttccacagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggaggttagtaactattaaaatggtatcagaagggacaaattaatcaagtcattaatttataatgaaacagtagaccttattgtttatgattaaaattgactcataattttcaaatgaagttgaataacattaggtagctacatttttagctttgaaaatagcttacagcttttgtatgttgtagagagtcagtagtgtcaaagcttaatgttttgtaataattgaggtgtaaatgtgtgtgtaaaattgctgaaataaaaagttggcaaaattagttccttctgtttcaattgcgtttagaagaaaaagggggctgctgcctgtgtaggttttttttttttttttttttaagtgaaagcaagtttattaagaaagtaaaggaataaaagaagggctgctccatcggcagagcagcctgcatgtggagtttttaagcctgccatttattattatttttttagataataacgtttgaaaggaataataaatatttttttgacagaaatttccacaatatttaaatactgttttatttttatcagaatcacttgatggctgccaggaaggcatttgacagatttttcatacactatccgtattgctatggttactggaaaaagtatgcagaccttgaaaagcggcacgacaacattaaaccatcagatgaggtgcgtacatcactgaataaacttatctccaataggtactgtaagccaattaataacaaaacaaagatttttttttttttttttttttggctggcagtacctaccatttatggtcaaacaatttttatagggtatttatttgcatttgtcactcttgtggcatttgtagctaatattttctctctttgttggcaggtgcgttaaacctctacagtttgtcaagctttgcagtgcaagcctctgtattacactgcagcttaacaagtagggcagggcttttctctcacttacatttatttctcattttccaaacaatatagttggtttgctagtcacatttgctacgtcttattgcatttttggtcagacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtaatggtagattatttaaacaaaattccagtaattagtatttctaaggttcaccggataacacagtgttgcctctctgttaagaaataattaaatatttgaagtacagtttgctgttttcttcttaggtttatcggcgggggcttcaggcaatacctcttagtgttgacctttggatacattatataaacttcttaaaagaaacattggaccctggtgatcctgagacaaacaatacaataagagggtatgtggaacattgatactgaaatgttttttatgatataaataattattctgatgttgataatagagctcatgaaagctaagctggaagtttaacttctattccattgttaaaaaaatgatacatgtaataaacttaagctttatgatttgaaaatgcagataataaagccctcctacagtccatgcctcttatgtccccaattccactcctcaaggttaatagcttggtgtgtgttctttcagatatatgtataagtacatgtttatgcgtatgctttcatactgctctttgactttttttttttaataatgtttgggaatctcttcctgccatattttttaacaattacaaaaagtattttataatactttataaaaagtatcttataagccaaagtactctat

SEQ ID NO: 75178 - DNA, 1117 bp, Homo sapiens
tacctgtaatcccagcactttgggaggctgaagtgggaggagcgcttgagcctgggaggttgaggctgcagtgagctgtgattgcaccactgcactctagcctgagtgacagagtgagaccttgtctcaaaaacaaaaaacattagctgggcatggtggcgcatgcctgtagttctagctactcgggaggctgaggcaagagaatcgcttgaacctgggaggtggaggttgcagtgagccaagatcgatcgtgccactgcactccagcctggatgacagagcaagaccctgtctcaaaaaaaaaaaaaaaagagagagagatcaaaaacctataaatatttttcatcatactgtcttttcattttataacctttttggtttttaattgctcctcccctgcccctcatttttcccgtttgtctaattttctttgaacatttaaggttttttcatactctccagcagctttgtagaaggctttaaatatagctttctatacaatcagatctgttaaaaaatgtgtaagtcccattttttcctctcctttgagctgtctcctggaaaccttcctactataatctggactggtcttctagttctgctgtacaagagttgtcttgggattttcttatcatcatggttctaggagatgtctttacctcacttctgggtgagtttattattagatctcactcttttcttgatttcatgtccaacttttagaagagtgtgtcctataacttcttgttaaaggatgcttggatgaaaaaataattttaaggtttggtaagctgtagaatttggagttgaaaattattttctccatagagctttgaaggcattatttattcctttatagcttctgctattgcttttgagaagtccaataccattcttgcagaatagattctctttctataatgtgtttttcctctgtggaagctgttaggatgttctctttgggtctgatgtaaatgaagttttataaaaatgagctttgatgtggattttctttttcttattgtgattattgggtgattgggtgagtcttttcattctgagattctaatgtccttctattcttagaaatgttattattatggatattcttattttg

SEQ ID NO: 75179 - DNA, 1039 bp, Homo sapiens
tctgttcccaggacggtttcctctcaaatttttctgtttacccattttcatctctgagatatgtgatctctggatttttgttcctattacagattagatattaacaagctatatgagccaggcacagtggatcacttgaggtcaggagttcgagaccagtctggccaacatggtgaaaccctgtctctacttaaaatacaaaaaaattagctgggcatgctggcaggagtctgtaatcccagcttctcaggaggctgaggtaggagaattgcttgaacctggaaggcagaagttgcagttagctgagatcgtgacattgcactccagcctgggtgacagagcgagaccctgtctcaaaaacaaacaaacaaacaaacaaacaaacaaaacaaaacacaagcatatggaagcactgtgtgttttgtatggggcattgtcagttggcctatggtgtttcacagtagtgtaatcatgtggccactctttttgctggtggattcccagtgatagtaaccttatatcttattcctgagccaagcagtttgtttagaaaaggataattttatttacttggggaatggacacctagcttctgaaatccccatagctgggcgggaaagttgaagatttctcacgattcattaagtataccttcttctaaacgttctgtcttcatttcattaccttcttgtcttcttccccttttctccatacttttttcagtgtctggttaattttctgaatcatttggggttctgtagggacagtaacatctattttattcttttgaaaaccttacaccaaatatgcacatgcatgcatgcacagacacacatgctcttcaatcttttatttctatattaaacatatttcctccaatgttggtatgtttttaactttgtttatggtgtcttttatcatatggagttttatttttccttaatgtgcttctgttttaattcttactggttcctgagttttgtgcctattttaccaaaaatatataaatcctgtattttgttctaacttttctatagtt

SEQ ID NO: 75180 - DNA, 1986 bp, Homo sapiens
atcttggctcattgcaacctccgcctgccgggttcaagcaattctcctgcctcagcctcccaagtagctgggactacaggcatgtgccaccatgcctggctaattttttgtatttttgtagagatggggtttcaccatgttggccatgttgatcttgaactcctgacctaaggtgatcctcccgcctcagcctccctaagtgctgcgattacaggcatgagcctgtaatcacgcctgtaaccatttcaccatgcctcatgaaaatattcttaaattgagataaaatttgcctctctttaacttcctacttgttttaattttgtcttctgtcataaatcaatctatacaatagacatttcagatttaacaaatacttacatgtctactcttacctatttgcaatgtgtacattttgtatttaattttctatttgataaagttacataaaaagtacatttatctattctctttgttttctcactctttttaagcagctgttgtatgctttctgttattctgtctaccctttaatccctacttgcataggaagcagttgaatataatttttgaagttagcattatcttctaaatttagaaataatattttaaaagtgattttatcttggaaagataacttaagagtaatttaatttttcagaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagaggtaggtgggaaattctgatcattgaaacatctttgattactcagatagttggtaatattaagtattataattatcttggaatgttatgtaagcttttattatgtggaaagaggaataaattttgttgctaatcacaacctacatgcttgcttttgacattttttcatatgccttatgaaatgtttagaaattttactgtttttagatagaagtttctccttattcattttaatggataaagagaaacaggaattctgtcttgtctaaggtagttcagagtaatgaaggaatgagaaaatagtacctaagttgagttatttatttatggcattaaattgacacagtgcctggcacatgatagatgcttattttttttgaaacttaatgatttgctaaatatacattattgtgattgctataacaccttatatccaaaacagtgaaggatgcattttatatagtaagtagtatctattttcaaacactcaggtatcattccattttaattttctaaaatgatttttctgttacaattggtatccttttattttaatgattactgttaaaacaactaattctgtgtcattatttttgtgttctgttttctgctttattcagagtatcccataaataaggatccagaaagtctttctgaacgagtatgaggactgtgtctttgcttttaaattggcatgttttctattttttgttataatttttatgagtagtattgtataaacttagtattttctattttttgttataatttttatgagtagtattgtataaacttaggtactttttaagtgagtgattttctaaattttttttttagtaccaaaagtagaagacttttatgaagcatttgtaaagtactaaggatcaatgtgctaaaggtagaagttatacagactcaggttagaaataggaagcatatagataggaatattctctctgctcttgatgaaatagaggaagcaggcaggtttctaaggtataacgacctaggaagacacttgctgaaagatgttaacacaagtaagaattggcatatggaaatgcttggtaaatagttaccaaacacataagtacaaaagtacttaaattacctgatgggccaaagagggtgtcttttcatagactagttcttctgtgattta

SEQ ID NO: 75181 - DNA, 2577 bp, Homo sapiens
ttaaatctgttttttcatactacatatttgagagttacttccttatttttaattttttaacataaggcaatctttgttaatttttttccacctggtgctgaaatgggccgttagcctctgtatccattgactttgcaaaatttaaattagattccaatgttatttatatactttttttttttttttttttgaggtgaaatctcgctctgttgcccaggctggattgcagtggtgcagtcttggctcactgcagcctccacctcccaggttcaagtgattctcctgcctcagcctcccgagtagctgggattacaggtgcccgccccgacacggagctaatttttgtatttttggtacagatgggtttcagcgtgtttgccaggctggtctcaaactcctgacctcaggtgatccgcccacctcagcctcccaaagtgctgggattacaggcgtcagcaggcgcctgacctgtttgcttactttttagtaacatttctgatagtagtatagaggtgggaatgggagttgtgagactagaggctgcaaggtcattttatgtttatccagcttaaaagtcccgaggtgatgaacatgtatttaaaaggtacagtcagtaggacctggtatctaatgtaaatgaaaagctaggtggaagagattgagagatgtagtggttgacagtaccattaatcaatattagaaatgctgagggtggcggggcacggtggctcacacctgtaatcccagcactttgggaggctgaggcgggtggatcacctgaggtcaggagttcgagaccaggctgccaacaaggtgaaaccccgtctctactaaaattagaaaaattagctgggcgtggtggtgcgcacctgtaatcccagctacttgggaggctgaggcaggagaattgcttgaacccgggaggtggagcttgcagtgagccaagatagaacgattgcactctagcctgggcaacagagcaggactccatctcacacaagaaaataaagaaagaaatactgagggtattcattttcagatgaagatgccatacttattttaaaatatttcatatttgaggttccaaaggtatattcaaattgtgatagtgtagatattttagctcctcaacctggtatttttgattacaatttgtatgtatacaaattattgcatgtttttataaaatagtgaaatgatatttttttcaaaaatctttttatagattagcttaaaactaatccacatttctttgtgcagagtattggcagttgtatatgctaatgtgattaggagaaaggtttggacttgtgttgtagttttgagagtcatcatggtatacttatttcaagctgtatgaatgagattggccagaagtatgtattaataaaaatagatgagaaccaaatggagagtggaatacttgggtatagtagcatttagggcaggtaagaaggggaataagacatagagcagcagtcagaggcttggaggaccatactacaaaacaagtgtccatttaattttatatatgaggtaattgataatcttaattgggcagtttcattggatttttgcgtactcacatgtggatgaggagtatttgggaggtgggaaggaaatgctatatttgttggttatttacaagtgatcatttagaatttaaatatggattacagtatttaattttactgtaacttttatgtctttgtagtaaaatagattctatgacacacgaataggtattatcatcttattttacaattgaggaaactaagatttagagaaaagaaaaccttccctagtcagataaccagtaacagacagaactgaggtttgaatttatgcccgtccatgccttctccattccactgtaaaggtaggaagaaattgaagatgtctatagactgttttatcatatggtagtgttttatcatatatggtaggattttactatagaaaagaaggagaaaaggtatgatattttggtttcttttttaaatcaaatcctttgaaagagtagtatatagtaggaatctcaatatgagatctaaaattatgattcaaatacatatatttttattgtcttcctttagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaaggtaaccagtcttattctaaagttcgtcagtggccaggtatggtggcttatgcctgtaatcgcagcactttgggaggccaaggtaggcgggtcacctgaggtccggagtttgagacccatgtaggcaacatggtgaaaccctgtctatactaaacatacaaaaattagccaggtgtggtggcacatgactgtagtcccatctacttgggaggctgaggtgggaagattgcttgaacctggaaggcggaggttgcagtgagctaagatggcaccactgcactccagcctgggccaaagagcaagactccatctcggg

SEQ ID NO: 75182 - DNA, 2391 bp, Homo sapiens
tatatacattgtagtcatcacagcaatcaagatacagaactcttttagcactccaaaggtccccttggcccctttccagccagagttcccctctccactcctagcactaggcagccattgatctgctttctgtcactatggttgttcaattttaaaatattcaacaaagtataaaatgttctgtacattaaaaagcatgtaattggcaaaatggcagaatagagagaaaatgtattatttcatttgtttgtaaagcttaaggaatttaagggttaattttaaaagttttttaaattatgaaatatgattaaaaattttaatcatcaattatatttaaaattatttgtattaacactgtacatgtgcatattttggtgatattggtttactttcattggcatgttacaatttcatttcagattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaaggtaagaaaatcatgtgctcttaaacttgaatatattataaacattgatctagtgactaaccttttttgtacttctgttgaatgttgttcatataactatatctgttgcattaggagatggtctgcttgcaaccagatttgactgctgcatatgccaacctcgttgcctctcttcgtccttccttacagaaactagtctagtggttcaataaaggtgctgaatgggtttaaaaatagaattttatcgttctgtcacaaatttaatggcttgttcaactgtaaattattcagtatttcctcttttctgtatgtagtatgccaagtacatggaaaaccatagcattgaaggagtgaggcatgtcttcagcagagcttgtactatacatctcccaaagaaacccatggtgcatatgctttgggcagcttttgaggaacagcagggtaagagtggagaaattcagttgacatttttgagattttaagttatttcaggaaacagtgacaaattgagtggtaagggatggtgtaaagcagagtttggcaaactttttctctaaagggccagatagtaaaagccacgtgttctgactttcaggctttgtaagccattgtagccccgaaacagccataggcagtgtgtaaatatgcatggctgtttcccattattagttgctggatttagcccatgggtgattgttgccagtatctggttataaacgttattttggttgtttaaaccaaagcataaacatttaattactgtttctaggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagtatgcatttgtatttttaagagtatcttctattaaaaaaaccagtggtcagtgtattttcactgtggcaactgtgatgaaagatttggtctgtatgtaatagattttattactaaatgaggacaacagtccctctaaactgatgttgccatttaaaaatttttttcaaattgttttgaattaaaagttttagacattaagattattgggttaaaattgttgtagacattgtgatactttatattttccctttagaaattatcaacaaatttactgattactaagtagaacagaggacttgggagaatacttcataaacaaaagcataggcgttgcctatgttgtaagcacatttagaagtgagatgattttgcttctccatagagtactttttatattttttatatatcaattgaaaaaggcagtgtataggtaataggtaatttctcaagttttaggattttagttattgccaggtctgtttaagatacagatttatagcagtttgcttctagctgcagtttaagatgtttatctttttttttttgagtctgtcgcctaagctggagtgcagtggtgccatcttggctcacttcaacctctgcctcctgggttcaagtgattctccagcctcagcctcccgagtagctgggattacaggcatgcatcaccgcgtccggctgatttttgtatttttagtagacacagtttactatgttggtcaggctgatcttgaattcctgacctcagatgatttgcctgcctcggcc

SEQ ID NO: 75183 - DNA, 1050 bp, Homo sapiens
ttgtatttttagtagagatggggttttaccatgttggccaggctggtctcaaactccagacctcaagtgatcctcctgccttggcctcccaaagtggtgggattataggcatgagccaccacgcccggttaagatgtttatctatagttgtagtaaagatttaaattatttgaagcatagagatttttttttatgttttgttttctaattgtcatggtaggtcatgtcatactaaatacaagataggctatagagttttaatttactgtcattgaacaatttgcattgtttaggaggtactaggatgatcaactgattgaaaaattcatcagtgtgttaatgaattttttcacccctttagatatatgctgaaaacatttagcatgagttgtattttaatacaattttcaatattttttcaaattgagacataaaaactaaggcattttaaatatctgtgctctaataaaaatattttagaaatattcattgatgctgctttttacacaggagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagtaagatattagttatattacctatttgaatgataaatgagcattgatatttttgtatggggatttgatgattagtatagattaatacattgttaaattttaaaatgttcgcttagtttactttttcctcagatatatatgggggtaaattcaattttgtaaatgtatatgtacttaacaggaaggcataaggtttgtctttccttcaaaactgttttcccaattttagaatgacaatttaaaccatgactgaatgagagaaggcaggaaggagcaatcctgtgaaaagggaaatgggataaggattgaaccctgaaacccaaatatttaatatataggtcaataaagatggatg

SEQ ID NO: 75184 - DNA, 2554 bp, Homo sapiens
attactggattctgataaactgagcagaggacacagtggcggaagcaagttgaatctcatctaaaagtaacatctgcttgattggaggtttttgtgaagtagtggaagcgtgatcttgactgtgttgtgcattgaaagctagactgaattgatagcacatgcagtaggtagctgacagtagtaagctattggaattttgaccagtgatgttaaatgacattattttaatttggtaaaaacaggcagacaaatcggagattcaacacaagtgtcatttagtccattataagtatagggaatggagtgtctgagtatcaggactatgattttagtagtagaaattttaaaaataaaggagccgcttagaaattttcttaggcagtttcctaagtaaaaacaactttaaatatttaataaagtttgttttttgtatattccagaggatatttttttctttcctttcaggcttctgaatgcttatgatgaacatcaaacactcctgaaagaacaggattctttaaaaaggaaagcagaaaatgggtatgtcactttttgctaagtcaagaaggcgtgcttcattatggaaatgccttcaaagacaaatgtttttaagtgttacttttatgttgtaatttacatactttattttcatgatttgaaaaagtcttgagtgattcagaacttcagtaaaacaaatatacagataacattcatctattcgttaaagttcttacctgtgggagttttgaaagtttccattctgacgttttatatagatcagaagaaccagaggaaaagaaagcacatacagaagatacaacttcatcatctacacagatgattgatggtgatttacaggcaaaccaagctgtatataattatagtgcgtggtatcaagtgagtctgcataattataattctttgttcatagatgttattagcataaattaggatagtttctttttttttaaaaaaagtttttgttccaattgtgtaatacattctttggtggttaagtactagaattttagcagtgaacacttgcttgttttcttaaacatagctgctttaattatacttttacatatggaactctgccacagttctaatatgctaacatacttactttttcctttcagtacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagtaattgtttatgaatttattttggggggatcaattagtaatattaaccttatgttcacctttattagtggctcattggttttgaagtacaccttttctaaattcaggtcttgatcttcctgccaagatttttctgcttttagcattttgtttcccctcaagccttatgcttttgccttctcattatacaggcaatctgtccagataattttactgggagttactccctggtttgatgaggtccttagttccaattccctaatcagaacaataatatattaacaccaaacaaatcacagtcagatcaagacagtggatcaatttttattgagccacttaagtttacaacatgaggtaaaaggaaaaagttctccttgaccagtattttacacagctgtaggaaagtattttagaccagggattcataagggatttatctctcaaaagctgggaccaagtaaacaaattttattaactccttgaattttccagttgactcttcctttacaatagtaacaagttctaactagttgtgtaaatttcttcaaggccaagttttatcattgttgctaatatccttagagctgaagcactgctatttcaatcaatatccactaattccacttcaaaagtgagttttgcatttggtggaattctgttgaagaagtcaaggt

SEQ ID NO: 75185 - DNA, 1012 bp, Homo sapiens
cacaattcacaagtataactgaaacagacaaaaccttgtcagcaaaggttaaaagtccttttttctttaaaaaaaaaaaaaaaaaaggaggtaaataaccagcccttatgtgttttcagaattttgtactacactgacatgatttgcagtcaggtttttcttcctaccccttaaggctacaaaattctgttgcaaatgcattgcaaaagaattctagaccacttaatgcaaaaatcaaaaaatagtttttcaataaaaagtaaattttataaatggtaggaaacagtatctgtggtaagctactaattgacattttccccctattactaaacaaatcatgttacacagaaacaaggaagacaggttatcaaatacaacaagcttatactgtttacatccctcattaaaaaaaataataatttcatacttttcacacactgcatttgaaatttacatttttcccatcaggttggagggggaggataatattgtccataattccaaggattctgataattgtactgaaaggaaaaagtaagtatgttagcatattagaactgtggcagagttccatatgtaaaagtataattaaagcagctatgtttaagaaaacaagcaagtgttcactgctaaaattctagtacttaaccaccaaagaatgtattacacaattggaacaaaaactttttttaaaaaaaaagaaactatcctaatttatgctaataacatctatgaacaaagaattataattatgcagactcacttgataccacgcactataattatatacagcttggtttgcctgtaaatcaccatcaatcatctgtgtagatgatgaagttgtatcttctgtatgtgctttcttttcctctggttcttctgatctatataaaacgtcagaatggaaactttcaaaactcccacaggtaagaactttaacgaatagatgaatgttatctgtatatttgttttactgaagttctgaatcactcaagactttttcaaatcatga

SEQ ID NO: 75186 - DNA, 1324 bp, Homo sapiens
ccctggtagctggaactacaggtgcgcaccactacgcctggctaatttttgtatttttagtagagacagggtttcactgtgttggccaggctggtcacaaactcctgacctcaggtgatccacctgcctcagcctcctaaagtggtgggattacaggtgtgagctaccgtacctggccttgaacttagcatcttaaaatgcacagtaaatattatgtactacctcataaaaactttaatactctctctctatatgtatatatattttttttgttccacccccccccagctagaatgacattacttttgttttggagtacttaatagtcttcattaagtggtggctaatttaggagtacttgtaaagcatccaggtaaggaggatcctagtccaagctcaatttatctagtgagcctatctagtcagcctatcctacactaaggttatgggggtaggggagaggcactttttatcaaatgtaccttgacttcttcaacagaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaattactggatgagtcttccgttttattacaaaaatgaagatcagtttgatcaaaatgaaagcttgttcacaagttttacatgaatattctaaatacaaagtctcctgaaacaacatacttttgatatgattttcatttttaaagggatgcaaacattccattttctcatttataa

SEQ ID NO: 75187 - DNA, 1095 bp, Homo sapiens
ggagtctcactctgttgcccagactggagtgcagtggctcaatcctggctcactgcaacctccaccttctgggttcaagtgattcccctgcctcagcctcccgagtagctgggattacaggcacccaccaccgcacccagctaatttttttatttttagtagaagatggggtttcactatgttagctaggctggtctcaaactcctgaccttaagtgatctgcccacctcggcctcccaaagtgctgggattataggtatgagccccaaaaggttcttttcacattaaaaaagccctgcttaaaatacccttttttttctattgaagaaatggaagacaaagatttagggactcactgaagtacattatcttagaatatagtgaaatctatagtaatagattctgtgtttgttttaacatacaatcttgtcttgactgtcctggtattgcatgtgctttttgcaaaataccattagtttttattttgttcttgcctttagtgggatgaagctctcttgactatgagtaaaggagaaaaggctcgactggagattgaaccagaatgggcttacggaaagaaaggacagcctgatgccaagtatccttttttccccttcataattaaagttgaaaaaaaaaaaacgtctagatcacctttgaggatgtgaaagatgctgtctaggcaaacttctggatcaagaatcctgtccagactagtcttcctgatctttagatgcttatgtgtcagcacctccaataggcaatagtattttctattgatataaagttcaaacctcagctagaatttttgtttctcttattcaaattcttaactttcaagaccttaactgtgaagtttaagcttaaacagcaattcttaatgtttttaagagtttaagaaaagttaccatgcccagtacaaactgtagcaaactacgatgcaaatatggctcatggtaattttatggtacagtataatttcaggcaattaaattcaaagcttagaaatggaatagatgtgggagattaccagttgtgaactgaaggagaccacagaatcaacagtgttagtgtaagcatttattattactacta

SEQ ID NO: 75188 - DNA, 2040 bp, Homo sapiens
ccaagcacacctttgttatttattttatgaaatttagaaaccaaatatagatttggataatgcagatccctctgaatttggtctgaattcagaaaccaaatagatttaggtaaggatacttttaaattcggtacacttcttcttttttttaattaactccctaagattcttgacagttcctctgtctgctttcctctcatatatgaattgctattgattagattaatatgtaaccttttttgtagaagaccctgataatcctactttgttctaggaaatatgcctgttatagcaatttctttaggtaatttcatccattgtgtgaatttattttccaaatcggggacagaggcaatatcactgtattcattctaattggttattataaaaacacctagtaatatcaattattgctgctaaaacagttcaaatctttgtgggggggaagtcaccatcccttattttaatgccttatgatttcataggaattaaatagtaatgattttttttaactttaggaaataactgaaatcatgttatggtttggtgaattattaacagaatcttattagaagaatttaggcttccaaagaagctggaagttatttgaaattaaattatagatgtgtaagttactaatagtcacatcacagccttgaaattagatactgagggttttgtttgtttatttattaccaaatccatcaaactctttaaactgactttggtcattgttggctattgtttgtcattcttttaaaggacacaaattaataactctgtgtgtgtgtgttgttttttgtttttagggtccaccaaaatatactaaatctgttctgaaaaagggagataaaaccaactttcccaaaaagggagatgttgttcactgctggtatacaggaacactacaagatgggactgtttttgatactaatattcaaacaagtaagtctaaatggaatcttatgtttttggcttaaagagattctaaatacttgggtggcagacagatgagtagttagcagtacctttttcctgactgtcacctactttcatccagacatactttcccccaagatctacttggaagaggtcttcagttcactgattattggctggctaaagacctcttgttctttggaaagcaaaagataaggaatctcagtctaaacctggttaatgtcccaaagtaaggcattagtatttgaatagaaaaggcaggatagtatgctgttttgtgatataagtataggtcctacccctctaccctttgttaagaatgtaattatttttacagccagaattttattgatggatgatctttgtaaattttttccttcttttaaaatacatagtattgtaattctgaaatcaaaccactatatttttccactggaatttaataatttccaatggaaatttcttaataataaattagagtatatcattaatgataaggaaaatctgttttacaggtgcaaagaagaagaaaaatgccaagcctttaagttttaaggtcggagtaggcaaagttatcagaggagtaagtaaagaatgccaatgaatcagtagatattctggcatatgctgcttctggtatggtgctgtaaagaattaggtttggggatataatacaaaggaaacagactttggagtctgacagattgggtataatcattgttagctgatcttgcacaagttatctcggtctcagtttcgctacatataaaatgaggacagtactgcctacctcaaggtttttagaagattaaatgagcataacttgaagtacctaatacagtaggggcttaaatattagtcccttccatgtgtacccattttattatttttcttcataaagtaagtctttgtcagaatgtttggccctctaaatttaaggttcctgtaaaatgtcttataactgttgtaccatttacatataatttgcaaaggtaaaatatctgtcccactgaagtattcacagaagcagagtttgtttctgcagccttttcacctcatacaacataggctgcaatacca

SEQ ID NO: 75189 - DNA, 2336 bp, Homo sapiens
cttagtcccctgtctagtgtcagacagctaggatttttttttttttttttttttttttgagacagagtcttgctctgtcacctaggctggaatgcagtggtgcgatctcggctcactgcaacctccacctcccaggttcacgccattctcctgcttcagcctcccgagctgggactacaggcatgcgccaccatggccagctaaattttgtatttttagtagagatggggttttgtcacgttggccaggctggtctcaaactcctgacctcaggtgatccgcctgcctcagcctcccaaaatgctgagattacaggcatgagccaccgcgcccggcccacacagctaggattttaacctagataatatgactccacagcccatatacttagcaattatatatataatgttaagcatagcaatctcaacatatgtatgttacatgcttgtgtaacagtgactcttcctagtcggctaagaatgggttacaaatgcctcaggatagctatgtccaacctggctggaggctctcaagggctgcacccaagtatcctcctgcagtgagcagctgactcaagtcaccacagtgtgcttgctgtataaatgttattttttgtgagtgttgacaggaaaaagtttaggatgaaacactgtgttcagtacataacactacagttgcagtcttgtcactaattcttgtaaataccgaatttttaaaaaatctcttactttttttgtaacaaagagtataaactataggctttatttcttcttcagtactagtactactgaaaacacaactgctaacataaaaggatcgttttctaattttagacacttcttactcgggagaagttatcttgattacccagcttttttccttatagtttcttgcagaacataaattattaggaaacattaaaaatgtggccaagacagctaacaaggaccacttggttacagcctataaccatctttttgaaactaaggtgagtattgttagattctgttagcagaacatcacttttgaaattttatttccaaaaaagatgtttaaaatgcattgatttgttgaatgtgttggagcttttccacctgtaatttttctgaactgttatcataagtggactagctgtcaaatctagcaaggctaatctgcagtatggcagaatgtttcagtattttcaaagggtctggattttgtagcttaaattgagacaacaaattcttaagtccactgaagttataaattcattaggtcagtggtattaccgtattactttagcatatggtgtatattaaatgtattttgttgttgttttattatatatgttaaatgttatattgaaaataagtttccatttcactaatgaatttaaagtctggtttagatttaggctgagctttacaaaaatacattttaagacattctcccacatttgtttactatgaaatgaatatcttccacaggaaagaaatctttatttaggagttatttgaatagtgcttatatctctgggtatgagttggcctttctaaggtcatggttctcatttcagaatttatattgtaagctggtttgagggtaatcatttattgtttaaaaataaattatgagcaaaattctttctttgctcttcgtttccttagaccatttattcacaattgtgttatacaacctatatttattatgcagatgttcatttaattgagaggctgaaaatcttgatgttgcttcttggttttagcctgtcctgggtatgatgttacaacattttccttacagcgttttaagggtactgaaagtataagtaaagtgtctgagcaagtaaaaaatgtgaagcttaatgaagataaacccaaagaaaccaagtctgaagagaccctggatgaggtctgtatataattatttttttattttatcatgtggagtctagaaattgtatttatttctttattatttgcactaacttctcatagtgaagggtggttgaatacgaccactttcaatgagccaaacacttaatgtagtgggccatttcccttaggtgtactgggacagaaataatcctaagaactagtgctttacagttattagcctattctgtgaaacacttctgatattgtatttaatatcgcctccacatctgtccagaccttctgagctttcaaagctattttaaggccttgattctatagccaagttggactaagtgaaatacattttcttttgattatttttagctttttctaatgtacatggtgtccctggcaatagaaataatccaggcttggctgcaggatgtgggttcatctgtctcagttttcccaactcag

SEQ ID NO: 75190 - DNA, 3180 bp, Homo sapiens
tttaagtttcggttgtgtgatctttaaaagggaaatggtgggatatgggttttcggatcgacaaggactgaagcacttcaggtgtgactttttaggctagaactagataaaacgagataaggagcctgaatgctgttttcttttaacaggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcggtaccagaggcgtaggggcggccgggctggtgcggctgagggacgcctcacccccctggagatgcccatacattccgtattcctctgtgcccccgccctcgtcttcccgcggccggtggcctggaaggccggagaggcccagcttgtgctttggtgcctcgctcccgcctctcgggcgttctctactggggcaggggagcagctttatttcttggggcacacaggctgcaattgtagagttagaacctcattgggatccttgagtgggggtggaggccagaaaaataggaacccgaggatattgggggctagggcggagaggccgaggaatagtggtgtggatgagactcctgggagcggggcgccggctactagggaaatgggaagggatgtgaagatttctgtgggaacggtgtatccaacttgcttttctcaacagtttactaaatactgaacattaatgcgtgtgatttttaaaaaatccgtaggttgtggtttaagttttgatttaacatatcgaccctttaaatgaccttttcacctttatactttaagggagctacatgcacatttctcttgtgcagtggtctgtcattgttataaacagactaagaaatttatttgaaatgctttatactgtaggctctccatttgtcagcatagtctccatcttaaccatccgtctatagtcaagttatttttgttacacttgtttttcctttggaaaataagttcattcatgcacctgttaaattgctgaaatagttgtgcacgcagcattctcttacaagcggcagcctgcttgtgttttctatacaatttttaaaattctaaacttttcatttagaaaaactgtttctgggtttttttgtttgtttgtttgagacggagtctctctctgttgcccaggctggagtgcagtggcgcgatctcggctcactgcaacctccgcctcccgggttcaaacgattctcctgcctctgcctctcgagtagctaggactacaggcgcgtgccaccacgccaggttaattttttgtatttttaatagagacgggatttcaccgtgttagtcaggatggtctcgatctcctgacctcgtgatccgcccgcctcggcctcccaaagtgctgggattacaggcgtgagccactatttctgggttattttgagaagcttatattttattttcattttgggcgggcgtcatgacagggagatagaagaactctccaacttccagtgccttcttccttaattattatcctggcatccgcatcttagattaatttagcagatattaatacaacatctgtaacaagaactattctcagtgtttggaggtacaagggtgaaaaagaacatgtgtcggggatcttaccccattttaatggaactattttctcttaagccaattcgtatttcatctgaaacaatagaatagacatcattaacatttaataatacctcagtcatgtacttcatccatcatattcttatgaaacaaatcatgccatgtggaatcgtatgtaaaactgggccacgtggaagaatttcaacagacttggattatcaaaatgtttttataacattaatcttttaaatgcatagtctcggtcggtcgtggtggctcattcctgtaatcctagcactttcggaggccaaagcgggcggatcacgaggtcaggagatcgagaccatcctgactaacagttgaggccaggcattgaggaccagcctggccaacgtagcgaaacctcatttctactaaaaatacaaaaaaaattagctgggcctggtggtgggcgcctctaatcccagctgttcgggaggctgaggcaggagaatcgtttcaacccaagagggggaggttgcagtgggccgagattgggccactgcactccagcctgggcgacagagctagactctgtctcaaaaattaataataataatctccggtgatcattaacacttagacctatacttgacaataattattttattaatcataagatatcaaagagatgtttatgcttttatgctttgggtattttctggaatctttaacaagaaaccaccagcatgctaaaggtaactgattacttccgtttagtcaactttgtctcctttccccatcagctgttatttagaacatatctttgaaagaaaaagcaaaagaaaaaaatacaatagtgatagtgttagctgttaactgctaataatgttaactgctttatcaaaagcttagaagatgccaaaggacaactttgagaatgtaacaaaattaggaattaagcaaggaccacaaggcagaaaaagaagcagaataaaataaggaaacaaagaagttatggaaatcctcacaattacgtgattttcagataaagttatactacgacttgctatttcagcagtagtattttagtgtccatctgccatcttagcagtcttatatttgaaagaaaagcaattccgctgttaccttgagttattaaatacagtattaatcataatcccaatatttattaagttcttactgtgtgacaggctctatgctaaatgcattaaatggat

SEQ ID NO: 75191 - DNA, 1453 bp, Homo sapiens
atggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacaggtatcttagactggactaattttgaagtaagagctgggaattcctgacccatgtggaatagttcccaagctacaacatgtgcatcttacgccctccctcttaaaacattctctacttgcagcaagcccaaaactgatgaatagggttgctttattcaatcttcagagaatatctgcagcttgtcatagtattttgaagctattatgtgcgtataccccatgggtaactgaacatgatatttcctggcattcttcctgaaaaagatttctcagttgaagaatttgcctctcttcaaatatgccattttgtaggaattttctaaagacaatttggttgtagtcctagataagtgccagctttgatatttggaccacaccagaactttaaaatgtagcattccgatgaattgtcaaattgtttttctcttaatgttaccaaagcatgtttgcattctgaaaaagccagactatttatattttatagataacagtctgaagtttagaatgtagaatgtcacttttattttcagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggtaataattttgttaaacggtattttgtattgtaactgtactgttaaagagaattttggcgaatagttactagtgatggaagttattgacaatattattataaaaagcctttacgtctattatctcagaacagatggtgataaagaatatctgtactttctgtcatccattcaaatcagtgtcttcactgccttttgctgttattgttgttttctttttcttttcttctattttaagactaaccagataattagtgtcagatgtagatcatgagagcctagtcatggttgggacagtgatctaaaatagggtatgaaaggagttttgaaattaataaagattggtagtggatatgcggtgtctcttcttggcggctaggtaaaataatgacataatgtatgccacatacctaacacagtgccttccagttgagtactccaggaatataaaataagat

SEQ ID NO: 75192 - DNA, 1155 bp, Homo sapiens
aatacaacagattatatgttttttctccagtttcctaattttacaatgaagtctctttataagctttgggtacatgaaatttagtcctggaaatatattcacatcatatatgttgatttaaatggaaaatattctactaatttatcaataattgattgagtattgctaatctgaaatttttgtctgagtctttataaagactctatttgtaaagtaccaaactacatttgaggaactttttggacatttacaaatattcttatttctcggatgcttggcttgaaggtctgtgtggggaaaagatgtttcggaagcacttttcacctgttgtgctacttctgatgtactttttttataggcttatcttctttcttttttgttacttaatgatataaatttctggtgcttctttcaaaattttactgctattttatttctgttagtgacttaaactaaaaaattttaacatgtagtttataatcatacttaattgatttcatataggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccaggtaaaccatttttatgacatttagggatttcataaataaactggtaattgaattatttcagctaacaggatttggatgtgataatatagttatcttatttttatataattgatatgttgaaaaaattctttgaagttaaaatttttggaatgagcactgtgttttgtatgtactagcaaactgttattgaaagggaaaatacaaaagatgggccatttgtaaagcaaataatagccttacatggttttgtatttttttaagtaaaccttataactggaatatagaacatgcacacacacacacacacacacacaaacagcaaaagtagacaaagcataagtgtattgctcagtgaattttcacaaattgcacacacccgtaacatgaacacgtactgagattcagccagaagtttctttgttttctttttgttgttttttgttcagctcactgcagcttccacctccctggttcaagcagttctccttagcc

SEQ ID NO: 75193 - DNA, 1683 bp, Homo sapiens
ctctgttgcctaggctagagtgcagtgtcacagtcatagctcacttgcagccttgaactcctgggctcaagagatcctcctgcctcggtctcccaagtagttagtgctacatgcatacaccatcatgctgggctagtttttttatttttcgtagagacagggtttttctatgtgcccaggctgagcttgagctcctggactcaagcaatctttctgccttgtcctcccaaagtgttgacattacaggcatgagctgtggccagccttgaggctgatttttaatctgattttactatttttcaggtgagtggggaaaaatatgctttgatctacagttctcttacatttgcatgtagttatttttcaattgtttttattttaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtgtaagtagagctgcagaaacacaatttgacacttgaaatttgagaaatacagcccaaaggtgaatatcaacatgttagcattccaagtccaaacactctgtagatagttttggtttattttcccccactttgtattggattctctcttgtaactaggagaatttttgactggagtcagtttgctaatttttatccatctaaagaaacacatttttaatacttaagtagtaattcagagatacctagatctaaaaaccaatatctattactttgttttactattttcctgtgcttctaaagaaggcctgtgctttgtgtttagtttacttttctttctgaactatagtaaactgagaatcattttttccttttcaagggctgtcaaaataactgactaaataagaaacaaagaacatgtatcagagacagtatgaagcctgaaaaacccaaaatatttactttctggccctttttggaagtttgctgatgcctattttaagtgataaggaacttgagttatattcatactgtgctacaatcttgagtgacaggcctttctaaataagatgttacataaaatattattttgtgtttgttacactaaagtattaactaacttttgtaacttatcgagactagttcagcagccaaatatatagattcacattaaaggtcttaacagccatgataatttttaaaaactgattttaggctggacatggtggctcacgcctgtaatcccagtacctttaggaggctcacttgaggtcaggagtccgagaccagcctggccaacatggtgaaaccccgtctctactaaaagaatacaaaaacgagacaggtgtggtggcgcacgtctgtaatcccagctacttgggagtctgaggcaggagaatcgcttgaacctgggaggtagaggttgcagtgaaccaagatcccaccactgcactccagcctgggtaacagagcgagactccatctccagaaagaaaaaaacaaactgattttaaatattttatatactctttaaaatcatcctgaaaaatgaattatttctctaatacttttcatgtgattatagcatattcatatgt

SEQ ID NO: 75194 - DNA, 1359 bp, Homo sapiens
aaactgaaataagggaatagttttaaaaaaacacaagacaaccttacacttctatgtaaatatcagtcttttttaaaaacagcaagctaacaaagatagatttactttatgcagtataactgctaaggtgggcttttgtaataatggactttgaaatgattttctttttaaaaaaaaaaaaacaaaaaaaacggagtcttgctgtgtcacccaggctggagggcagtggcatgatctcagctcactgcaacctccatctcctgagttcaagcgattctcctgtctcagcctcctgagtagctgggactacaggcgcatgccaccatgcccggctaattttttttttttgtattttcagtagagacgagggttcaccatattggcgaggctgatcttgaactccggacctcgtgatctgcccgcctgggcctcccaaagtgctgggattacaggcgtgagccaccgcacccagcctgaaatgatttccattaaaggttaatctaacagtttactgataggttttaaaattcaagacagctgggctcagtgactcacgcctgtaatttcagcaccttgggaggccaaagctggaggatcacttgagccttggagttcaagactagcctgggcaacacagggagaccccatctctacaaaataaagattaactgggtgtggtagctcacacctgtagtcccagctactcaggaggctaaagtgggaggatcgcttgagcccaggaggttgaggctgcagtgagccctgatcacagcactgtactccagagcctggatgacagagtaagaccctgtctcaaaaaaaaaaaaaaaaaaattcaagacaacagaagctccattttctaagtatttaagtggatcggggtttaattttatgtttacaataaatccaaactaataattgcttgttatggataaattgttatttataaaagtaatataatctgacattttctatttgtttttacagatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggtaaataaattttgcatttgacacatgcatttttcccctgttcttacttagcaggtcgtatcttgatataatatttcttgtttgaaaaactgaatatatgttctaattaatatattataggcattctctttggaaaggctgtacgagattattcatgt

SEQ ID NO: 75195 - DNA, 1157 bp, Homo sapiens
tttggttgaatatggtgtcctttccccactttatgtttttgtttgctttgttgaagatcagttggctgtaaacataaattatgctttcataagcatccttgtaaaccaaaacaaaaaataaaatttttgttttgaaattatatttaaaactttaaatttgatgttattgtttattttgtttattattaacaaattctttgttaactttgtgaaagtcaagagaactgatcaaaggttgtagatgtgcctggagagctgggaaaacaacctcagaaaagatttcttttaaaatatttaactgtttgctcttaacatggaactatataaacaggaatattgtcaacttgtaagtcatataacagttacttaacaaatatattttaaagggcatctttctgctttatgaaattattttctttttttcttctgagattttagttgggagtatctaaatggatccaaattatgttaagctgattatatgtatattgagtgttttttaaaattagtttgtgaaatctcagtatgttttcatcatttttattactttttaaataattaaggctcaagaatcaaccactggaattcatcaactctctctctctgaatggagactgtggcaagatcatcctttgcctacacatcaagttgatcactcagatcgatgccgccattttataggccttatgcaaatgatagagggaatgagacacgaagaggtggggttttattgtaactttctcttgctggtatgatagtaaaactagagtacttagcttttatttttcttaatttgaagtaataagaaatactttgtttttctgtatagttccttgtgatctcagtaaagaatgagttttctgccttaagagaagaaatagatttaattaattagaagaagaatatcatctgtaaatattgatagaccagagtagaattttaatatacttaaatgatttatgtaaactgtttgtaaaccttatttaggattcttttggattcggatttattgaaatactctctgtcatctaggttatttgatatctttcttgtatcctggtcctagtttagagaattatagattccttgagcagttccttgattattcttcctagagtcagcatagtgaaccaattatgagtgtgaaatccatagtg

SEQ ID NO: 75196 - DNA, 2773 bp, Homo sapiens
gaataattcagttaaatgttagaaatgtaaaactcactatattcttatgtattcattcaatttgttcttcctacaaatagttaccaagggtcttttgggtattaagtactggggatacaaaaaagttaactgattaatgataacttgatagtttcacagtagtgtactttataattttgatttatcggaataacttttaaggtataaaagaatatcactggaacaatgtaataatataaatattttaatatagagtgaaactcctctcttagatttggctttctgttttgttttgttttcctgtggctttttaaattttccttatttatagggagaatgcagctatgaattggaagttgaatcttatttacaaatggaagatgttacctcaacatttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagcttaaaaaagaaaataatcacggtattatagattctgtagataatgacagaaattccactgttgaaaatatttttcaagaagacctaccaaatgataaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaaggtaagattccatctttataaagtctataactctttctagaataattactctagaaatactttggtaatttttccaaatgtaattttttagtacatggtacaatataaatattgaattagataattgatgtgttatatttttcttaagatgatcttactaatattagatttatttacatatacttatggcacgcatggtatggaaaaagttattcttgctagacattatgaaatacacgaagatgagtaagatctggccctaggtcttggttgtaaaacataattatgtgacatacgtatttgaaaagatgccagtaaaatgtggaaataactaccaaatgaataataagagagtggctgtttaggaggttcagaggatgatgaaattttgaggttgattagattggactttttttgtttctttgttttttttgagacggagttttgctcttgttgcccaggctggagtgcaatggcatggtctcggcttactgcaacctccgcctcccaggttcaagtgattttcctgcctcagcc

SEQ ID NO: 75197 - DNA, 1352 bp, Homo sapiens
accttaaacgtgttcaaaacacttatatttggtcaaaatcatctaacacaaagcttattttataataaaatgttgaatatctcatgtaatttattaataatactgtactgaaagtgaagaacagaatgtttgtatgggcacttgaaatttggtttctactgcatgcatatcacttttgcactatggagaggtcgaaaaatcattaagttgaaccatcgtaagttggggaccatatgtaattaaaaatacagccagtccgtattaacattgtgtactcatataagacttcattagaaaaacaacttgctaccttaactagaacatctgattgacttatcagaaatgatttaaaatattgataatgctgatgatcaatttgttttaaactaaatttattcctgttaattgaaatgattttgataaacttttgattcttttgactggttttgtgttatcctataagagatatggtgataggcctcatagtcaaaacttgttattgttttatttgtttcttagtttcaaatgattcctatatttggactgattttgatggccaaatttataggcttgttctttgtgaagcccttgaagatcttctgaaggaaatactgttaaactaaaagtatcagttttctaagtcaccatagtgtttgcagaaaaaataaaaataaaaactaaaagtatgttttcatcaaacatattcgatgtaatactatattggatgaatacctatactagtattacttataacctaatttagtattttagcatttaatattacctaagttatttacttttacattcttaagtatttataacattaatattatgtatttataacatggctctgagttgtaagagcaattttacttgtctaggaagaaaatatttttttcttatgcaagaattttgtcgaattattatagtcagaattatcatctagtgatgagagtgagaattttcccaaaccatgttcacaattagaagacttcaaggtttgtaacgggaatgccagaagaggcatcaaagtcccaaagagacagagtcacttaaaggtaatcttttttttagtttctttaaatatgtatgcattttatcagtaaagataattggttttacatcaatgtagatttctctatacattctctttatagaaaaaaattaagtattttgacacccatttagattttttttactggaattaaattcaaagtagtttttttttgtttatctttgtgttttgatgctttatcttgcagtgttgtgttactttgaatgaataccaaaaaactcaagtgtattgagaatttatgtttcaaattgaagaaaatatagaattagaaatttga

SEQ ID NO: 75198 - DNA, 1323 bp, Homo sapiens
aaatagataggtaactttatcatttcttcttgggattttcttttttttttttttagacagagtttcgctgttactgccacagactggagtgcagtggcaccatctcagctcactgcaaccttcacctcccaggttcaagtgattctcctgcctcagcttcccgagtagctgggattacaggcatgcgccaccacaccctgccaatttttttttttttttgtattttgtaaagatggggtttcaccatgttagtcaggctggccttgaactcctgacctcaggtgatccacctgcttcggcctcccatagtgctgggattacagacatgcatcactgcactgggcctagaaattttgtttttattattttattaatcttaaaagcattgataagaaatcagttttccagaattatttccaatcatgaaagaaaattattttctcactgatatcttcatgttttctaatttgtcttacttagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatggtaaatgttataatgatccttaaaatttttttcaatgtttttatgtgcttatatttaaatattttaatcagtttttaatgaaactagaccttaaaggtaattaaatgtggtacgtgcaaaatatttatttggtcattttcattcaaattctttaatacttgctttattttagactgattgttcataggcttctgctaatttgaatatttctcttcagattgacctgggttgctcaagtgtgaaatgttcatttcacaagtgtttattgcccgctacatgcctagtactatgtaaggcatttaagaaccatatatgaatgaacaaaatagacaaaaaatttcttcttatgaagcctacattcaaatggaaagagacagacaatatatatactaactaaattatttagtttattgtaagataaagagttacagaaaaataaaaaagttggccaagatgagaaaaatttggagtaactggggttgagggtataaataacagacaagttgccattttattgtattattttttagttttatttttttagagacagagtcttactctgttgcccagagtagggtgcagtggcgcagtcatagttcactgcagccttgaactcctaggctcgggagattctcctgctttagcctcctataggactacaggcatgtgccaccatgaccagttaa

SEQ ID NO: 75199 - DNA, 1050 bp, Homo sapiens
ttcagcatttaacatttttatgaaaaaaaatgaattttgatcaaccaaggacaaaaaaggaatcttttttactttttgagatggagttttgctcttgtcgcccaggctggagtgcaatggtgcaatcttggctcattgcaacctctgcctcccgggttcaagcaattctcctgcctcagcctcccaagtagctgggattacaggcatgtgccaccatgcctggctaatttttgtattattagcagagatggggtttcaccatgttggccaggctggtcttgaactcctgacctccggtgatctaccagcatcggcctcccaaagtgctgggattacaggcgtgagccaccgcacatggccaaaaagggatcttgagaatccatttagtcgagcttcctgactttgggcagaaatgatctcaaatagctctgacagcccagttttagaaacaaaatggaggcttcactaacaggaacatatttcaacatcatcatccagaaattctccattatatttctatagttcatacctgcgagaaaatgtttatgtttttatgtgtcttatgaatcattttgtacttattgttcatcattggactacgcaaagatttcatgtaaatagctctcatttcagaatctgtgtaaagataagaatttagataaattagcaaaattatttaaatgaaaaccagtaaagtatttaacttcaatctatttcaaatttacttgattcaaaccttgtgcaaatattttacacaaagacaataaatattaaaagatatctataaacaattattcaaaaatataaagttaggagtttagcctttgaaatcagattttctagttgagtgatcatggacaacttaagttccctgctttatctatctctctgaaaatgaggattaaaatggtgacttttctttcaaaacaaaggtatacaaagaccttaaaactgtaccagatttatagaagtttcaaaaaaaataagaaatctagccagaaaagcaaatatgcactaaaaacattaaaacccacagccaataaaaagtat

SEQ ID NO: 75200 - DNA, 1329 bp, Homo sapiens
ttactttctacctacctgttattagcccttaaatttctagacggtaaatcattcttttcctttatcctcaaactcattttcctccataaagaatgtacttagtttatgttagttgagtaagtggctgaattaataaagtaaattaaacaaatattaatgcagatttcatgtgcctagaagtatattttaaatacctgttaattgtctgaaataaatataaaacattcttgtgtttttattgtagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggtatggatcaaagaaaggaaaaatatctttagatggttaccagaagtttttctttttctttcttgtgtgtgtgttttgtattaaataactaggtcaaagaaaaattaacaaaaaaattttgcagaaaatgtcttcaaacaagaaaacaatacacaaaattatatgggcaattcacagggtgcttaggttttaattttttaaatatgttaatgttttgttaacactatgtaaggaaacttgataattttattaaaaggttgtgggaaaatagggctttctgcaaggcaaaattaactgaaattatgtgttcagagttagttccctggccagatgcggtggctcatgcctgtaatcccagcactctgggaggccgaggcaggtggatcacttgaggtcaggagttcaagactagcctggccaacatgatgaaatcccgtctctactaaaaacacaaaatcagccaggtgtggttgcgtatccctgtagtcccacctacttgggaggttgaggtaggagaatcgctt

SEQ ID NO: 75201 - DNA, 1142 bp, Homo sapiens
acacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggtttgtatttttaaatatctttgtttataagactgtaaaggaactttacggttaacttagtttattcttctattattaggatgtgggaaactcttaaaatataaacacctgactggtgaatgtcatttcatattttcatacagccataatggctttcattagtcattgtatttaaatgcagcttatgagaaatgaagggttggaaactgaaggcaagtctgccaaacataagactttttcaggaacccaggaaggatgagggccttaactaaggcagcaatggggaggagaagtagtattcgggagatgtttaaggagtcaggattagcaagagttggtgggaggagttgagaattactgagttgaccaacttcttggttattgggcagttaagtagtggtactgtttattgcaattatgaatataagggaagcaacagatataagggacaagggaagttcaattttgaacacgttaagatcgagttctcaatgggtcactgaagtgggtacctaggatgcatttggaagtgcaggattggagcttcaggtagaagatttctgcagtaattatttaattgtatggcgagccctcaagaacagtaaaaagatcatgagatatggaatcagaagacacaccaattactggcttctctgtgtgatattgcattgacaaatcactccctctgaggaactgataatacacttgttctactcatcttgtgatattatgagaactaagtaaaagcatgtaggtgaaagccactgcggaagaattgaagaattatacttttggtaatagtgtagtttatgtaaaacattggtgtgggagttgggca

SEQ ID NO: 75202 - DNA, 1119 bp, Homo sapiens
tgaacaagaaagggtagggaagtaattggcaagatgatgttaaaatgggtgtacagggtatttgttgagttattctttggaataaatacctaagataattttatattaaaccagtacttaatgcacccttcatcagagctagcatgaaaaactagagatgagtaatacagtcttggccttcaggagtgaattatctaggaatataagctcttccttattcacctttctacgttgattccagctcaaggcgctcatagttacccctattttctttctcagatatttgagaaacattagttgtagggtttctcattagcagaatgtggcaccagtttgctcaatggtgtagatcttgggattttaataaaataaagtatattaataattctacttaatattagttactgaagtttgcctttccctaaatatgaatatttaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacaggtatgtctgttgtaatatttttaaatgattacttttaaaagattcgtaaaagcattccatagaagtttaatgttaaaaaaatttaagcggcatcatgcctgttagattattttattcagtaaacattttttgcctgccaacatatattagttactgtatgaagctaagggacattattcgaaaaaaagaaaaaagaaaaaataggtgtagggatttcctttgagaagcttagagctctgtggagagacaataaatagcagtttcctttgaccttgcaatctaacatttctgggctgttcagttctgtaacaagaaaaatgagtattttactagttgtgatcattatattgcttgaagagggagattttagaatgtagttcattttaat

SEQ ID NO: 75203 - DNA, 1353 bp, Homo sapiens
acaacacaaatttatttctgccagttctggatactggaagtctgagatcatggctgggttctggagagagctttctactgagtcacagactactgccttctcattgtatcctcacatggcagaaatagagctagctagctctttgacctcttcttaaaagtgcacaaggatatccacctttatcaactaattctcaaagttgccacttccaaataccatcacattgggattacggcttcaacatatgaattttgggcaacacaaaaacattcagttcattgaagatgttgaaattgttattctagataattttaaggaaaggaaacaagtagctcttttatccaaactaatgttcaagacatatcagctgggcggataatgcttgagatgatttccttaaaggctactgtgtttggtgttctttaggtaatattaaattttataaaagccaaaagtcctagtgtaatgattttgtctcatttatttttcagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactacagccaacttgtcgattttccctatgtgtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatg

SEQ ID NO: 75204 - DNA, 1028 bp, Homo sapiens
ttaaaagtatactatctacacatagggaaaatcgacaagttggctgtagtcatagacatgtcaactttactatttatcacaacagtacaactttaattttgggaaacattccaaagtatatctctagcttagcttttactttcttaaactatccttagtaacacttttaataaaccttgttttatttaataagaaaaattagttttataatctagtcaaaatgatcactgaacatcagatttttcttttttaataatttctataatctataaataaaaatgtatacaatataaaatatttaaataaaatattctcttatttacaaataaacataaaacagcaatgattattgaagtgcatttaatattgtgagaggtctttgaaaaccccatcttgagcagcttgattatatatcagatttcagtctatcttggttaagatcatttggtaacatttgtatgtcaaatacatagtgaatatatctatagatctcctcagccttctgatgagttacttgtgcatacatggagatttcttgaagtgagctgaaaaataaatgagacaaaatcattacactaggacttttggcttttataaaatttaatattacctaaagaacaccaaacacagtagcctttaaggaaatcatctcaagcattatccgcccagctgatatgtcttgaacattagtttggataaaagagctacttgtttcctttccttaaaattatctagaataacaatttcaacatcttcaatgaactgaatgtttttgtgttgcccaaaattcatatgttgaagccgtaatcccaatgtgatggtatttggaagtggcaactttgagaattagttgataaaggtggatatccttgtgcacttttaagaagaggtcaaagagctagctagctctatttctgccatgtgaggatacaatgagaaggcagtagtctgtgactcagtagaaagctctctccagaacccagccatgatctcagacttccagtatccagaactggcagaaataaatt

SEQ ID NO: 75205 - DNA, 2166 bp, Homo sapiens
ctctaagggctactatattttctgttctgttactttttatttttaaaagatttttaaggattgccagccatggccaatagtttgataagcattgtaatgtgtgtgagcatgtacttcaaacttgccatttactttaccattttagccaagaatttcaagtacagagaattaaaattctgctggtataaaacattgtactgttataataacagactgtaggtaaaagtaatacagtaattagtattctgtatagtaattactatactgtaatagtacagtatagtattgtaattataattactatatataatcatgataaattgtgtttatattttaagtttaccaaaccagtatattcattacttaattacttagcacattttggcaacttttggaggcccatagactatcctttaactgctatagcattagtttataataatttcttagaggagtgtttgccagcactgggaaacaacattgagtaagtcatggttcttgccctggataaacccaaaagagaattatgcatttcacagataattataatgtgattaaatgttgttataggcatatgttcaaagtaatctggggataagcatgcttaattttgtctagatttgaggtagacttcaccaggaggtaccatttagctattaatagtaactcttttataggttgaaactgatttctcaactccaacaccaagaaggaaaaccccatttaacacaggtaatacacttacagctttcttttgtggctcagttctattataaggtaggttctttatttaaatggtattaaaattaattgctctcaagtggacagacttagcattttattccttatagttgttttcagttttattgaaagtacttttagaaatttattatctttttattaaacttctctttacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagatttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtatttgtttcttgttttttgtttgttactaattactggatgatagaaataaaaacaaatcatgactggtcctgtttaagtttcctcaaaaaaaaaaaaaatgattaataacattttcttgtttcttaagtgttttagtcagagcaggcatggtgtcatgtatctgtagtctcaactacctgggaggctgaggaaggaggatagcttgagcccaggagttcaaggctg

SEQ ID NO: 75206 - DNA, 1049 bp, Homo sapiens
ttcctcagcctcccaggtagttgagactacagatacatgacaccatgcctgctctgactaaaacacttaagaaacaagaaaatgttattaatcattttttttttttttgaggaaacttaaacaggaccagtcatgatttgtttttatttctatcatccagtaattagtaacaaacaaaaaacaagaaacaaatactataaaagcaaactaactttatttgaataatctaaatagagaacaagggtaggtgaatgtgtagccagagggaaaatatcctatgtcaagtttcaaaacataacaagcaaaaataagtttatttctaaaagaaatttcagtgaaagaaaaaggatgtttattatgacataatatattgattcctaatggtggatctattaactgtttgtctaatctagtcaaaatatttaagctgtttctgcatatgtaaataaggcttaaaaattagagaacaaaatctgttctctaattttacctagtaaaataatggtaaagcaataaactaaatttacaaaggtttcatagatatgcctatcacaagtttaaaataaaaacaatcaggagagaagcatgtcaacaatgtgtaatttaatttcaacaatgtgtaatttaaacattaggtttggataacaactggtaacaaatcctactctggcttggataataactgctaacaaatgctaacttaaaagttttcatgaattcaatagctaccaatacaacctctgtcatccttctcaccttctcttacttaaatggtagcaaaattttcttgaaataaaaaaaaatctgtttgggaaatggttttcttaaagtaaacagacttggatgcttattaaaaaattatctatatatattttaatatgcaaaaacaaatttacagatatctacacgagcaaaaacaattttctttacatttttagtaagctgcagcaatgaggatattttactttgaacacaaacatatgaaaccttcaaaaaagtccacattttcataggaagctactttacaaagaaaatacatgtactccagt

SEQ ID NO: 75207 - DNA, 1259 bp, Homo sapiens
ttgaaaccagcctgggcaatgtggtgaaaccctgtctcttaagaaaaatacaaagattagccaggcatgatggcacgtgcctgtagtccaagctacttgggaggctgagttgggaggatcacttgagcccaggaggttgaggctgcagtgagccattatcatgttactgcactccagcctgggcgacagagtgagaccctgtttcaaaaaaagaaatacatttgaaattaatttaggcaattgttgttcaacctgtggttaaaagtatgacagttaacttaaaattattaggttgacttaaaaatattgttgacttaaaattatttcgtattcaaacaggaatgactgtgataaatatgtttttcgtatgcaaaaatatcataaaagtaatggtggtattgtctggggcaacatcaagaaaaaattagtaagtatttttctttatccaatacatatctatgaaacaactttaatatgtgataaactgtggtagttgtaagtcatgtaacagtccctgtccctgaggtgattataatgtaacaagttacaataatgaagccatgaatgaggtaagcacataagtactgtaggattacagatggcatcacattgactgaaacattggagcaaggggaaaatggctaaaaactttgatttttgggaaatgaagggtgggaaaaatatacacagaggtctgggaaggatatttcaggcaaaacacaaaaacacaaaacacaaaaacaatcctgttcaaggattgaagaataattcagactgagtcacaattctcataaagtaagaaatttcatcaaattctatgtagctttaaaatggcttcaggtgtttttcagatttagctacttaattttatttttttactttttatttttttacattctaacatttaaaatccaactacagaaaaatttttaactgaaagatgccttaatagaatgatctatatcccttagagaaaagattaggacagtcctttatccccttgaattactttttaaatttttaattttctgattttaattgcaataactgattatcatatataagtactaggattctggaaaaagtatttcatctcaaatttcctctaagtagctaatcttcgagaatggtaacttatgggaacccccttgattcccttgctttatgacactgagcaagttacttgagctttctaataccattttattcatgtgtggtatgacaatggggatcatgattatattgatttatgttaccaa

SEQ ID NO: 75208 - DNA, 1038 bp, Homo sapiens
tgtagtggttggtaccaggtaaaatttgttaaacatttttacacagttgactttattcatcttttcattaatggcttgtaggttttatagtatagttagaaagaccatcactaatctggtattataaaataattctccaaggtttctttagttttttttttttaaagttttttacaagtaaaaccttgatccatttcgaattgatccagaagtaaatgtgggttatatcacaatgctgtttattgaatagcaccccgatttgatgaacttgtccatccttaacttctagaaactacacattcttgattttttaaataatgcctcttcccattactggcatctatggtcctcatgaaatgtttaaatgttcctcactactctgatgcagagaattaacatatcatatgcatgaatatttacctatttatagaacctagcatgccaggactgacatgctgacattgaggagtttttaccaatggaaagataactgatgatggagttgttggatttttgtccatatttggcagaatatcatcatcatcttcactgtcctggaaacttggcaactagaaaacaagtatttattatcagcaggcaccccataaaaggtattttctcattatcacaaaatagttttggaggactgataagttggttcttcttgtaactttccaagttagataattaaaaacagtagtacgtagaggagtagaggctagaggaactccattttagatgctaattcaccatgctgacttctgattaaacctggatctggaaatgcctctaagatttctacctccatatacttactggaaatcttgtccttaggtcaaaacaaccttggtgttatcgtaaacacatacttaccataaatacagcccttaggcaaattccctatggtatataaaccctgggtctggggggataacagtgcccaaatccaccatcttgaggccacccaagagatggcttctgctcaaaagtctctattaaatgtttctgagaaactggatttgtcaccctctttattca

SEQ ID NO: 75209 - DNA, 2546 bp, Homo sapiens
aatcttgtagacactttctaaattattttgattattacctttttccacggattgtaatttagaggcttcttttctccccagcattcaatattatctatcagtctcattctgtcagtcatcttgtaaacaatggcacataatatgtggaggtggttgtaatatgtttctatgacagtgggatgatttgcagtttatatgtatttctaattacagttggatagtttcagttagtttgacttctcattacttaggttttgaattggtgaattgttctcattttaatttgctttctttagtgacaagatataagattctcaggttgttctcttttgcttgttttgtacttcatggtgtttggggggattcattttgagtgtgtttctatgaccaccattggcaatgaaagtggaaccatgcagatggagttccatgtcctcctaactagcacagctcatataatacttagtaaggtttcagtgactactggttttcttatatcttctgaatattttacctccagggctttgatttaacaagtatttacttattgcctactgtatatgtgaaaggctctgtactaactccagcaaaaaaaaaaatcaaaccatacagataaagttctaaccattaattattttttccagtctgattgaaagacaagtgtgcaattataatacatgtctcactgtcaaacatggcattatttaaagtattctggaaacttgaaggagagctttcattcagtgtagggaatgtgtacaagtttgtacactaggtgggttagagaataaaatcgaagcaggtagtgattttgtttatagatgaatgaagaacatcttcaaagcagagtggacaacattattaaaagtggagaaccaagaaaatctgagaaatagcaagtggtgtggttctgaacatagaatatagttgagattttgacaacagtgagagattggaactatgtggaaggccaggcagaggagcttatttatatgtctactaaaagactgtgagaagtcactgtcaggtttgtataaacaatagtatatgtttacagttgaaggggcagtggtctgaatagacctgggcttcagaaagattaatatgacaggtgggtatacagtgtagctcgtggataaaaatagtatcttttatttgtgaaaatatattttctgtgcttatatttgtttatagctaatttgagattttggtctttggttttgtcttatgaaattaaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattggtaagtagttagatttcattccgaaatatctacagagcagccacaagacagttaaagacataaaaatagcaataaggggttaacatggaagatgtcattaaaaaaaagggagaaattataatttgcacagggaatggagatagactacacataactcctagtggtatttttgtggtcatctctaatacgaggaaagtacgaggaaagcctaagtatgaggaaagtaaaagtgaccttttcattcccatgtaatatttcaagatagccaaatagtactctctcacgtagcttcatattttaagaaatgcatttttttgttttttgttttgttttgttttgattgagacggagtctcgccctgctgccccgtctggagtgcaatgccacaatcccggttactgcaacctctgcctcccgggttcaagcgattctcctgcctcagcctcctgagtagctgggactacaggcgcacgctgcc

SEQ ID NO: 75210 - DNA, 1064 bp, Homo sapiens
tttcacttagagccagcacttattagggatttgatcttaattgcaaatattatcagtaaagtgtttaagaaagctattgacaagagaaatgaatacaaatttaaaagactaaagtttggtaaactattttacataccagctgtgtccataggaaaatcactcagcaattttttttttttttttgagacagggtcttgctctgtctcccaggctggaatatagtggtgcaatcatggctcactgcagcctcaacctccttggttcaagcaatcctcccacctcagcctccaaagtagctgggactacaggcatacagtactgcacttggcttgttttttatttcttgtagagatgggatcctactatgttgccaggctggtctcctactcctggcctcaagcagtcctcccaccttggcctcccaaagtgctgggattatagacatgaaacatggcacctggtgtcaacatttttaaagtgctttccatgaaccctggtctattaagttttaggaacttagagatgaataaggcatgattccccccacccccacccccagggatcttggtttaggggcaaatattaatatattctgttatgattgcatcatttttctagtgtaattcattagatcttttcttaatgaaactgttagacactatcttcatatcacgtaagttattttgagtggtggttggggctgttattaattttattattatcattgcactttgcatgaaaaaaacaaaaccacatctaacattatatagctaaggttatgtaaaggtaccaacccatgttaatttaagataatgtaattttatgtatgtgttttaatgatttgcctaaaaagtacttgtgtatcatagtattgctcttaaagcactttatctctgttattacacttaccagagtatatgataaatgacctatcataatagaagcttccttcattatatggtaatattttcaagagcaaggactagtcagtacatctttaaagaatagcttctagaaaaataacaaaatgtttttatactttttatgaatctgttttaacttac

SEQ ID NO: 75211 - DNA, 1702 bp, Homo sapiens
tctcctgacctcctgatccacccaccttggcctcccaaagtgctgggattataggcgtgagacaccgcgcccgcctgaaatgccagttttggagtttgctttggtctgtgaagcatttcagaagcaataacattttactagaacttctgttgtatttagtaaatctcaaaggaaaataaaacttttgacatatgtcaaagagtaattctaatcatttacccttcagaaggcatgcagttattaaatactaatgtgcagttcttcctcctttttttttcattcattttctcagtagttatggagtgtctgctactttacagacactatagttgatgctggtgaaagacagaagaatttgatttattcttgcccttgtggagctcataggggatacggactttaaacttaatcacagcacaaatataataactggtaacgggggctggcagtttttttctgtaaagggcatattctgtaaagataatattcttgcaggcatattgcccctattgcagctattcaactctgcctttgtagcagaagagcagccgtagataatatatacatgaattagcatggcagtgttttaataaacttcatttacaaaaacaggcaactggcagttgtcctgtagttttcctataatatcagtttaagtaggaattataagagcatatagtaggaagcagtttggagatcatatttgagtcctctgacttaagatgttacacctcagttctttgtgaaggaagggagtgaaagccatgaaggattaataatgtaagattaaagataccctgcctgggtggaaagagctttatgtgaggggtttttatttatttatgaagattttttttgttttgtttttttgagaatcagtattaaggaaaaataaaataattgtttttaaagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttgggtatgttttgtctttacttctctgttggtacagtggttaagttcttacatggtctacattgtttatggtttataatgtgtatagtagtaatgtgtatagtatagtattctttgacttatactgcccccacattcctgcttcttcactactatatgagaagtaactataatacagattaatcatggtcaggattcagcttgcttcatcaaataccacctttgcctgggcccagtgacttatgcctgtaatcccagcactttgggaggctgaagcgcaaggatcgcttgagctcaagagtttgagaccagcctggataacatgacgagaccctgtctctactaaaagtcaaaaaaattagccacacatggtagtgcatgcttgtgttcccatcttcttgagaggctaaggtgggaggatcgcttgagctcagatggttgaggctgtaatgaaccatgtttgtgctacaacactccagtttgggcatcagagtgaggcactgtctcaaaaaataataataataataattacctttttattaatcagaataccaaagaacactggtaaacaaattaatgaaagatgattgttcttttaatttccttgacccaaagtatttaagctgccaacctacc

SEQ ID NO: 75212 - DNA, 1136 bp, Homo sapiens
tgatacagtaatttcttttttccccacttaaacctcatttggtaccttccaaaatgaaaggtaaaaacatttggctgtatagccagggtgaaaaaacaccagattagctggatccaatctactttctgcataaaagctaacacagtatagaccctgaaggagaggaacagggagatcattctttggaagcttagcatcagttaagctgaagctgcaagtatttattgccagcatcagatactgagacaaggcctctgctcccttactaataatattttgtaggagggacatggtttggccacagtatagtttttttggtacataatctgaggattacaatagccaagcagttgagttctgctgtaatgtttggccttcaaatattttgtaattagactaataacattcttagtgttgctgtagctaaagtgtaaaattattttctgttagaaatttctatatgaatattttgaccttaccaaaactatttttttttcctagagacgtcactaacatatattggcacagtaatgtaattatagagcggattgagcacaacaaacttaggactatatcaggcaacgtttatatattaaaaggcatgatagaccaaatttccatgaaagaagcaggtaaatgactgtcattattgataagttattttaagaagtaaagcagttaaccatgtttctcacagtaatacacatttttttaacttttaattaggtatttttaaattatgaataaatcaaaacaactgatattatataaaactggtaattttttttctgatttttatcactcttattgacaatttctaataagttatgtgtttttgtttttttttttttttttggaaatggagtcttgctctgtcacccaggctggagtgcagtggcacgatctcggctcactgcaacctccatctccggggttcaagtgattgtcctgcctcagcctcctgagtagccgggactaaggtgcctgccaccacacccaactaatttttgtatttttagtagagacggggtttcaccaggctggtcctgtgcatgaccacttccaacatggcacaaaaaaatgatgcaatagcaactgcaggtagctgtggataaataagcctggaacaacatcgt

SEQ ID NO: 75213 - DNA, 1328 bp, Homo sapiens
tgtcatatattgcaaaagtactatactggtctgatcattactaaatctaagtgtctttatttcaagaattttaaaagctgtttttttcttagtgactaatacaattcaacttcttctttctttaaaaaataaaaccttagcctcagtccaaggagttcctctagaatcatcaaataatgatattttcctcccggtcaaacaaaagattcagtgccagcaggaaaagaaagcaccactgcacaatttaacttacggtaaactatttttggtttgttttcagtttgttacttaagtatattgttaaatgttctaggtaattactttccttgtgtgggcattaaactttagctgtggacaaaagcttgaatcgtaaaagagacactcagagaaagactgggcaggagggtggaacgttcctaacctaaatttatctcttttaatttcctgtgatccttctataattgttttgttttgttttgttttgtattttttgcagaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtgggaaaacttttaagacagatatttatttctatttttaccccgttcttcaagagcttgagcttttaatgttctctcattattttttttctagctaggatttgaacctgtatgcttcattattaacagtgtcttcattatcatgttttattatttactgcagtgacagtgtgacatagtgaaaagaacagtgagttgaatgtaagaagacccacatgttaagtcttattttgctctattactagttgtgtagtcttcaataatttacttgttccttttggtgatgaacattgaattcattcctactcttttttttctgatacttacagtactattaaaatagttag

SEQ ID NO: 75214 - DNA, 1484 bp, Homo sapiens
gtatttttttagcttttattagaatagatcttgtagttgctgccttaaaatttaactgcctaaagggaaaaattatatttgtggaactttatcttttgtaacctaatgtagtgccatatgcatatatcttttattttgttttattttattttattttattttgagacaaggtcttgctctgtcacccaggctggaatgcagtggcacaatcatgactcactgtggccttgacctcccaggctcaagtgatcctccctgctcagcctcccaagtagctaggactacaggcgtgtacaccatcacacccagctcttttgttaaggagactttaacaaaaataaaatcttagtctgatttgtgattatctagtattgttatgaaccagttaaacattttaattagtataatgttgtggaaagcaaataaactttaaacattttctgcaccaaagcatgataaaggctgattttacgttgaactacaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagaggttagttttatgtgttagctaaaaagctgtaatgtcttaagtgtttaatgtttcagacactgttttaggtgctcagaatatagcagtgaacaaaatggacaaaaatccttgcccttgtgtagctcatattcacatggtgggaagacataattaacatattaaataagtaatttttatggcttagtagaagaggaaaagtggaaagaggaaaaagcagaattaggatgatgggaagagttggagggggatgtaattttcagtgcgatggtcagagtaatcttcagtaatttgaatttgggaatttgagcccacaaaattgaatgagatgacagatacatgtatcttgaggaatggggaaggatgat

SEQ ID NO: 75215 - DNA, 1068 bp, Homo sapiens
ttcagcagaagttgatttgtttgttgttgtttagttaattaaaacaaaatccctactttaagataccttccaattacttttaatacgttttatctcaaggaaaagccccaaaacatctgaaaggaggcagcaattttagaacaagtacaatcgcaagcctcagtattctctaaaaagttattatgtatgtgtttattttggttttactaaggcattattttgggtttttttcatgagtcattatataatgaacaagatattactttcaacacttttccaaattaaaaatattgtcactgaaatacttgaacaactatgacgagttaccaaatttactaaattatacttttacaaataaaattagacaacagtttgaaattaaatacccaacttccttataaccactaagttagtcttaaattggttattttaaaatgaacatcagaaaataacatttgtactagtattatatatttgcacattttagaagctctgaaattctaaactttcctgtgtttacaaaaaccactatttcattttgccctttacaacttaaaatgcactggaaaaatctgaagtcctatgtgtattaatgtctgaagtctaaagtcttgtatgtattttttcaaacacttatataacagataatattaaatatatataaccaagagtaaccccctatccatttttattgcttttagtaaaataaattttctccattagcatatgaggtttctgaattttcaattacactttttgtcattactgccctttgttttagtcttgctttttggaatgcatttttgagacacaaaaacgttatattttcacgtctttcaaaagtgttcccatgtaactaggatggtgctgatagaaggctcatgtacaaagaaaaatcaatctacttttaattatgatgtctgaagggttaaaatctgtcaatagtttttatgataagtagtttataattaaaatatagtttatggaagaagaaaaggatttagagattttgaagcatatcaaaatttttgaattatttccgggaagtaactcttaatcacaaaaaca

SEQ ID NO: 75216 - DNA, 1052 bp, Homo sapiens
gtttcatatgatgatcataaaatcccaaaatattaattattagctgttattatattatcatctcttgtttacctaccctttacccttgctatagagcacttctgtatctttgagtataaaattagagcactaatactactggtgaaatagtaataatgatgacaattataggtaattattgggaatttactatatataatccatattaattattaaacctattttataaatgaggtatactagtgacagagagcgttttcatcatgattgtcagcttcagcttttttgttctttcttttatttattcatctaatatttatttagtatttgttcctcatcctacccaatgtgcagacgtagcatcctcaacaagatagatgaagtctcagctctcagctaaacgctgatagaaaaagatgcatcataaacaatcaaacaaattaataatcagggaaggaaataagacaggtattgtagtacagtgaattatttgttgagggacacttttagtttgggtgctagaaaaaaaaaatatctaaagaagtggcctttgaactgagacctaagtgacaaaaaagagctaaccatgtgaagatttgggaaagactgaagaagtacataggtatagaagtagtaataagcttgccaagatcaaggtgatgtcataatacccttctttctggaaagtgatggaagtgacccaggaaaagataaacagaagatcacacacagccttgaagggctcagtaaggagtttggttatttattctgtgtaaagtggaaagttcttggtaggtttttactagggaagtggcatgatccagcgaagttttatggttttatgttgtatatggtgatgtcagcggattcaatagattgtaagggattacaaatagaaacaaagaacaggtcacagcctgttgcagtagtccaggtagatagtttaaactcaataaaagggcagaataacatccctccaccatgaaagacattcacgacttagttccagaagcatgggaatatttcatgttaaaatgcaaaggggagttaag

SEQ ID NO: 75217 - DNA, 1025 bp, Homo sapiens
ggtcttctgaggttcccgaagagattgaaataaatcttcttctaagataatgaagcagcagtagctagttattttgagaatacagaagcagatgttggacaattattcctcattctctcttccaactatgcaaatagatatttcctatttccagtttctgtacctgcttttcccattttgcaatttctgtgggtcctttatcttctcatcgtcaagtaactgggggacaatgaatttcaatgtcagaccccttcctcgtcctgttcctcctcctttttcttttgttgtggtgttgtggtatacttctttaagatggatgcttccttctttcttatgtcttatctttgacatttctcttctgtacattcccttatttgttgcctatgatatttgcaagtatctttcaataccaaaatttttaccaaaaacctggttttctttcttggctggagaggaaataacttctagagaggcagagggctcatcaaatgaatacaaatagaacctaagtatttgttgaaagagtaagatttgttctataatgaaatcaagtaaagttacttattgagtacacagggtacaggtagatacagttgtgtatatatcaattattctgtcctcaggcaatttgaaatgtttttgaagaagcaacaaatacaatgctagaaatagttaaatactaaattgtatcttacaaactttgtactacatagagactcaaaatcaagaaaagatgatatgaatataaagaactaagggaaataactgaaaagatgaagtttgtgctacatattagggaatttttaaagcaggatggtgccctgaaatacattaaattgcatgaaatacagcaccacagaacctgagttcaagtcacacctctactacttaaacgttgtgtgtccatagaaaaatcctttacattctctcatccttgattttctcatatgtagctggaaataatcatgatagtttaacaataactatcatttataaagccctcatcaaataccagaaaatgtata

SEQ ID NO: 75218 - DNA, 1050 bp, Homo sapiens
aaccagtgctaggctgcaaggtcagaacacagagtttgcctatcaagttatatccatatttctttgaaggtggtgggatggttagatatatgtgccactcctttctggagaggacagtaactttcggtatgctgttgagtagcctcccattgcaaaattgcaaaatcttaccttactcttgtattgaagatgagctaaaatctttacctttagattattctatttttagacctcaagtttgcaaatgtaataggaagctaaatcaatgcacagatggttaataagaatacagttcagtaatggataggttgtacccaatccatccactgatgtttctgaatcataccctaatgtagaatggattataacaattaagtctaaaggtacttcagaatgaggtcttgagaaatacatggctccatgtatatttgacaagctacctataatgggagaaattcttgactagaaagactggtactgtgcttcatgaggaaagataccacacataagacttgaccttatgtagtgctcagaaaaatgttgcctttattagagtgtagcatgactactcagaataaactagtgctagagctcattaatgaggcttattcagcaaattactcctacagtggatatgcttgcatattgctggactgaaataccaaaatttgcatgtgtttttccagctgtgcttgtttgtttaatttaaatgatcagctgcagatgaaattctgatcatattcttaaattaggagatggccccagttccctgatcacatttgaaggctgatttgtttcacacagtaacttcctatcatttgttgcctccactctactctgtacttcatttgaaatttggcaaccctttccatttacaaactgtgggtggatttgagtacaagacatgaggaaatactatagccactaaagaaatggagggacatacattgtcttctagtaatttgcaatctttccagagttgcaacatataagcagcatggaacaactggaaatatatcaaagatatgaaatggaatacaaataatagct

SEQ ID NO: 75219 - DNA, 1035 bp, Homo sapiens
acattctgtaaatggactgataagcataaaaacccatttcatagtgagatcagcggtcctgcagaatcactctggttattttcctagttccttaatgcctggttggcatagatgtactcaaaatctggcaaaatttctatatttatttccttaaccatgatataagagatattttggaagatgaatcacttagggacacctttccaaatatatgcatgacctaaaagcaatgtcatatttgtgaaggaattatcaaagtcttaacaaagtgatgcaaatcctctcacatttctaatatgcatactcggctcttcagtagctggattggttttatggaatattataatcagatgttacaacataatcagatgatagctttaattacatctgttgttccaggtatgactttattgccacaaacgattgtagtcaagtattcaaattgtcaattttggtaatgtgtttttctttcaaaccagaactttctttcacttgaagggaatgggagtacatctcatgatcttattttggggccatgccaactgtctgacttaggcaaaaatcacgtacagaaattagcaggtcacaagatgtttggaaacatatgttcacagcagagagtaaaaaataaatgaaaatgtaggatactgctacttcagtgaaatttttgagagaatatctttaaaaataccctccagtatgaaaaacaattactctgttatgttctgtccctgagaaagaagcacaatgtttggtaaactgccttgattttggagaccacacatataaaaattagttttgttgctattattgcagtatgcaagcgtaagttggaataggataatacaggatagactttaccagtatttattactgattgccctgctctacctctgttctacagaacgactaggtgaaaaaacttaaaagctacataacactatttttctgaattctttgaagcaagtgctctgaatacaaattatcatttccctttatgtgcagggtaaaaatgagatagttatcattttcttg

SEQ ID NO: 75220 - DNA, 1006 bp, Homo sapiens
ctgcccctttcacctcctcaggatactgttcaatgccttttaaccagtcaaacaaatcagaattttgcccattaaaatgctctaatagcacatggacaggagttgtctctccagtaaattagctaagtatattttaggtacaattgtaaagtgtccattatttatagcatcattggcagtgccaagcaccctgtgattgtgcattggatatgagatgatagtgattgcctattaaatgttttaaacttgagttccacaagtttgcctcctggctcaacaggaagaaaatgacttttctacaggaaaatatataagatatgtactctatagccatgccagctgaaacatgacacatttccaaaggcttatatgacctttaattctataaagtccaaatatcagagtgaggagggatgggatactagtctaattgccacctgggttactactccaaactaggaggcggacagcagatggaattcaaccactctggaggaaagagaaaggagagagccagtcctcttaatagaaatgtgtaagacaacactcaaaaatcactttcgactagaaaatttgagattaaaacatgccagaaatggtgaaataccacagggggccaacattataaatataaataaataaataaatacaaagtgccaggaatgggaactagaggccaggtgtggtgcctcacacctgtaatcccagcattttgggaggccaaggtgggagggttgcttgagctcaggagttcaagaccaacctaggcaacataggaagacctctcctctactaaaaataaaaattaaaaagatcagccaggcatgggggcacatgcctgtagtcctagctgcttgggaggctagggtgggaggactggttgagctccggagatccaggctacagtgaactatgatcacgccactgcactccagcatgggtgacagagtaagaccttgcctcaaaaaaaaaaaaagaaaaagaaatgggaactggaagaaaaacc

SEQ ID NO: 75221 - DNA, 1063 bp, Homo sapiens
agtcatttgatgccttcagatgcatttcttttctgtttaatgtagctagattgtttctagtttttttcagccaagaaccctgacatgtagaggagtgatcactcattctaaaaaaggtcttgttaaggaatttttttcttccttccatgtttccctccctcttttctttctctacttccttcctttccttccttccctccctccctcctttcctgcctccctcctttcctccctccctttcttctttccttccttcctttcttctttccttccttcctccctccctgcctccctccctccctccttctggccttcctgccttcctttcctctctccttttcttccttctttctttttttcctgatggagttttctcttaaaatgtttatttattaaaggaagatataaaggagaaaacaaaagggctcataattatgcttcacaatagccttttgtggacagtttccatttctacttcgttaatgaaataactgccacatacatgtggttagaaaatctaaacagtgccagtagacatacactgaaaaggtgcctcctttcctagtccctccctcttaaggaaactacatttatataatcacacacagatacatcacatacttttaaaataacaccatttgtgtcattcattcattcattcatttattttttgggtctaggttctgttttagggatatactgatgagcaaggcagatataattcccatctccaaagagtttacatttgtggggcatacagtaaccttcatgaggaccttcaaatgcatcccttttccttgcccaagttctgatcaaattgaaatataaaagattgacagattacatcatttacctcttttattgctaaaggctatgttggaagatataggatagtgtgcaaaccgcatggacttcctaactcggatgcccggagttgggcacctatacccacctagtcaccggcagggctgaccatagccgacttccctattgcggggactgcctggtgaatatcctggacagaagagagctcctgttccctgtggacttctctctctaaaga

SEQ ID NO: 75222 - DNA, 1073 bp, Homo sapiens
atggcgaaaacctgtttctacaaaaattagccttgtatgatgatccgcgcctgtggtctcagctactcaggaggttgaggtgggagaatcgcttgaacccaggaggctgaggttgcagtgagtggagatggctccattgcactccagtccgggagacagcgagactctctctcaaaaaaaaaatgatgaactgtgtaattatagttgcctactgaacaactatcctgtgcatttggtaaagatcatttactagtgttttgggaaacattactttgatggaagaagtgcgatagcgttactaaaaatcgttctaaaacatggttgattctggagtaggcattcagtaaatatttaaactacatagaatctggtgtggtttggataggtcaaaggtccagttctgtaattctataacattctataatgagccttttttttgtgagaatcaagtagagatttaaagcattttgaaataaatcatctgctttttttttttcagttggactaaatgctcttccttcagaggattatccggggcatctactcaatgaaaaaccatgataattctttgtatataaaataaacatttgaaaaaacccttcagtttatgagtgttctaatgtgactggaatagctaattgtttatagaaatctttttctttttttttttgagactgagtccccctctgtcgccaggctggagtgcagtggcgcgatctcggctcactgcaacctaggttcaagcctcctgcctcagcctccaaacctagctaattcttctctttttagtagagatgggggtttcaccatgttgaccaggatggtctcgatctcttgacttcgtgatctgctcgccttgggcccccaaagctctgggattacaggcatgagccaccgcacccggcaagaaatcctttaaaaacttacattttattaccttctcaataaacttgtatcaatggcttattttctctgagttaacataaaatcataccagccagtaaactggtaaatgccaattttatttttatactttacaaaacctggcaggttcaggcctgtaatcccagcac

SEQ ID NO: 75223 - DNA, 1166 bp, Homo sapiens
tagctgggactacaggcacgcgccaccgcgcccggcggtcggataccggcgcagaatagcactagaagctgtggtatggtgacgtcatcaactgggccagcccacaacgcctctaagatttcattttactcacccagcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttggtgagaaatagtttgtgattttggggaagcgttgccgtggagcgctaggctgcttaaaatctcaagtagaggaggccacgggcggcacgagggagcacgccgactgggagtcgctggtgccgccattacaggcctgtactgtggcttgggagtcccgggatgcgggtagtagccgtctgagtgcggagtcttgtaatttctatgacctgcaaaaccgctgtctcttttcttacagtcgtgtctgttcaaaccggcacggtctgatccggaaatatggcctcaatatgtgccgccagtgtttccgtcagtacgcgaaggatatcggtttcattaaggtaggcgtctgcaggcgtactccatgttgtttgggcagagaaggttgtgggggttattttttccgcgaaagacaaacggacagatcttccctggagtggtaattctgagcattcgaccaagagcttttcctctttttttagttggtagctggtgacagtgttgatggtttgggcaatcaaattaatagaatggagaaggtgaaggacttagtctttcctactcccttttttacctagatagcttagccagttttaggtgccgtgtattgtgtttggtgaaattcactttagagaagccactaaaattgttttacatttgtttcatttatcaatcttgtaagtacctattctcttttttttttttttagagatagggtctccctctgtcgcccaggttgaagtgcagtggcgttgttacggctcactgcagcctcgaactcctcctggtctcaggcgatcctcttgccttggcgtcccgagtagctgggactaaaggctct

SEQ ID NO: 75224 - DNA, 1138 bp, Homo sapiens
cgctgttgttgcccaggctggagtgcaatggtgcgatctcggctcacggcaacctccgcccctccccaccccgcccaagcgattctccttacaggtatgcaccaccaccacgccaggctaattttgtatttttagtagagacggggtttctccatgttggtcaggctggtctcgaactccggacctcaggtgatccgcccttctcggcctcccaaagtgctgggattacaagcatgagccaccgtgctcggccttgcctcagttctttaggtcgacaaattagtcctccagtaatttaaacgaagtgtttcaaaaaggtatgtacttgtatgtgcgtttattcatatggaaaaagagtacgtggtggatttatatattactcatttatgtgtacggttttcctgtatatacttgtatagcactttcacttttcggaatgtttaacgtctgctatcttattttaaatattttactacagttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaactttttgtggtttttacttataaatagaattccatgtttagtgtagtcccacctcaaactttactaacaagtttatatatgtatgaagggaaaatactactttactactttttgttttctggtcaatttcaaatgttgaatgaattcataaacattgagcagcttagaaggatctttaagattttgcaagagaaggaacaagataac

SEQ ID NO: 75225 - DNA, 1038 bp, Homo sapiens
ccgggccccgggggtcctggggcccgagacctctcatttaccccgcgccgcctgcgctccacacatcctcgcctggcagctacagctcgagcatcggcgccgccgctaggagccgcggctcggcttcgtctccgtcctctccattcagcaccacgggtcccggaaaaagctcagccgcggtcccaaccgcaccctagcttcgttacctgcgcctccagcggccctgcgtcctctgcgctctcatccttacaggggccctagacggccagaactgagcgacgcggcctcgcctcactccggcggggaccgttatgacaacccgcaactgccccgcggcacaccgcggccctccggcccacacccctccggcccgccccttagaccgttggttggtgctttccagacgcgaccgaaggcgcctgaccgccgtggccggctgcctattggtttgcagtactgtcgctcaggtgcagttcccacttccgcctgtttcttccctttcctgttaggcgagagctgcgaaaggcgagagctgcgaagggccaggtgtcgggcgctgtttctcggtaagctaagaacgaggctgtagcggctccaataggagcctcccttgctcagaatcctgggtaggactaggccttcttaggaaagggaaggcgagacctatggccctcgccggccttagttcgagagcaggcttctcccttcaggaaaaaggtctcaggcatggcggctatagaatcgcggggcgcgccggcttgataaggacacgtcagccctcgaggctgctgacgggtgactgtgcttcggaggggaaaagtgatactacgctgatgtggttctcgtagaaggaacggggcgggtcgtaaccgtagctacaacgtcgcgcgctgccccagccattctctagagctggaaaatggaggaggtgggtggggggaagggggtcaaagaaactctggtccttaacttccttttcggaagaaaattagatgaaccgcacttttcttttggagcagtcacaataaattaaactca

SEQ ID NO: 75226 - DNA, 1794 bp, Homo sapiens
atgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcattttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgta

SEQ ID NO: 75227 - DNA, 1053 bp, Homo sapiens
ccctcttctctcatatcaacaataatcaattttagcagataacagattgagctttaaaaccctactcccaaaatgaaaccttcagttttaaatcttaatcagacataactggaaaagattactatgtatttggacaccttttacaagattttgtttttgtattaaagcagaaaccagttcctaaactcttttattcaattgtatgtcctgtttggacaaatatcaaaaatagaagactgtcgcttttgtaactgtgattttcactgcagtcttctataacttttacagagttcatggtccctaatatctccccaccctccattttttctaggtggggaaatggctaccacagtaaacttttcactgatagttagagtttctggaaacatgtattgtttgttattatttaagagtgactcaatttgggcactctgagtggatggtctacaggttttcttgtgatgcataccacagtctccagcatgaaagatcctaggaatttgaggaaccagcactttccagaattttggaagacaagatacagtcaagtattgaagagtccagtcccagttataatcatcataagtacagaaagtgtctgtgcactcgatcagcttctgataggcattccgggtcaaggctagacccatattgtgctctgtggatttccaagttttcacatctaccttgtcagccatgccatagaaactgcgactggcactataggtccccagggagagaacatcacattcagggcactcttgctgcttcagtttccacatctttttgaagacatggtaaaagtctggggctaagtagtgatcctcttctaggaaaagtataaggccagcataatctcgaagaattttcactctttcccacacaaaatgcagcttccaccaccagtgatgtttggtctgggagaatttggcctctctataatggccgaaggagtcgggatactcagcattgatgcaccccaatttcaaagcggcattcttcggcaggtctctgggacaatctctagggtcactacctggaaactcgttaggg

SEQ ID NO: 75228 - DNA, 1030 bp, Homo sapiens
aagagtccgcggaccggtccggaactgacggccaggcctgcgcttccgctcgcgagggggaggcgggacccgcgaggagtcgcgcggaggacggaggccacgatacctgcgtggctggggctgcgggctccggggtcaccaccctgggcgacccggaggtggcgcctccgccggccgcagctggagaggagcgtgtccccaagccgggggagcaggacttgagcaggcacgcggggtcaccgccgggcagcgtggaggagccatctcctggaggagaaaactcacctggtggcggaggctccccttgtttgtcctcccggagcctggcgtggggttcttctgcgggaagagagagtgcgcgcggagatagcagtgtggaaacacgcgaggagtcggagggcacgggcggccagcgctcagcctgcgccatgggtggtcccgggaccaagagcggggagcctttgtgtcctccgttactgtgtaatcaggacaaagaaaccttgactctgctcattcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggaggtaacagttctttccagagtcctcatatttgaaatatcccatctcactttaaaaatttgctattaccggccgggcgcggtggctcacgcctgtaatcccagcattttgggaggccgaggcgggcggatcacgaggtcaggagttctagaccagcctggccaatacggtgaaatcccgtctctactaaaaatgcaaaaattagccgggcatggtagcgggcgcctgtagtcctagctgctcgggaggctgaggcaggagaatcgctt

SEQ ID NO: 75229 - DNA, 3019 bp, Homo sapiens
ttggtagtcaattcagactcttgaataatggatagcagtttaaaaatagatattattactacatatcctttaagaaaggttacaaaggaagaatacaaagattacttatttactgttcgtattgctcattgtaatcataagttcttcctgtgggaataccatcagaggcagccttggttcgcctcttttctgcctacattcactcctttgctggccttctccagtgtcctctggctttaagtatcatctgtgtattgacaccttccacatttatatttccacttcaacctaccttccaaactccagactcaggtatccagttgcctacttatcaccatcccaacctaagtgaactcctgatcttcctccccacgagtgtccctaacctcttctgtagacttctccatgttagttcatgacaccttcatggtctgaacaatgattattccagttgttcaggccaaacactttggggtttctctcacatgttttttcaggaagtcccattaacttcaaattatatccagaatctgctctctctctatacctctacctccacaaccctctaccacagtggtccccaacctttttggcaccagggactgatcttatgggagacagacgccagggggggtgggggtgattttgggatgattcaagcgtattacacttattgtgcactttatttctattattattacattataatatataataaaacaattatacaacttaccataatatagaatcagtaggagccctaagcttgttttcctgaaaccagacggtcccatctggggatgatgggagacagtgacagatcatcagacattagattcttataacgagtgtgcagcctagatcactcacgtgtacagttcacaacaggattcgtgctcctgtgagaatctaatgcccctgctgatctgacaggaggcagaggtcaggatgtaatacaaccgatggggagtggctgtaaatacagatgaagctttgcttgcttgcagcctgctgctcacctcctgctgtgtggtccagttcctaacagaccatggactggtaccagtccatggcctggaggttgaggagccctgctctgccatcttctcggcctggattattacaatagcctcctaattggtctccagcttttactccttcccctccgtattctattcttttttttttttttttttttttttttttttttttttttttttttttttgagacggagtctcgctctgttgcccaggctggagtgcagtggcgcgatctcggctcactgcaagctccgcctcccgggttcatgccattctcctctccgtattctattcttaacgcagtgtgaaagtgatcctgtaaagcataaggcatatcccatccaccttcccgatcctggaaaaagggaccctcattggaaaaagggacccctcgtgatttagtgacagccgtatccttgcagtggtaatcaaggccctgtgttatctggctccgttacctctctgatttcctctcctccccatttactccagccacactagcctcccttctgttcctcaaggatgccaggcgagctccagtctgagggcctgggctccatctgttccctttgcctgcagtgcgcttcctctgggtatctgcttgactaagtccctcttccgcttcaagcctgtgctcaagtcacactaaattatgagcccggcctgttctgatcatcctattaatatgcccgccttctaggctctctcttaccacatatgctgtccctcttagcctgtctttttctttttctcttatgcttaattatcttaaaacatactatatgattatgttcgctttttattttctcagccccaccccctactagaatgtaaactgtatgagggctgggatcttttggttctgttcgctaatccctagaatggggtaggcatatattaagagctcaatacatagctgttaaatgaatagatgaatagacagactctggttgaagttttgtgtggtgaacagtgaatgtgggaatggggttgtattgtaagagattttacctttaaaattaatatcatttttttctgagaagtcaaattcaactactgttttcatttcagaattcagtactgtacacaggaaattactgtcttccgtgaagacttagtaaataaaatgtgcagaaactgcgtccgttttcctagcagcaatttggctattcctaatcacgtaagtgaaacaacttttttattaaactgccttacatgttgcattatataaaattttattaagccacttaataatttgtccttgggttaggacatttatttatggttcaaaatagtttgaacgtacttttgtcagtaagttaatttttgttagtgaagtcagtgtttctcagctttctacctaagtgtatgtcctttagaggacagagaaaagctgagaataagcatgaaatttctttcaagcttcgtgttttgccttttaaactcttaaattatacttgaaaatatatgtatatttgttttaataaactgttcttatttatcccattggttacatattttatatagtatgtccatatcacaagaatgtgcagtatttatcttgtagcttcgaggttccctgacaatagttgtcaatcacaggttacatacacccccatttgagaagtacggaaatagatgttacagagcatttttattattcattttataatatttaaagtttatggaccaggtgcagtggcttatgcctgtaatcccagcactttgggtggcttgcttgaggccaggagtttgagaccagcctgggcagcataatgatgtatatgttattaaatgaaaactcatagattttttttcctaaaatacagaatagtttatttcacttttaaattagtgtctcccaaagctctgtgagtcaaagctttcctagtttctcaaattttctggttccttttggtaattaatatttaatttgaaattatttgtttagctattttcacttttgcaaatgaactga

SEQ ID NO: 75230 - DNA, 1030 bp, Homo sapiens
acgccattctcctgtctcatcctccagagtagctgggactacaggcgcccgccacgtcgcccggctaattttttgtattgttagtagagatggggtttcactgtgttagccaggatggtctcgatctcctgacctcgtgatccgcccgcctcggcctcccaaagtactgggattacaggcgtgagccaccgtgcccggccgtttagtcagttttaagacacagatatagcctattattttatttactgcttccatattgcttatcttgttttagaatatttagataacctttgtacttttaaagtgttacaaagagtacctttttacactggaaaataacttcattagatacaaagaagctaaatgtatacaactattagaaaaatatctctagtggtatatagaagataattatgttataattatctagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctggtaggtcttattttttttcttctttcttgaactcttttaagggttcatgttttaaaactttttgagtattctatttatctttttgagtattctatttaaaaaaaaacagagttagcaatgagataatttaaattagatttcattttaaagacttaaatttttacattaagaaaaaaacctgtgtgtgtgtgtgtgtgtgtgtgtgtgtgtgtttatagtcatgataagtaagaattagtcctgaagttcaagaccagctggacaacatagtgagaccccatctctaaacaaaaacaaaaacaaactgggtttaagtgcaagcctattaccctgggcaggttacttaacctaagtctcagattttatggatgttctgaggagtaattaagccaatgcaggcctggcctatagtaagtgctcaatgaat

SEQ ID NO: 75231 - DNA, 1092 bp, Homo sapiens
tgcatgcctgtgatcccagctacttgggaggctgaggcaggagaatcgcttgaacccaggaggcggagcttgcagtgagctgatatcccaccattgcactctagcctggagaacaatagcgaaactctgtcttaaaaaagaaaaagaaaaagaaaaagaaattgtgtgcctggcctgagaaaatgtgaaaagtgtgttattacaaatacttataatgcaagttatcatgttcacctagagtacttatgttttagtaaatcaggtctgtattttgtgggatgtttttcagagagcacgttttcaatatcataggagcatttgatattccacgctttgtgtacaattcagaaagaaaaaaatttcttccgtaagtatgtcatccactgattttaaattaatttcaaatgtactttttttttcagaaggtatagtctcttgcttcacttttggctcacctttgtgtattatgatagtcaaaaataggcattctctttttctagtctgttaatgaccaaccaccctgcaccaaatttatttggaacaccaagagataaagcagagatgtttcgtgagcgatataccattttgcaccaggtaagtttggtagggggcggaggggaggatactgggtaaaatgagagaaaaggagactgtttcagtttagggaaatctcagggatatttaaagaatggaattttgtggtccaaagttggtcattcaataaactgttattaagatttctgtgattgagactgtgtagaagatacagagatgaaaaagctattttccccttaacaacaatgatgatggtaaaaatagtagttactatttaatacatgatatgccaggtagcacttaacatacattatttacctcatttaatcctcataatactaataatgtgtaaatgctattattcccattttacggatcaggaaactgaggcttaaagaagtttagtaatttgcccatagatcgtatatagtaagacaggattttaatccagcctgactctaaagcccaaccattgcctactatactttaccactttcaagtagcttacagtctatgaagttatagacatttgtgcaa

SEQ ID NO: 75232 - DNA, 1034 bp, Homo sapiens
ctgaagcatttaaatatttattttcttttctttttcttttttttttttttttgagatggagtttcgctcttgttgcccagggctggagtgcaatggaacgatctcagctcaccgcaacctccgccccccgccccgggttcaagcgattctcctgcctcagcctccctagtagctgggcttaccggcatgtgccatcatgcctggctaattttgtatttttaatagagacagggtttcccatgttggtcaggctggtcttgaactcgcgacctcaggtgatccgcccgccttggcttcccaaaatgctgggattacaggcattagccactgtgcctggcttgcattttaaatatttctaagctatttttagtggcgtttctttactaatgactattttttctagtctcaaaatagacgcatgttagcaataatatgctaagaaatattatgctttaaaattcttactacaatggaggtttgagcgtatgtgtgtgttgtgtgtccataatcacagaattatagaagcaagaatggtaaagctggaaaacaggaatactatatgccaaccctcttagtttacagattttttttcttaagccatctggaagttctactgatagtagaacctacatcttctgtctccctaccattatgtgacagacctgtaacgtgactgaatcatattgaaatgaccaacatacaggcatacctcgaagtattgcagaatacttcgtatgactgcaataaagcgaggtcatacgaatttttttggtatctcagtgcatataaaagtcatgtttacattgtagtgtgttaagcatgcaatagtattatgtgtaaaaaaaaaatgtacatacctggctgggcgcggtggctcacacccgtaatcccagcactttgggaggctgaggcgggtggattacctgaagtcaggagtccgagaccagcctggccaacatggtgaaaccccgtctctactaaaaacacaaaaattagccggacatggtggcggatgcttgtaatcccagctactc

SEQ ID NO: 75233 - DNA, 1105 bp, Homo sapiens
cggaggcgcgggcagaggcggcggcggcggcggcggcggctggaggacccggcgctgggggcgctgagcggcagcctcgcttccggagctcggcgggcggcgtcagcggaacgggcggcttccggccgcggcgtaaacaaggccgtggactgcaggaggcggggcagacgggctgcaatagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaaggtcagtgagtggccgggccgcgacggacgtcgctcggctgtgactcgggtctgcgttcgcggccaggcggggaggccagagcgggccgccgagggcgctccccgcctgcgtcgcgcgccccacctcagactctgcccgttggttgttttttttttgcgcgcgggaatcttccttctctcgagtaccccaacccgtctcgaacctccagggctgctgtcatgtcaccctggtgctcacaaagccaactcactcccacccccgttgttgccattggagcgttattccggggaaggccctgttaatgttgcttgggcggtgcattcggaagggttggggtgtgaaaggtgacggtgtgtgatatcactcagacgcgttatgaggacggcctacgaggacttcaccctctggagctgggaaccgctgcccacttacagggaggccgaggtgtaggaaaactggaattccaaaagg

SEQ ID NO: 75234 - DNA, 1049 bp, Homo sapiens
tacatttaatttattccccctcaggaaaaaaatcaacactgaaggtgatgttcctccttctatgtcaggaagctgtgctgtgtgtgtagacagggtgctgtacttgtttggaggacaccattcaagaggcaataccaataaggttagtgtttctaaggattatggcttgaggcatttttattcttattatctttcaaacaactgcaaatttctaaggttagccccagacttatttgtgtcacagttaaaaatgatgtgtacttgattatgatatgaatgtgcattttagtattttgtgtgccaatctgtatttacctaggcattatgtaaaatcaacttttgttggtaacctgtgtgcagtaacttcctgggtggtttttctttgtgctttttgcagctacttgttctcttagaaccttaaatgttagatgaacattagtaataaaattgcagacaaaatgaagacaagatgtaatggagggaagggtaaaaatgagcaggcaaccagtcagaaagctgtaaggataaattaaaactgacaaaactttacatgttaacattcctataaagtggtgcccaaagacaatgctgttcagactttgccgtattttgttccaagtaggaaaaaatatatcacttcttctctttcagaccaataagagacagattaagtcaatcagaaatgatacatatgacatatattagcgcttactgagttgccaaataaatgaatccataggagtctattaagttggcaacttagtaagcactttatgtgctgagcacttggctggacactggagacagaaagaatgatatagttctcacctcctggaactcacattctagaagggacacatatagtaagtaaaccactgcagtagcacctgctagagagatacacagcacctggcatatagaaaataactcagtaagtattgttgaaactgaaaactttgacattgtatttggtgggatgagggaacagaacaaggaaaatcttgaccgaagaggtgatgcttgaactgaataataaaattggaaggagt

SEQ ID NO: 75235 - DNA, 1049 bp, Homo sapiens
acaagtaagttggcagcactacaggtttgggtttttatgtgtaaagtggtttaccattcaggtatccttagccagtaaacatttgcacagaacatacctcatagggcccatatgaagattaactgaattaatacatgaaagcatttaacacagcacctaagataaactgcttgtatcctatcctatgggtatttgaatttttagtgtcttggtttttcatccaacaggttaatattttttggagggtatggatatttgcctgaagataaagtattgggaacttttgaattcgatgaaacatctttttgggtaagtgaagtttcatatttgcatatggcctccttagtatgttgaaataatacattttataagttttgtgcatttttctttggtaatcaggcaggctgtctaattttataaatatcatttctaaaataacgcggattcttattttctgtagaattcaagtcatccaagaggatggaatgatcatgtacatattttagatactgaaacatttacctggagccagcctataactactgtgagttactaaagaataatgaattgttaaggatacttagaggcagtggggaggggtggggtaggggagaggggtgcaccagagttggaagatactgtgaaagtgacagttcattcttgttttctggggagaagatccataactttaatgatttccaaggactctagaactcagaagtttaatgaatgtatgaaatgactaacccagcatctattacctaataatctaatactttttttttttttttgagacagagtctcgcactgttgcctgggctggagtgcagtggcgggatctctgcttactgcaatctccacctcccaggttcaagcgattctcctgcctcagcctcctgagtatctgggattacagatgcccgcaaccacgcccagctaatttttttgtatttttagtagagacgggtttcatcacattggccaggctggtcttgaactcctgatcttgtgatttgcccacctcggcctcccaaagtgttgggattaca

SEQ ID NO: 75236 - DNA, 1047 bp, Homo sapiens
atccgaaatgctccaatgagcatttcctttcagcatcatgttggcactcaaattttcagatttggagcatctcatattttggattttccgattacagatactcaaactgtaattaaataactctgcactatactgcaatttgtattacttaaatattagatttcttttccctctgacacagataattatatttcttttccctttgacgcagatattatataatatgccagcctttattttaaaagagaaaaaataaagcagcctattgtgttagccagcccattcagtaacacatttcaaaaatagaaaattaaaatgcccagttttggtagtcagcttgtagtacaactgttgtctagaagtctacactcccaacttttaaaagctcaagtgccttacatattcttatcccatatccagagtagacataggtattttccctgtttataaaaagttcactaacttgcttatgtgcctctaatagggtaaagcaccttcacctcgtgctgcccatgcctgtgcaactgtcggaaatagaggcttcgtgtttggaggcagatatcgagtaagtattcaaacgacttcaatgacttgcttttgaattcttcaaaatgataacttaattatccttttttaggatgctagaatgaatgatcttcactatcttaatctggatacatgggagtggaatgaattgtaggtatcactttagatacatttttccaaaattcagattgtttttaccctatattccctactattggtatataatgtccttgcttaacttttctttaactatgaaattaaataaacataattactaggtccttaaggaatgaattttatttttgtgtttccagttcctgtaactatgtgcctagtacatagcatgtgctcagtgtttgttgaaaggaaaaggtctgaagttgattctaacgtcaaagaaaatatttcagtataaagcatgtagtttataccaagaagcctttttaaacttaaggtctcttttttcataacatgtacatataaattttaaaagaaaactta

SEQ ID NO: 75237 - DNA, 1055 bp, Homo sapiens
ttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctcatgactcagcttaatcatttctattcatttgtagaccttcaggtttgatcttaattttttccttgtaatctgattcagttctgtaccattttaatttccacctttagtaattaattaccaatatagcacgttagagtatcttaacctataataccagaagcgcattttaggcttaccactaaagactctaacccacttttcctctgtctcttaacagaatggaaaatgatgtcatcattatttccattccttcatgagctataaaacctattaattaaaaaaaaactttttaattgactggacagcacctgcctgtattcag

SEQ ID NO: 75238 - DNA, 1232 bp, Homo sapiens
ttattattgcatcattttaatccacagcaggtttctgcaactcaggtaatatccaatagtttttttccttttttttttttttttgagacagggtctctgtcacccaggctggtgtcacccagtgcagtgacaggatcatggctctccacaacgtctacctcctgggctcaggtgatcctccccccctcagtcttccgagtagctgggactacaggcacccactatacccagctaacttttatattttttgtagagatggtgtttctccatgttgcttaggctggtcttgaactcctgggctcaagcgatccacccgcctcagcctgagccttccagagtcctaggattataggcgtgaaccactgctcctgggccttctttctcttaaatgtaactgtaggtaggattttgaaaattattgttctcattacttattatgctaggcaaaaattaagtagtaaagaatatatttaaacattggtcttcaactctttggaactatgaagcagagtttaagtaccactgttccagcttagatggtatgtatatcaggaaaagataaaaaatatgttgagatactaattcaagtgttttagcattttttgtaaagggcggtataaattgcctttgtaactgttattttccctttttaggaaaacctatttgattctttgacaggccagccacatcctgaagatgtactactgtttgccattccaatatgtgccccttacaccaccatgacaaactacaagtaagttaccattagttgacagaatggcttttgtgaattgttttgtaacgtctatttagtaacacatgtaattcctttttaaagatataaagtgaaacttactcctggagtgcagaaaaagggaaaaggtatttaaatttgtttttttgaattatgattttaaacagttcagtgacttaacagtagattattcttactcttttttgtatttacagctgcaaaaacagccttgaatagtttcatgcattccaaagaagcaacagcaagagaaaaagacttattccgcagcgtaaaggtaaagttctccttcagaaaaggaatgtggagactgacagtacaatttaaaatgttagcagttttttgttattttagtagaaaatgctgtcttattagaagcagtaaaaccatctcagctaaaagtttggaaatgtttttcgtttttgtcataaaagaaacatgattgaccatacaggatgtg

SEQ ID NO: 75239 - DNA, 1153 bp, Homo sapiens
acggcttaaaatagaggccagataaaaaatttttacctttgtcaccagcattttttttatgtaaagcttgagttataattgtgtgctcagtttagtgcaggtaatgcttacagggattctgtattactattttcttttttttcctgctgaacagttgttgtttagtaatactaaaactcgttttggcttttaaaatttgtacaatatccttatgttctgtaaatcctagactcacaaatactcactagaggtgttaattattaatgttctttcatgagtaggtgctatggtctaaatgttaatatccccccacaattcatatatgggaacctaaatacccagtgtgatggtattaagaggttgggcctttaggaagtgaagtcacgagggctcttctgtcatgaatgagatgagtgcccttttgccacgtgaggacactgcaataaggtgccatctttttttaagatgaggtctccctgtgttgcccaggctggtgtcgaactcctgggctcaagggatcccccgaccttggcctcccaaagtgctgggattacaggtatgagccaccacacccagcctaaggtaccatctttgaggcaagcccttatcagacattgaatctgctggtgccttgatgctggacttcccagccttcagaactgtaagaagtaaaatttctgttgtttctaaattatacaggctaaggtattttgttacagcagcctgaacagactgagacagtcagttatctccagatagatttttcttaagcaaacaaaattaagcatattttatgggatatgggaaaaatttatccaaaactgttgaacagatatttaaaaataaaagttctgttgaccaaaattctccatttgcttttctcctggcaaacttatcaaccttagttgtcattttaaattgtacttgtaacttttgctgctttaacatatactttatatgaaagtttcagttcccacctcctctacttcagagaactacccttcttctcttgaatgacattactttcttaagtaataaaacagacacacacaaacacatatacgaatccacttcagagtcttaggaagaatataaccttgaggccccctatcctgtgggtcagaaatgacagtctggttgtatcactgtttct

SEQ ID NO: 75240 - DNA, 1050 bp, Homo sapiens
agtttaaaacccctagagtgatttggggatgtaatcagggtaaagaatcattggtttatttaataaaatacagagtcttgaaagcctctagaataagtgcctagcctagctttgctgctttatttcctgttcttcctccatgtgtaccctgacccaaaccaaatgtgatgacttgctattactgttctcttcctttttagacttgcttttccaatactgttttactttatttcttcctcacagttctttatgttttgttaatgtattcttacttctctgtgtatcttctctccaccctatggtaaattccttgaagatgaggacttcagttatccaactttgtagccttcatattgtttattataatggtgccttattcagtaagcatttttgacagagaatataaagtaacaccatttctttgcaagtatttgttgacatttttttgctgctgaatatttccaaccaaaatcttctgattttgtagagtaaaatgaaaaaaatgaaagaaaaatacaaagaccaggatgaagaagaccgtgaacttatcatgaagttgctgggggtaaataacatctaaaaacattttttcttttgcttttcaaatgggcatctagcccactgcctagcgtatgacaggcattcaatacattcttgttaaaatattcacagtattgaaaatacaacactgactgatgtttcctctatgaattaaagtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggtatggctactttgtgggcttctgcttcttaattagggtgattacccatcctggagttcccaggacatgggactttcagtgctaaaaccaagacaagtgagtaaccctattcttaatggaatgtcatccagaaat

SEQ ID NO: 75241 - DNA, 1128 bp, Homo sapiens
atgtaatgaggacctgaactaagacgttggcattgggaacagaaagaagaataccacagtaataaaatttacccttccttcttaacctgtgtatttttaatccatttagtcaaccaaccggtcaacagatgttttattgaatgcctaagacctgccaatgctatgttggtacaaagactacaaatcccagtgcctggccatcaaggtgatcaggggcaaaatgtgcctagtgagtaaggatgagtcaggggtgacaatatgttgagcttggatgatggaaagaaagataaatccatgagagatgaaaaacttgcatctttttcccacatgatgattttaagcatctttgtattttctaacttggtgattatcaagtgaagcagaagccatgaccatttatatactgtatatgtgccttccccatggaacttttttagggcactaagaatttcaaattctaagaatgaaatgttttcatgtcttttttattcagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaaggtaaacttcaggatgatctatatggttcacagttaatttgtgaggttcctttttaattttttaaagttgaagtgaaatagaaaatgtaggccaaaaaataatcctgtgtgatttcctttgactaaaaattagttgagtagatacagcatttagggaacacagagatcactattagaagttctttagactttcaagatcatctgcacagaagctctcattttatctggaagagtaataggagattatggcttgccaaagtcacccagctagttaagtagcagagctgatatttattgagaatttagctcagtaatttttagattttggttagagttcttagatattttgctaaaggtggatggtgaagaaagaagtacttatgatagaacatactctttccacactgcccctgcccccacctccccaccccccaaccccgctgtcagctcccccaagatagtcttgctctgtcacccacgct

SEQ ID NO: 75242 - DNA, 1001 bp, Homo sapiens
aggcaggattgtctcgatcttctgacctcgcgatccacccgccttggcctcccaaagtgctggattacaggtgtgagccaccgcgcctggccgattttttttttttttttaatagcaggtctcaggaagcaagtagaagcaagggaagggcggaagggaagggaacaactactgtagggtgggaaagactaagcaaactaaagcactccaggaagaggccctagaacagaatggacaataaagccttttcatttgagaaacataatcattgaacaattacagagaattctgagcacatagccctgtgctagatacttactgagtatacaaagaggtgaagtataaagctcatgccttcaagaagcttttgagtcctggattcaggaagtagtcataaatatgtaaatagtgtctgaaagtgataaagtagttcaagagtaagagattgctgtgagttcagatgtttggggaaataacatcagaagtataccttgaaagatatgttagcagttaagtaaatgaaggagggagactccaaggagaattagcattaacaaaggggagtgcttctttggggtaatatgcatagtgctttggggaaatgataaatagactgagttggaaggaagagaaagtttgtgtattaaatggtagataatatgattggagaagtaaatttggactaaaagtggagtacttaaaagctaaggattttggactataccctttaaagtgatacgaagagaatgtgacataggcaaatgattaaggaagattaatatagaagttaatggccggatgtggtggctcacgcctataatcccagcactttgggaggccaaggcgaatagatcacctgaggtcagaagtttgagaccagcctgaccaacatggtgaaaccccatatctactaaaaatacaaagttaactgggtgtggtggcacaaactccgttttaaaaaaaaaaaattcagagtatgtagactctggaggaagtctggg

SEQ ID NO: 75243 - DNA, 1120 bp, Homo sapiens
ttattttctattctcacaaccatccttgtcagatgagtggtggcatctcattttacaggtgaggcagtagaccctgttactactattagacagtgttccttttgcagaagaatgagcacctgctatgtgggcgttatataatacgtatttaagtttttatgtgcaaattataataaaagcagcaaaagttatgcaactaattttgctgtcttggtttttggaaatacccaactaaggcagagttgtggttttcattgttgaaagggtagcaatgtccaagaaatttattgtggtaaaggatcttggagatcatttagttcaacctattcatgatacaggttattcttttgtctaagagtaccctttgggaatgatcagacacttttctgttgattttttggagaaatatgggagaaacagtggaatatttttatgacatttttaggaaatcacctggcttggttggtagtcccacactgactttccttatgataattctacagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtaattaaaaaataaaattttacatattattgtgtaagctgagaatgatgatgaggtaatccttacaaagataataccaagattgacatcagtacttttacactccattgtcttaatactttttcaacatttgattgggtctctctgcaaagaaattcccaggaccagggtagaaaaatacagtgcatatagagtggccaaactagatccaaatagaaacaagtaaatggttataaatgctaaaaacataacaaaggcaattccatcaaagaaatgtgttttagtctatataatgttttgcagatcatcaggtgaatagtccatagttataaatgcataa

SEQ ID NO: 75244 - DNA, 1949 bp, Homo sapiens
cttagttttctcattacatctcatgctggaagagatgagtggaccagttctggctgtcgtccatggcatttgaaaattattgccgggcatagtggctcacgcctgtaatcccagcactttgggaggccgaggcaggcggatcatgaggttaggagttcaagaccagcctggccaacatagtgaaaccccgtctctactaaaaatacaaaaatcagctgggcatggtggtgcgtgcctgtagtcccagctactcaggaggctgaggcaggagaatcacttcaaccaaggaggtggaggttacagtgagccgagattgtgccactgcacttcagcttgggcaacagagtgagacttcatctcaaaaaaaaaaaaaaagaaagaaaattattgatgtagtggattctttgtttttttctttgttacttccaaaggcttatctgtcattaaaggggtatctttccctttagtattgagaatttgtacgaaattataaacttttcagaagacagtgtggcttacttgactctgactttactttctcctcaagtggaaaaagaaaactagagtatttttttaaataagaatataatgtattattgtgttcttcaggtatctaaaacagcaccaactggagaatatttgacaacaggaagcttcatgataagaggtaatgtcttgacaggaaaaatatcactagacttgtcaatggattatggagacaggtttgagacagtttacaaatactcttagaacaaaaacaaattactcggatttcctatgtgaagtctgctatgaagtaaagaaatttttgccttggtgtgacaagtttagtgtttgtcatatcttcttcatgtatatttttattgagggcagtgcactttcacatagtttagttataagggtaagaaaggatagcctgaacttatttctgaaaatagaatattcagggtctgactgacccagaatatcagagcaagtgtgtatattttttacttcttaataactgttcctatacatactgcccagttctataaatgggaaatgttattcttgacatagtaaaagacaaaatggatatgaccattagtgtcatctgacactaatttttttttgttttacaagcaaaaaatggagaagactgattttcaaagcattaatgtacgttatcttttgtaggaaaaaagaattttcttcctccctcatatctaatgatggggtttagcttcctttttaaggtactcttcaacttcttggttatttatttgtttttttcctgattttcattagtcttgtctgaagctccgtcactgaaaaataactgtttctttaggtagatgagtcttgtgtttggagacatcagggtgaacgaaaagtcagagtacaggatgaagacatggagacactggcaagttgtacaagtgaactcatatcagaagaaatggaacaattaggtagtttatagattttaagaaattagcttgtgatgttttttgttacctagttttgcttctaaatccttagaagatcatgtctctttgggataatctaaatttcaaaaaaaccccgaaaacccaaagtacgtgctgttttactgaatttttttttttttggaaatgctaaatatacttattctagtgaatttaaaagtatttatcagtccgggcattgtggctcatgtctgtaatcccagcacttttgggagtccgaggcaggtggattgctagagctcaggagtttgagaccagcctgggcaacatggcaaaaccatctctaccaaaaaaatcacccaggcgttgtgagcgcctatagtcccagctactgaagaggctgaggtaggaggattgcttgaacctgggaggcagaggttacagtgagcctagatcacgccactgccactgcactccagcctgggccacagaatgagaccctgtctcaaaaaaaaaaaaaaa

SEQ ID NO: 75245 - DNA, 1038 bp, Homo sapiens
aaatagtaactttttataatggtgaagtaaaaatgtattagtatttaagatatgtgattgaccggccgggttcggtggctcatgcctgtagttccagcactctgggaggccgaggtgggtggatcatgaggtcaggagttcaagaccagcctgaccaagatggtgaaaccccatctctactaaagatacaaaaatttagccgggcatggtggcgggcgctggtaattgcagctactcgggaggctgaggcagagaattgcttgaacccgggaggcggaggttgcagtgagctgagattgcgccattgcactccagccagaacaacagagcgaaactccatctcaaaaaaaaaaaaaaaaaaaaaaatatatatatatatatatatatatacacatatcattgaccctgtcatgcggcatgtgattttcatatcttgctctggagaaagtccatactttggtattgaaacattatgcattgttattctaggagaacccatccccccacggaccttgactgaagctggcacaatggcactttgctacagtgctgcttgggatgcacgagttatcactagtgcttggtgggtgtaccatcatcaggtaataagggctcttgtcctttttcttaatttactaagagctactgtgtgccaaattttgagagtatagaagtaaataaagcagacaaggctcaatagagctaactctttttggtagaggaaaatatgtacataatgtcaggtaataagtgccataaaatagtgtttttaaaagcatggaaggggatagagagtgataggggataccgttttggatgaagtattgggggaacctttctaggaaggtaggatttgagcagagaggtaaatgaagagagagtgatccacacaattatacaggataaagagtgttccagttattattgattattattggcatactgacctaaaaggcctttcttctgttcatctttgttggaatattctgaattctcttgggcacttccagaaaagtaggcatatcctgtttgtttttt

SEQ ID NO: 75246 - DNA, 1094 bp, Homo sapiens
ttttgagaaaagttgtaattttatcctcctaaggacaatttttggtcttttgtatttaaaaaaatgtaaagaatatcatattaaagattaattacgttcatttattgagagcagagtgggaaaacaacatttctttcttattagtggtctaaagcctattcagtgcctcactaaaagaaagctaaacctaaggaccatatgacattttatacttttgctttatgaaatttattgttagaagttgagtttaagaaggctatatggagtaaggagataacttttttaaacatagaatttaatttcttttttctaagactgtctaaagaatatcctagggcaatttgtattataggtttttagtaaaattaagcttgatgccttaaaaaaattaaaccatcaacttgtcttaaatagcttcctgttttgttttgtttgcaaaaagggtatgaattcaggcagctataaagaaaagttaactttttttctttcattttgataggtttgagaaatttctgtggttcattagctcagagaactatctaattataggtggacgagatcagcaacagaatgaaataattgtgaaaagatacttgacaccaggtaggtaagattaaaattcggaaaaattttctcttgaatgtttggatcagttatctcaatattaggcattgattttcttgttatactcttctgtttgatagatttaactagtagaaagatttgatgcatgatgcttcatggtttgttgcatatgtgttttgatgcttttagttcttaagtgaatattcctaaaatggtattgctgagctaatctgcagtgttggactttcagtacattacattaacagaataactttcagtcttcaaagttattgtaggtcaaatttttaaaagcttactgtagtggtgttaaagtttgcaatcatttttcacacctagaagtaggacttggccgggcgtggtggctcacgcctgtaatctcagccactttgggaggctgaggcaggtggatcacctgaggtcaggagttcaagaacagcctggccaacatggtgaaaccctgtctccactaaaaataccaaaaaaattag

SEQ ID NO: 75247 - DNA, 1402 bp, Homo sapiens
tgggggctttgtccatcttgttcactcttatatctctaatggcatctagcctagaaccaagcatatgataggtactcagtatctagaaaatgacaaggtatttattactttgtaggtcttgggcaaatattttcatgtagtaattctttagtttagattattttaatacttcaggcaaaaatattttcatttcttcattactttcaagtatgcgtatttgtgtgtgtgtgtgtttgtgtgtgtgtgtgtagattgtgccattttgtgacatttaaaaaaattcttgccccattatttactttggtgttatttaaatacattcttaacaaattgtttttaaaactcttttctataaataggcattcaagtcagcagaaaagaaaacaaagcaaacattaaaagaagttcagactgttacctctattcaaaaagcaagaaaagtatattggtaagtgttctgtctctttcaaatacagtttttgtttttattaaaattatccatgcacattgtttagaaaagtcaaacagttctacaaagcttgttacaaaaccagtagctctgcaattttttgttggtttgtttgagacaggttctctgtcacccagggtggaatacagtggcatgaacatggctcactgtagcattgacctcctgggctctgacagttctcccacctcagcctcccaagtagctgagactacaggcacatgccactgtgcccagctaattttttaattttttgtagaggcagggtctcactttgttgcccaggctggtctcaaacttctaggctcaagagatcctcctgcctcagcctcagtgctggattacaggcatacgcttctgcactcagctagttctccagttcctcacctttactcctattgcctgctctccgaaggaaaccacttttagctcttttagttgattcttttgatatttgcctttatttatcttagtaatatgtttatattgctacttcttaatttttctgttttatattcttactaacttcccactgggaaagatgaggatttccctctttccacttgtgttccattacatacacacacagttacagcataattttgtcaagattaatagcattggcatcattataaatatttaaattgtagtcatataatttatatgtcatagctgacccacatagaattctgttttctttttccttccttgctcagttttaaaaatcttccctggagttattaattgtcatttcatttgctttttatttttgttcttatcactaatttatctaaataatatcttccaagtgtgttcagacacattggaattcaatcagtatcatcttgcagaggtcagaagtctctcctggagctttttgacttacttaattttatattggttctctctaagcat

SEQ ID NO: 75248 - DNA, 2135 bp, Homo sapiens
ctctttgggaattcattccctgccaggtgcagtggctcaggcctgtaatcccagcactctgggaggccaaggtgggaggattgagctcagacattggagagcagcctgggcaacatagcgggacccggtctctattatttaaaaaaaaataaagaattcgttctcccaaactttacttttgtgccataggaaaaaatgtcttgatttctgcctgtttgaataatgccaagggtattaggggtatatcttatatacacagtaacctgtaatcaaaatacctttctatataaggagtgggagttaggaagacaggagaagtaattttggggcatggaacgcattgtagtgggataggcctagggtggtagactatgggaacttcagctagctagataacagcatagatggggtcaggatagtgagtgttgggaagtaagagagggatgtcatgaggtaggagaaatctaatttttaaaaaatctgttttgccaataaaaggaaaagcaagcattgaagaaattagataatgttcgaaaggatcacgaaaacagattggaagctcttcagcaggctcaggtattatgtttggctttctcagtgctttttcaaaaatgttaactttaactggcaatgtagtaaatgtgtgtggtttgttttttaaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaaggtaagtttgactcttagtcaagcagttaatgcttgtctttattttgttattttaattgttcactgtattaaacattttttcttcatattttgaaattctcaaagaaagggaaaaaactaatttagattaaaataaataatgaaacttccagtactgtaaaccatttataattttattgaagaagaaaattgaaaataaaagtgatgtcattgacgttagtgaaatgctattgaatatttttaatagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtaagtcatttaactttacattttaggccaagtgttatctgcaataaattaaggaattaaggacattttaaaaaattttaaatttcacttgtacatgcatactttttttgggtgaaaatacttttttaaatttagttttgttaattatacagtttgttctgatttgttctgtataatttgagaatttgtcaagttagaactaagtagaaaactgaagaataaatattatacttaaaatttaagagaaatatgtttttctaggtattatgatcacaagagatatgctgctaagaaaacacaaaagactgttgaagctgctgagaaggtactgagtatttcttagagtgaatgttagttgtttgtgcctgcgtaatttaatggacataattatttcttctgtttaaatgaggttttctaattcagaagtatctttcaaacttaactttgctttaaatatatgtatttccagtattttttccccccaggactgctcctcccctattcttcctcatctcagtaaataacaccttcatttttctgttcactcaggttaaaaatgtttgtgatatcctggactcttttcccataaatcatgcaatccatcagtaaatcctttggttctttctttaaagtacagccagaatctggctactactcattatttccactgatcagtcccctatcacctctgtgttcacatggactatgacaagtagcctcttattggatctctctcctcctcctcttttcccactacagtctgttctccacatagcagccattgtgacccttttttttttttgcgatggagtttcactcttattgc

SEQ ID NO: 75249 - DNA, 1019 bp, Homo sapiens
tatgtattattaaaaacacatattaaaccagctagtctttagcggcttgatgggtagatgatataggaaagggtagcctttcagaaagagtgtaagaagtagtatgggaactctctgacctgcctctttatttatgataaaggtttatgaagaaggtccatgggggattttattgttgaaaagtatgtcctcatttgtttcatgagtatttcagatattctgtaaaaaaaggaaaatacggtgggaacgtgaggcctgttatttacaccttaatgtggtttgctcagaacaacccaaagcttctcaaacattgctgttaaggagatactgttttagggagattttaaataggccagaggaggggatattgtttatcattaaactgtttcttttttaaatggactttaaagccaagtcttaatatgttttctgtgtatcatgactccaaaagaagtgatatacagtattttcccagcacatttgaccatgtttttagagcatttgctgcagaacagtttcataaattgttaatagtcactcttgatttgaaggggatttgattttttcaaaaacagtcttaaaatatgtgtgcaaaaatttcaaattatttgaggctgggcgcggtggcgcacgcctgtaaatcccagcactttgggaggccgaggcgggcagatcacttgaggtcaggagttcaagaacagcctggccagcatggtgaaaacctgtctctgctggaaatacaaaaattaatggggtgtggtatgggtgtccagctactcaggagcctgaggcacaaaaattgtttgaccctgggaggcggaggttgcaatgagctgagactgtgccactgcactccagcctgggtgacagagtgagactctgccttaaagaaaaaaaaatcaaattgtttgaatccctgtaccacttcctcttcagtttttaaaaattagttaatcatagcacaatttcaaagcaggtaggccagtcagatgaattatatacatcatgtaattaccaca

SEQ ID NO: 75250 - DNA, 1023 bp, Homo sapiens
tgttttgtttttgtttgtttttataaaatgactctgatgtttatatggagcaaaagcatgtgaaaatgttcaggataactctggaaaatactagtaatgatttattactgtctgtgtaacccttcacagattaaaatatgaagctatagtaattaaaactgtaagtttttggagaaggaatagcataaagattccaaaaataatttgaaataatatgggaatttagtttatgaacaaagttcctttcaggtcatggagggaaaggtggatgattcaataaaagctacttggacaacaggctgttcaaaatgaaaccatatatccacatatactggttataaacatgaaatcactatctctaattttcttgaacgcaacattattttgtaagcactttcctgtttttctacatagttgtttagccacggttaattgacacttgattggcactccttttttcctttttttcccccaccattagatattgaaaaagtacttgtttctctgcagaaagcagaagactatatgaaaacaacatccaacttcagtgggaaggtagcaccatgtatacttactatatattgttgtgatttatttgggttttcagaaattaaacgttcattaaaggatcattatatatacattttattttaatttggaaaattgttatctgtaatatgcttattccaggatagtttttttgttttgttttttgagacagtcttgctctgttacccaggctggagtgcagtggcatgatcttggctcattgcaacctctgcttccctggttgaagtgattctcctgtctcagcctcccgagtagctgggactacaggcacgtgccaccatgcctggacagtttttatattttcagtagagatgaggtttcaccgtgttggccaggctggtctcgaactcctgacctcaagtgatccgcctgccttggcctcccaaagtgctgggattatagacatgggccactgcacccggcccaggatagtgttttaaaagtttttgttgg

SEQ ID NO: 75251 - DNA, 1023 bp, Homo sapiens
aggaggcggagcttgtagcgagccgagatcgtgccactgtactgcagcctgggcgacagagcaagatgccgtctcaaaaaaaaaaaaaaaaaccaaacaaaaaaaaagttgttcgatgcttaattaggtaaaccattttggatattaagatatggcatgaaaatttacaaacatttaacttttacagaaaaatgtcatttttatgtcatttatatgtgggcacattgctgacaatatgccttggtcgaaaaaatactggtttatcttagaaaactgccattcaagaacctgttaatcttgggtaaatatcttttatgatccattttctcacaacagaagaatgaattcctgttacgtttcagattattgtaaagatcaggtgaactgatacagatgaaagtagtattaatatgaagattgctgtaaggtttatttaagatatgatagaggcatgtccgttttgtttcacaggttgactgaaatagtagccagcgcacctaagggtgaactactgaagagggtgcttaacccattacttcgtgagtattcctgcaaatagcagtgaaatgtttgcaaggcagtgtggttttcaggaatatattgaaatcttttatggttttattagaaaatttgaacaagtgatccttggagtaagtaggagtttattgtcaaagaaagagaagttaaaccacatgaagtttgagctttatctattagattttatttaaaagcaatgcagattgtgttatctagtacttcagtgctaatggtagtattctaagaaatcagattttttcattgtgagtctttgatttaataaccacttagcttagtttttttttggttttttttttttttttttaattggtgggtctcagggcatcccagcatctgacaggtccttttgatcccaataagcatttttgatcccaatacacttttatacttgagaagatcatcacttagccctatattaaggaatctagagaagacggggaggcaggtaccattgattactgagca

SEQ ID NO: 75252 - DNA, 1078 bp, Homo sapiens
tttgggaggccaaggcaggaggattgcttgtgcccaggagtttgagattagcctgggcaacatagtgagaccctgtctctacaaataatgaaaaaattagctggggatagtggcatgtgcctgtggtcccaatcctcaggaggctgatgcaggaggatcacctgagccagggaagtcgaggctgcagcgagccatgatcacaccactgggctccagtttgggtgacagagtgagaccctgtcttaaaaaaatgcaaataaaacactgtttcagagttagtgtttataataaaatgttttccctctgattatcatctgcaatctattactttatgactatactgttattcacaacgttttaaatattcctgatgataatgaaaagaagcttatttataaaccaataccaaatggttaggaattcacttttactaaatgaatgcctttttctttctcttgctagtgccgaaaacatttgaagagtcggagattagtcagtgcaaaacagcttggtgtggatagaattgtagattttcaatttggaagtgatgaagctgcttaccatttaatcattgagctctatgatagggtaagttaaatttgtgggatatggtgaaggaaaatttcttattaatcattttgtaatagtgctatataacatgagtgggggaacattttttttctgtgtcaaaggttgttactaccctaggaaatgggtgccacacaaataaaataaaattttccagtaataaccttcattttatctgtaggtctgagtttaggcagactttagccatttagaatagccttatgaatgtaggagatgaagatctgagaagtaaattatttggtacttgacatttcaggactaatatgcaaccagaaaatagtcaaatacggtcatgcactgatgcgctgtatgtatagtgatgtttcagtcaacaacagactgcatataaacgttggtcctgtaacattgtaatggatctaataaattcttactgcttagtgacatcttgatcctgactctgtgtaggcctaggctggtgtgtgagtttgtgtgttagtttttaacaaaa

SEQ ID NO: 75253 - DNA, 1212 bp, Homo sapiens
atatgaaataactgttttggagggcttactgttaaattcaggcattttagggccagtggaaactggttaagcattcacatcagtcttaacattaatctgataatctactgggagtttaaagactctaagcactaaacacagattttcctcactgtctataaaatgaaagaggaaagaagcattgtactaaattttttataaagctaattgtattcccttttttttttttgaggtagttcattgcattttgaacaaggataactgtcagaaaagatcctctttgaataaaacaggtatctcccccatggctgcttctgggtctgccctctgcaaccacatggaataggtctgattccggttcttcaggacaacttttcaagaattaaaaaatcacctccaaatgaatgcatttttacaaaatgaaaataggtagagatgctattttaaaaaaaaaaaaactttaccttctcaccaaccttaaaataagaagcaaaataattttggtatatctttttttttttttttttgagacagagtcttgctctgtctcccaggctggagttccggggagcgatctctgctcactgcaacctctgcctcccgggttcaagcgcttcacctgcctcaagcctcccgagtagctgggattacaggcacacaccagcatgcccggctaatttttgtatctcttgtttttcactaaatggatccctgaattggacccagaatgacttagctatggatgtaagaactgcttttgagtagctgcctccattagccctggggttcctacttcctgagtaccatgacctctgggataactcagctttgtggaactgaggtgcaataggcagcataatgaccccctccccaaagatatctatgtgctaactaaccaaggaatgtggacagccccctgaagctggaaaaggcaaggaaagggattctcttcaagagtttccagaaggaatgcagccctcttcaccaatttggtacttctgatctccagaactcttaaataataaatttggccgcatgtagtggctcacacctgtaattcccagcactttgagaggccaaggaaggtggattgcttgagctcaggatttggagaccagcctgcacaaaatggtgaaaccctgtctctacaaaaaatatgaaaattaaccatgtgtggtagtatgtgcctgtagtctcagctaccagggaggc

SEQ ID NO: 75254 - DNA, 3213 bp, Homo sapiens
tgcaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggatttttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgtt

SEQ ID NO: 75255 - DNA, 1052 bp, Homo sapiens
caggcagcactgggactttgggcttccagggtgccaagttctcaccaagcctggcccctgggacagggctccctccaagcccgaacctcaggggaaggctcagcagtcacagcccaccagtgtcctctcagctgccaacgctgctcagagagggaagtgctgctgctgccgggaggggcacagccctgaagattacggaagacagtgggcagagaatgtggaaaatcacccagaggttgctgctcacacttcatgtcttcagagcatcacccctcattttatagctggagagatggggtgcacagccaaggaaagccaggaacaggttccggcttccatcactcagatactcaggaatccctgggtaccccacactgattcacactgcgctgagctgtccatggcacagaaccatttgtccactgatgcttcctccctccagggacactgtccatcttcaacaagggaggatcccagatactcaccatgggcattcattttataaaagtcccaactgtggctcaggggtcggtccttgcaccttattaggatttacctatgactttatctgcactcacataagcactagggggacaggaagctgttactgcagtcccgggggcctctctcccgatgcctccatttaaagactttgttctgtttgttcacagtgtagatctaccgacttttttgtgtgtctattttaactcacaaattccacggcctcctccttgaagacaagaacagcatcttctttgcatcttgccccatccttgcacttattgctcaggaatagttgattatccagttccataattaatctgtctttccttgagcacctacaatatgagttctaggttctacagggaatacaaaaatgagtagacatgaatggagagcagggcaaaagagtggagaaagtcagagtagtagcttatttcataaagtttggtaggaaacaggagagagactgggttgagaggattgtagaagtgcatggggagggaggttgtggttgaagataaacggaggtgactagcgggtggataatt

SEQ ID NO: 75256 - DNA, 1976 bp, Homo sapiens
tttgtatttttagtagagattgggtttcactaggttggccaggcttgtgtcgaactcctggcctcaagtgctctgccacctcagcctcccaaagtgctgggattacaggtgtgagccaccacacccggcctatgttgtgtcttttgaagcacatatattttaattttgataatgtccaatgcatctgttctttcttcagttgcttgttaggtgtcagcaaagaaccatctataaacatgcatggttgttcacttgaattgcatgtagccactgttatactaggcatactaggcattatgaggcatattaggcattattaaatacccagtaaatagtttgtggtaaatcaatcttttaagtttcctttttttttgttatagaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattagccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttataggcattggtgctagatggtacattttatgtgttaaaataaacattgtttttgagaccttgtgactgtgaatttcagaaatacctttgaagaaagtgaacatctaaacagttaacaggagcaaaagcagccctatttagagacattaaggatacaagtcaagaaatcagttcattcctttcaggtttatttcagtcttaaaagtttcctttgctggtttcccccccgccaagatactttgttcatactgtccttagcatttcattaagcagtttgcaaggcagtgtaacctaaatctgtggtgctttgtgaggtacagatagtgctagctgttattaatgatgtcttaggacaaatgaccactttttagcttgttttataacatgaaatttgtaaaaataagtttgaccttgactataatagtccacccaggttccttaaatgtcttttcaccctccagtttttatgccctcctgctttctctttttttttttttttttttgagacagggttttgttctgttgcccaggctggagtgcagtagtggcacaatcttggctcactgcaacctactct

SEQ ID NO: 75257 - DNA, 1856 bp, Homo sapiens
gaaatacaacaaggcagatgagtccataaaagataaatgcactcaattaagtagaatttatgtattttcccgcttcttggtgcatgttttaccctgtataacaatcacattttatgcaggttgcctcagtgacacctagggtttgagcctgtagaaagagggaagaattgtacttcatccttttttttttttgaaatagggtctcactctgtcatccaggctggagtacagtggtgcaatctcggcttgctgcagcctctgccttgcaggctcaagaagtgatcctcccacctcagcctcctgagtacctgggaccataggcatgcaccaccatgcccagctaatttttgtattttttttgttgttgttgagacagggttttgccatgttgtccaggctgattttgcactcctggactccagtgacctgcccacctcggcctcccaaattgttgggattacaggtgtgagctgctgcgcctggcctttcatctatttttgtatttccagcacctttggtatatgtgactagtgtaaggcagggagatgattagttttatgaattaaggatgctagattcaataagcccacactttttctatcatctttgctttgattatgtttgtggtaaagttttctgattatatgaattctagtcaaaagcaaataaaacttagggaacagaagtaggtgttaggactaaatctaagtaaaaaggcagcagcgggattattcagattaacatttatgtggcatggtgccacagatacaaaaaaaactgttttgtgctttaagggatctagtgttaactgaagctgttgtgcagttttaaaagtagaattttttggaggcagaaagattttgtgtttcctaaatatagaggcttttttttttttttcggccaaaaaaaaaaactcttattttttagttgatgtaactcacataccataaaattcacgcttttaaggtgtacaatttggtggtttttagtatattcacatagttgtgtaaattaccactttctaatttttaatgatttcaccccccagagaagcctcttacccattagcagtcactccctgttacccccgtccccagctgctggcagccactaatctctatggatttgcctattctgcacatgtcatatgtaacaagtcacatactgtgtggcctcttgtgactgtcttctttcactcagcacagtattctcgagccttatctacattgtagcacacattagcacttaactcctttttgtggctgaataatattcctttatgtggctgtaccacaccttatccatccattgatgagatgaataatgctgctatggacgttcatctacaaatttttgtgtgaacatgttttcagacctcttgagtatatacctagaggagaactgcaaggttatatgggaactctgtttaactttttgaagacttgccaaactgtgttcctaatctaccataccattatacgttctcactagcagtgtataagggttccagttttctccacatttttaccaacatttgttaattatacccatctcactgggtatgagatagtctctaaactgtggttttcatttctctaatgactaatgatgttgggtatcttttctgtatttagaagaaatgcttggcccattttcagattgacttatttgtctttttactttgagttgtgagagttccttatacattctgaatactaaacacttacagatgcattatttgtgaatattttctcccattctgtgggttgtcttttcattttctcaatagtgtgtcttgtattttcttaatttattattttcttatttttcttttgagacagagtctcgcactgtca

SEQ ID NO: 75258 - DNA, 1063 bp, Homo sapiens
gtgctgagcttaatttttcatatgtatacacccaagtaactacttaccaacataaagatagaggacattttcaggatcttggaaggtttgcacactgccctttcccaggcaatactcaaaaggtaaccactgaccaggcgcggtggctcacgcctgtaatcccagcactttgggaggccgagatgggcagatcatgaggtcaggagttcgagaccagcctggtcaacatggtgaaaccctttctttactaaaaatacaaaaattagctgggtgtggtgtcgtttgcctgtaatcccagctactcaggaggctgaggcaggagaatcacttgaacccagggaggtggaggttgcagtgagccaagatcgcaccactgcactccagcctgggtgacagagtgagactctcaaaaaaaaagtaaccagcattctgacttctgtcacccacaggtcagttcatattattgaatttgaagtatgtctcttttaaatttatagctccttcagctagattttgactttgaaaaaattcctttggaaaaacatgatgaagagtatcgaagtgaagatattcatattatatacatcagaaagaaaaaatcggtaaataacattctcagttcttcattctccaaggaggtttcatcagctggacactatttcagggcatatgtgtggtatgggcgttgattttgatgtggagaaacagctctaatgattcactggactcaggcagtaacttcattgtcaagataatttaatctatcttgccttgggtttttgctctaaagccaggctttttttttttttttttttttttttctcgtattttttaagtagagacacgtttcaccgtgttgcctagactggtgtcgaactcctgggctcaagtgatccgcccacttcggcctcccaaagttctgagattacaggcatcagccaccatacctggccaggcttcgcttttaaaggccttttccagcttctccataggcgtaaattgtatagctctataattgggtattacctcagacaagttattagctatttataagtttctttta

SEQ ID NO: 75259 - DNA, 1294 bp, Homo sapiens
tcatctgaatcctttttctggaaaccaaaatcagtacatggtttagttaacaggagcttacccaatcattagttacagaggggtttttgtttgtttgtttttgttttaagataggggtcttgctctgtcacacatgttgtagtgcagtggagtgatcatagctcactgtaacctcgagctcctgaggctcaagtaatcctcccattcagcctcctcaatagctgggactataggtgtgcaccagcatgctggctaatttttaaattttttgtaaggtgttgcggggggtggtttgtctctcgctgtattctccaggctggtcttcaactcctgctttcaagcgatctttccacctctgccttccaaagtgttgatattacaggtgtgagccactgcacctagcctagagctttaattacatgtgctttgttggattgattcaaagatggataaattgtaggggagctataaatacccctgtacctcctcaacctacttttagagtagaaaaatttttaaatcaaaaacaaaaaatatattcttttttaaatagtctttggagccattgctgaaaactctaaaagatatcagcggatttgaaacttgtattatatgttgttatgaacaacgaacaatggggaaaaatccagaaattgagaaaaaatattttgaggtaagtattaagtactctattatctttgtagtgatttcccttcaggggggctgtatgtgactcttcaagtatattatggtaattttgggtggggaaaacatgctgtttgtgtgaagctgaggaaaggatcttcacagcccatgattctacgaagctcccctttttcatcttttctgatactttatttcatttctaattagttgatctatggctacagaagaatgttaatacgggtgccactcctttttaagaacagttttcagtgtttattaaacatgatgctgcctttggggaacatctcaatgatgtatgtattacctttggagaatacgtgatagaaatgtgcaggtgataagttgtttttgttttgagacagggtttcaccctgtagcccatgccggagtgcagtggcacagtcagggctcactgcatcctcaacctcctgggctcaagtgatcctcctgcctcagtgtcacccccccccccccccgcccccaagtaagtgggactataggcatgtaccaccacacccggctaactttttgtatttttttgtagagatggggttttcccatgttgccaagtgataagtttttacttctgtgtttttctctacatatt

SEQ ID NO: 75260 - DNA, 1028 bp, Homo sapiens
gcccacgcgctgagccggcggtcggtgctggagctgggttcgggcaccggggccgtggggctcatggctgctaccctcgggtaagagctggcgggcgggcgggatgtgggggcgccttcttgctggggaaatccggattacaggctttcccccctgtgcctacacctcagtcgacgttattttatagggctgatgttgtagtcaccgatcttgaggaattgcaagacttgctgaagatgaatattaatatgaacaagcatcttgtcactggttctgttcaagccaaggtactgaaatggtttgtatggcctttcagcttgttttaagatattgatttgtagtttgttttgaattgcgtttcattaaaaggatggaaggggactttccggttctttataaaacaagagtattttgaattattaaaacaattgaaatatttgtttggcatttttaaggggggaagaaatagaaggctttccttctccacccgacttcatactgatggccgactgcatatactatgaagaggtaagtatccagtgagcgaagtctcttcacttagaagatgaaccttattccatgaattctaaagcacacgtttcttcacattttaacatctttgaatccgggatttgccttatagttgatgcagtaaagagaagataaaagtcaccagggaccatatgtatatacgctcatcattatcataccgacctggtgaagcatgttgagaaaagtgttatatgcattttactagaggcttctgtaaaaattttaaaggattttgccaattggatgttatgaaaagccaaaatcctctctttttcccttggttgttcccacggaacatgttaaccatgacattgagaattaagttataaataattcattgttcttttctttaaataccagtttgggccgggcgcggtggctcacgcctgtaatcccaacacttgggaggtcaaggcaggtggctcacctgaggtcgggagttcgagaccagcctgacctacatggcaaaaccctgt

SEQ ID NO: 75261 - DNA, 1022 bp, Homo sapiens
aataagaagatctagtaatgaagtataaaagaaatgctagtttacttcattcactaaatttttgttcaagtcttcttgtcttctgatagttgtcttctccttaacaaaaccccaacctttagccccaaaagatctttcagtggaaaaatatttgaatgttcaggggttataattttcatcttctacagctatgacttgaaaccctggctagtcaaaataacgcacaaggcatgacgtagaattttttgtattgcttgatcttctaatttatatgagtaaattatgggttttatatttatagataaagagaggagaaatcacttcaggtaagtgtacaaaggaataccactcatcttttaatgtaaaaaaattgttttccagataatttgcaaaattttataaaatttaaaggtttgcatttataaaatatgattgaattgtaaaaaatttatactcaatttatgtatactttaaggcactgcaggaaaggaaaaggaaaattttggacgaagctgtggaattaagtcaagatcactttaaaaaatacctagtaaaacttaagtcaatcaatccaccttgtgtgcctttttttggtaagttactaaatatggatatattttgagggtgagcgtgtgatagccaaaagagagcagtcttcagaggcatgttatctttattttatatctgagctcatctacttttattagctctctgtattaataaataataaaactctctattttctataaaatgaagactataatatctcatagggttgttataaataaggattaaaaatattttgtctgtactacctaataagtctagcacataggacgcactcatgaaatggtaactgttatttttatcataactatctatgtcacatctacagtgtttgctttctctttaatttattaaaagcttctatgtgatttttaaatttagaattaaaatattgttgtgtatgattgaaattgaatgatttaaatcaagttttgtcaacttcaacaattttggta

SEQ ID NO: 75262 - DNA, 1092 bp, Homo sapiens
taagttgagattgcgccactgcactccaacctgggccacagagcaagaccctgtctcaaaaaaaaaaaaaaaggaaaataatcagagagagaaatgtgaacagtgacaaaatacttcaagataacaatgtattaagaagttgtcagttttatgtgtgataatggtgttgtggttattactttaaagagtgttttaaaggtgcttaaatatgaatgaaatacgatgtctcggatttgtttcagaataacctaggaagtgacgggatggcatgagtagggttagagaaaataaaaattggccatgagttggtaactgttgaggctgggtgaaagttaaggattaaatgaagatttgcagtcatgtctgtcaagtaaaagacatttttctttatgtgttctttttccagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggtagacaattaatgttaatgtcttgctttatttttaagaatcttgaacattacctattttcaaaacattttgcacattattcatgagtgcttaaaaatacctcatctactctcatgggcttagaggaaaggtcatagcacagtttttaactagtctgccctgcaagtaaaagtcttatgtctagactggggactagcaatccattacaagaggaatggcaggaagattttcaagtccaccacccctcttcaactcctaataccttctcaccttggtttagtttgaggtcagtcagtcaagtcagttagtatggatgctaggcccttagcagctaagtgaatagaatattgtgtgagatgggttttcttttctcatttacagctcaggctgttgcgaagggtacaggccttgcatgtaacagctctctgtcgaaaaatgtcactatcattatcattccatcaaa

SEQ ID NO: 75263 - DNA, 1016 bp, Homo sapiens
tgccatctcagctcactgcaacctccgcctcccaggttcaagtgattcttctgcctcagcctcccaagtagctgggactacaggcacatgacatcacgcctggctaatttttgtatttttagtagagatggtatttcaccacattcaccacaagaccagcctggtgtcttgaactcctgacctcagatgatccacctgcctcagcttcccaaagtgctgggattacaggcatgagccaccatgcctggccagcatttttcatttttaaaaagctgaaataacatttggaatgttttttatagacagcaagaaactcacatatgtttagaccaatcatctgaggtctcagaactttgccttttcaagtttttgaggagaatatttcttttaaagaagtcgaaagttctttttaataaatttaagctatttaattttatctcattgcaaggttgccatttcttcaactgaataaaaatatgtgtaattttatgttttctttctttaatcttattcttttaatgattaacagctttcttataatatttacatcttctggaaatgtttttggtatatttctgaaatctgaaagagaggagttttctattttaagtttcagaatcatagcccaagaaatgaaaccctaggccatgaacatttaaacaaatgtgtcatcaaatgtatattattgaatcaagaacatttatgttttatctgacattatagggcattacaaatactataacaagtgtaacttatttcgtgttctacttgttctttaaggggaatattatttaaagttaagaatgttattcctttgtttctactttgagatgtttatgatacatttttatgtgtgccttgaaattgtcataatactacattttcaagttgtattctaggccagtgcaatggctcacacctagaatatcccagcactttgggaggcagaggcgggctgattgcttgagcccagaagtttgagaccagtctgggcaaaatggcaaaacccagtctct

SEQ ID NO: 75264 - DNA, 1609 bp, Homo sapiens
aaaattagccaggcgtggtggcaggcacctgtaatcccagctactcgggaggctgaggcaggagaatcacttaaacctgggagggggaggttgcagtgagccaagatcgtgccattgcattccagcctgggggacaagagctccaaaaaaaaaaaaaaaaaaaaaaaaaaaaaaaaaagattagcattgttatattattaggatagacttaataaatgtttaaaaatataatctatgaaagaaatttaggattttttgtaattttagttcttatagagccagtagtacttctctttcataataatgaaattgagggctgtattatttagtggcaaagttagaactaaatgctgtgcgtaaaagctactgtttggttatttaatattttactcacttgatttgagatggtttatgcttgaaaccatttgggttgctagctgttgaataagctatattgtttgttttttctagagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcaggtatgtgaaactcattacaactgctgacctagggcctgggacccaaaagctttttaaggatgctcaaaaatatttgaggcttggggaaaaaatggattgcctccaaaatataaaaatactgcaaaaacaaaaggaataaataagagaaggaattaaaggtctaaaaatgtaatattgttaacttcattaattattgaataaatattcataaaatatgcatattcatgaattttttttttttgagacagagtcttgctctgttgcccaggctggagtgcagtggcgctatctctgctcactgcaagctccacctcctgggttcacgccattctcctgcctcagcctcccgagtagctgggactataggcgcccgcaacaatgcccggctaattttttttttctttatttttagtagagatggggtttcaccgtgttagccaggatggtttcgatctcctgacctcgtgatccgcccacctcgg

SEQ ID NO: 75265 - DNA, 1609 bp, Homo sapiens
tactcggtgttaaatttcctgaagttgatcactatactgtgattctgtaaaagaaaatccttgttgtaagatgagctatgagaaatattaaaggagtaaaggagaatgatactatttgagagtaatttgtgatacatttgacttttccttatattccaaaaactactgcaaaaccattcagccgtagtcccccttcctctggaaggaactgagtggatagtatcacaactactaaaaaaacgatctgcacacactggcacacagaatgatgaagcatgtgacaaaatgttaaaaattggtgattcagagtattacaggagttatttgtgttacttttacaacttttctataaatttgatatttcaaaagaaaaaatttaagagggaaaaggcataatcagaaggcatcttcaagaggaagcatttcaactgtatcctagtggctaaattcaccgggtggataaggaggtcagagactgttgtgtagaaagcgaatgggggcatgaaagtacattacttgtttgcacatagttcagtacagtaatttttcttttctttttctttcttttttttttttggagacagaatctcgccttatcacccaggctggagtgcagtggtgctatcttggcttactgcaatctccacctcctaggttcaagtgattctcatgcctcagcctcctgagtagctgggattacaggcatgcaccaccacgtccagctaatttttttttgtattttttatttttattttcatttttttgcgggggacagagtctcactctgtcacccagactggagtgtaatggcacaatctcagctcactgtattctctacctcccatgcttaggtcatcctctcacctcagcctcccaaatagctgggactacatgtgcacatcaccacgcccggctaatttttgtattttttgtagagacaaggtttctccgtgtggtcaggctggtcttgaactcctgggctcaagtgatctgcccgccttggcctcccagtatgttgggattacaagtgtgagccaccttgcctggcccagtaatttctgtgtaagatgtttggaacacattcttttaagtatctgtagaatattagttggatattcattaatatgatgtttatcaaatctcactgctgaaaattcaagaaatatttagcaaattatcagattattatgccaaacagagccgttgtttaatatacttccattaccaggaaatcccactctaaatatcctcaattttgttctcctttacagcttataattattacatggttatttaaaaatgacacgtggaagagtttgagcagccttaagaccaagtagacaatgaaaatcatacctttttggtaggatatcactactggtgataatttagatatttggataaacaaaaacaagaataaaacagttctaattaagtgtttgatgtcatcaacattcatatttattaaagaaatattttagagtggagctgagaagactttctgtaagaaatctttaaagcagcaaaataagtgattttgccagtaactttcacctgtagaagtcagaataaccaagcacagatcttttttcaaactttctatgatatt

SEQ ID NO: 75266 - DNA, 1075 bp, Homo sapiens
actatcataagtagtcagaactttatgtttttcaaagtactgttctattttatttgacccttataacaatcctgagggatagaatgggcaaatattgtcatctctactttacttgtaaggagattgactttttttttttttttttaaatatagatgggggtcttgctatgttgttcaggttggtcttgaactcctgggcttaagcagtcttccttctcagccccccaaagtgctaagattacaggcttgagccactgtgcctagctggaaattaacatcttaatcaagttagttatagagcttaatcttgaatgtggcttcttttctaccacgttataattggattttgtctctagtggtatgaagaataaaaacctaataaatgctggcagctaatattatctttgtctttttgtgtcccatcagttttcattcctcaggaattaatttttatgggtctcttttcactggattagtgctgatatgacagaaaatgtctattttaatactaaagggtcagatggaagagtgaatcccttttttatctatctctgtatctactataattttttttagcattaagtaaaatataaacttttgagggaaagactatctaaaatcagagcatagtactctgcaaatattaaagaagtgaatgacttaaaaatgatcttaagttactccttttgcccctcatcctatgttttcaaaaagctcgcatttctggaaggcctaatatgtgccaggagcattttacagaaatcatctaatttaaccctaagaccctgatgagctgggtattagcagaccaaatgtgtgataacgggcaaattacttaactgctctatgcctctgtttcctcatttgtaaaatgaggatgatgatagtacctatctaataaggatattaggttattacatttcaagtgcttagaagagtgcctagaatataatgtgcccaatacatgttagttgttattattgtccttttcattcctaagccagggtcattcatctggcatgttgtaaaagggaaaaacagtttttcctctctaatctttttttttttttttttg

SEQ ID NO: 75267 - DNA, 1408 bp, Homo sapiens
ggaggctgaggcaggagaatcacttgaacttgggaggcggaggttgcagtgagctgagatcatgccactgtactccagcctgggtgagagagcaagactgtgtctcacaaaaaaaaaaaaaataaaaaataaagtatagtcaactttctttttcactttgatttatagctagttcttgcctgttggttgacctaagtccatggtagcatttctgaaagaagaagtggttgctacaacaatttaagcatctgtgagatgtttgggtttagcaaatgaacgtaatagcagtggtcattgtagtaaatgtgcatcagaaatgcatcgcactgatctatcgtgtgcctctaccatagtagcatttcacttttctccttttaaccctactcaaatatgtactgtcatccttataatatggcaaggaactaccatgttgaatacctactatttgctagatgtagtagtatgcattttatatacattaccacattgaattcttcttatcagctacattttactcataaggaatgtgactttcaaaagaataaatgtgttcataatcatagtcgagtagtggctgaactgggatttttggctcgggttattgttccccaaagacaggcttgctttttttttttttttttgctattatgtgtgtgtgtgtgtgtgtattacagtatacatatatacatatacatatgtattagtacatatttcaccattagttcatatctccagaaatatttattttgccatactcgattttatttgaatatttcccaccttcaacaactttttttccttttattctaggttttatcatataaatttacttataatacacacaactcattgtgtaatatttgtgtgtgcgtgtgtgtgtgtgtgtgtgtgtgtgtgtgtgtgtgtgtgtgatggagtctcgctctgtcgcccaggctggagtgcagtggtgtgatcatgactcaactgcagccttgacctcccaggctcaagcaattctcctgcctcagcctcccaaatagctgggattacaagcgcctaccatgacgcctggctaattttttgtatttttggtcgagacagggtttcaccatgttggccaggctggccttgaactcctgacctcaagtgatcctcctgccttggcctcccaaagtgctgggattacaacacccagccctgtttaataacgtatagatttcaagtactttgaggcagtttttataaaagtaaagaaaataaatttatacattattgatttctgtttctcaggttttgatggacatgtttgatcaggatgacataggtttggtttctctctgtgaagatgaacctagttcttctggtgaattaaactactatgatcttgtcagaactgaaatcgcagaagaaagacagtatctacggg

SEQ ID NO: 75268 - DNA, 1010 bp, Homo sapiens
tgccagctacttgggagactgaggtgggagggttgcttgaccccaggtctgcagtgagcctgggtgacagagtgagaccctgtctcaaaaaaagaaaagaaaggaaagcaatacttttttaaatttctttcaacaaatatttataggacacctactgtatgctaggtactattatttaccatatttcttatatccagtcagactggattattatttaggacagaaaatttagaaacaaaaacggctcatccctagaaggatgcagctgcttaaaaaaaaaaagaaagaaaaaaaaagaaaaaaaggtggggtgcttagcatagctggtggtgacagtgctattgtgaaagctgagtagcacctatttcacagagcacctctataatttgtaaaggagtatggtttttcagatgttacctttattactgggattcatgacctgcgtagacttcaagtaggtttattgacttcagggtatccacagttcctctgaaattgtatagaatagtttatgtgtatatgctttttggtgatagggaagagagggttcaatggctttccatagatttttcaaagggtccaaaaatgcttaagaaccactgctctgtgggttaagaaaagtttacagagaccaacaaatagtttttttcttcattttgtgttttatgtctgttttgagtaaccattatagtaaaatattatatataagattctctttgacttttgttcaatttatattattttgccattactttaactgataacttttttttaaaggttcaggaacaagtgcatcccactctctcagctaatgaagagtctctctattatattgaagagctgatttttcagctgcttaataaattatgcatggcccagccaaggactgttcaagatgtagaggtaaaaattattttgtcatttcaaaaagtcactcaaccactgtatgaattaatttttgtatctatatcattctaatttattgtgaaaactaaaaccactgaaattat

SEQ ID NO: 75269 - DNA, 1067 bp, Homo sapiens
tctagattcttaaggtgaaagaagaaaccataatggaaattagaaactatagtccaccattcttatccttgggttcttaatccatagattcagccaacctcagatcaacagtatttgggaaaataatggatggttgcatttgtactgaacacatacagacttttctcttgtcattatttcctaaacaatacaatataaccactattacatagcatttacattgtattaggtgttacaagtaacctatagatgatttaaagtatatgggaggatgtgtgtaggttgtatacagtgttacaccattatatataaaggacttgggcatccatggatttgggtatccacaggtgtcctggaactaatttcccacagacactgaaggatgactgtattttgaactggatgattacaaaaatattccatatgaaaatatgtgtgtttttacaaaagtagttttagagaaaacatacatattagaaaagaaaggttgacaaaaatgagcaaagtatccatctcaagaagttggcaaaagaacataaaaagcagaagaaataatgaagataaagcaaaaataaatgaaatataaaacaaacataaaataggatcataaaagccaaaagttggttctttaaaagattaataacattgataaacctctgagatgctgatcaagaaaagaacgaatacacaaataactaatattagaaatgaaagaagggatttttactataaatcctatagacttacaaaatatgaggctataatgcacaattttatgctatttttttttttttttgagatggagttgcccaggctggagtgcagtggtgcgatctctgctcactgcaacctctgcctcccaggttcaagcaatcctcctgcctcagcctccttagtagctgggattacagacacgtgccaccacacccagctaattttgtatttttagtttcaccatgttggccaggctggtctcaaacttctgacctcaggtgatccacccacctcggcctcccaaagtgctgggattacaggtgttagccaccgtgcctatgctaattttttaa

SEQ ID NO: 75270 - DNA, 1073 bp, Homo sapiens
tccattggtataccaagtgctaaagtattaaattgaccttacttccatgtgcagcccaattctgtaaggagagggaaagaaatgaaaagtgtgctgagtggtgaaaatgaactctggcctgaattaaaagcaaagggggaaatgcctagatagtaattagccctttgaccacagacaagtgtgagtgcagtaatcaggtaggcctatattgttggcaatgtgacgcaggtatatacccatttataactttctggtagcaaatagtatttgggtgtgtgttgcataacttgttcaataggtagctttgattctaataatcctttatgtccagaaacagatttatgttttctttttcttcaaatagagacagggttatgctatgttgcccaggctggtcttgaacttctggcctcaagcagtccgcccacctctgccttccaaactgttgggattacaggcataaaccacctcgcaccagacccagatttttttttttttttttcaagttaggctggagaagccaagattagcatccaatcctagtccattgctttggtgctattactttgcatttatattgtgcttgttttcctggaactcaggtgccttgtagatactatgttatattccacagttctagtatgttctttatgaaataaatacatctaagaaaatttggtcttttgaggtgaattcagaaaacattttctattaacttactgttgtgatagaattgaaatacatacgtatggaaaatttttttatatttttggaaaaattttggtaaaagtaattaagattatgtccacttttatggtatttaggacattgcaacttgtaggtctgtagtgcctgctaagagctgtagctcttagggagctaaaggttcactctttctttgcaggaagttttaaattctggtatgcatcagccaccttgtctttgtaaaatgagaatttctaccattttgggggagtctctgtcttcacattcagagcatctagaacttggcatccttcctctagctgaccagatcgttacaaagacaactaggatttgattggaatatctct

SEQ ID NO: 75271 - DNA, 1378 bp, Homo sapiens
acaaaacaaactcaaagcctttattatttccagtctctttgtaactgatgtggtatggtatcatcatgaaatctaaacagtggtacactgagtggttgtcctgttcttcaatctctgtggctgagaactgaaataacttagaagagacagatttttatgagagcagttttagaatcctgacactgatgtatagaactccaatttaaaaaagttatttatctattatatctctgatctttagtcacactaaggctctcaaaatgttggccaagattggtaatgattcatacgtacttgatttttcagggctcctataaacttgtatagggatatttttccatttttgataaatatctaactttgaggcattcacttttgtaaaccgcgaaagtgccttacattcacctcatgagtattttaagttgatgcccagtgctgtggtatatcctgtatatatgtgttttgtggtatctatcgaaattattcttataatttagaaagttagaaaatagaaattgtaaatgaaaatgtggcgacctgactgcagaactttgagtactgaaccacatttaggtgaggcattttcatccattctctctgatttgctctctcaggattcatcttctactgtgtatgtcttctttcctcttagctctccaaagctgtatgatggatgggtgagaaggatgtgcattttggttgataggaaaaatgtttctgttttcttccttttcccctcacttcaagcattgatgattacattgattgagctacctcatccattaatttgaaaggctacacttcatcagctcatgtttaagaagtagcacatcccaggtaaacagagtaggccattattcaactcttaggatgagtatattaaaagcattcagatatcaatgacagaagaaacaagccctaatgtttctttataacagctgattcctgcaagaaatgcaaacacaggatatttttctgttccattacaagattactaagagatggaaaatattatcattctgtattttgtcagtagtacgattgcatacatactaagttgtaaacattgaattacaaaaaatgattgtcctaattgaagcagtcctcaatccatttgagtctgtacaataccctgaaaaggaaacaacaggtgctggagaggatgtggagaaataggaacacttttacactgttggtgggactgtaaactagttcaaccattgtggaagtcagtgtggcgattcctcagggatctggaactagaaataccatttgacccagccatcccattactgggtatatacccaagggactataaatcatgctgctataaagacacatgcacacgtatgtttattgtggcactattcacaatagt

SEQ ID NO: 75272 - DNA, 1009 bp, Homo sapiens
aggcaggtagattgtagcccaggagtttgagaacagcctgggcaacatggcaaaaccctgtttctacacaaagttagctgggtctggtgcctctgtagttccagctcctcagtaggctgaggtgagaggatcacttgagcccaggaggtctaggctgcagtgagcttatgttcatgacactgcattccaggctggatgatagagcaagatcttgtctcaaaaaaaaaaaaaaaaaaaaaaaaaatccagcctgggcaacatagtgaatgaaaccccatctctacaaaaaatacaaaaattagctgggcatgatggtgtgtgcctgtagtcccagctacttgggggctgaggcaggaggatcgcttgagcccgggagatcaaggctacagtgagctgtgttcatgccactataccccagcctgggcaacaaagtgagtccctgactcaaaaaataaaaacaacaacaaaaaataaattccatgcttatttactttgcgaataaagaggcaaggtacagttttatctgtccgaatccctgacttttatttattttttttttcagacggagtttcactcttgttgcccaggcttgagtgcaatggtacgatcttggctcactgcaacctctgcctcccgggttccagcgattctcttgcctcaacctcctgagtagctgggattacaggcgcccaccaccatgcctggctaattttttgtatttttagtagagacggggttttgccatgttggccaggctggtctcgaattcctgacctcaggtgatccacctgcctcagcctcccaaaatgctgggattacaggtgcgagccatcatgctcagccctgaatccctgactttgttaatgacctgtccttaccaaccatgacctagagaagatttggctttttaagagttttggagaaagatggcataaaaatagattatttccttaaatcaattttttagcattacgctacctaagctcgtttggtctctcatagacaagaa

SEQ ID NO: 75273 - DNA, 1430 bp, Homo sapiens
tagaattttaagtaataaagattatcagtgtctttacagttgttcacacctataatcccatcattttgggaggctaaggtgggaggatcacttgaggccaggagtttgagaccagcctgggcaacgtagggaaaccttgtctctacaaaaaaaaattttctttaattagccaggcgaggttgtgtacacaacctgagcaacagatcaagactatctcaattaaaaaaaaaaagactctcattttattaacatgctgctaaatttatttttatgcttttcctatcatcttttgaaattgaagatgatcctgatattgaagggtaaactcttaaaaacaaactgcaaaacaagaacttgttgccatttgcaaatatttctctccataaattttaattgtgtgaattttaaaaacacaaaaataagtagaataggatacaggaatgcaactgacacataacctctgctttcattgatttgtattactcagatgaggcttattgttgccattgattgatttttataataaattcattctataaatttaaataaaaatatacctgttctaattaagtgtggatttacctactacctttggaaagagcagacattgataaataacttacttgtttttatgtatttctttgataagcgtttgttacactattgttacgtaataggttttaggctctaagctaacaatataggtttgacaggctacaactgacagcctttggttaaacataaactcattgggtttccatataattgtgcatttagaagaatactttattgctttaagactttttggaaacgctgacttgtaaagtatcctatgtctttgagtcagctgactcccatcttttacttttgcaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctaggtatgcactgtaatcttcatgtcagcaacaagaatgtactaattgcattctttaatttaaaaaatggtttttaaactttagtttttaggtcaaagataaccactgcattgttaaaatgatgtaacatagaaataataattttctacaaaaattagccaggcatggtggcgcatgcctgtaatctcagctactcaggaggctgaggcaggagaatcaattgaaccgagcagacggaggtgagctgagagctgagattgcaccactgcactccagcctgggtgacagagcaagaaaataataataataataattttcaaaatgttaggctgggggccgtggccagc

SEQ ID NO: 75274 - DNA, 1112 bp, Homo sapiens
ataataatacttatttcagtttgaagtgttctgaggggaaagcatatgtaatcctacaaagaaaaaccctgaagttgccttaagtgcttgaaaagggaatgaaaaatttggtactttaaacatttcatgttaaaaacttgtttgaactaaaatgaaatcgtaggaaaaacatcattattatttatttatttatttgagacagggtctcactctgtcacccaggctggagtgcagtggtgtgatcacagctcaactgcagcctctaccgccattagctcaagggatcctcccacctctgccttccaagtagctgggactacagacactcagacactcaacaccacgcctgattgattttttttttctcgtatatatgggatttcaccatgttgcccaggctggtctcaaactcctgtgttcaagtgatccacctgctttggcctcccaaagttctaggattacaagcatgagcctctgtgcctggccagaaaaacattattattattttaaaatttggattgtagggttttcaatatgtggacaagagtataggggacattgagaacataatttttgtttgtaagaaaaataagtgtagacatttttaactgtggttaatcaattttaacctttatgtgcctagaaggagcaaagggaatgtactgactgattctctatacagcagagttttacattggacactcaacatcagtggctggtcctgatgttgaggggagaaatgctacttcgatgagttcagataaactataaatagtatacaaaataggccacataccagctgataaacatatgcgtctctaccccaagaagtttcagctttcagttccgtcccttctttttgtgttctatgtggtatatctgattctttaagattttttttttaatttttatgggtgcctagtaggtgtatatatttttggggtacataagatattttgctgcaggcatgtaatgcataataatcacattatggaaaattggttattcgtaccctcaagcatttatcctttgtcttataaacagttcaattacactcttagttatttttaaatatacaatcaaattattatttactatggtctccctgtcgt

SEQ ID NO: 75275 - DNA, 2077 bp, Homo sapiens
agaaagtttaggatggagcttcctggcacatgtagttgtaaaaatatatacatatgtgcatctaggctttgcagagtctcacttgaaaatcacaactaaagtttttttggttttttgttttgtaattttgagacaaggtctcactttgtcctcactgcagcctcaacctcctgggatcaatcagttctcccacttcagcctccaagtagctggaactacaggcagatgctaccatgcccagataatttttgtgttttctgtagagacagggtttcgccatgttacacagcctggtctcgaactcctgggctcaagcaatccacctgccttggcctcccaaagtgctgggattacaggcatgagccactacaccctgcctaaacaactaaagtattttacctctggctgactaaagaaatctagggtagatgtcccatttctttcataccctgccttttaggtgtgttgaaggcatctaatatttccattagaaagccttgatgttggcaggctttatagagttccagtttgaaaccagcactccttgggaatttgagtttagagggtgtttacctctgtatttttttttttttttgagtcaaagtttcactgttgcccaggctgaaatgcagtggcacaatcattggttactgcagcctcaaactcctgggcttaagcgagcctcccacttcagcctccctagtagctggaactacaggcacacaccaccatgcccagctctgtttacctcctgagctgatgaggttttcttctgatattggccaaaagttgattttcattgattcattgattgattggttgattgagagagggtctctctctgtcgcccaggctggagtgcagtggcacgatctcagctcactgcaacctctgcctcctgggttcaagcaattctcctgcctcagcctcttgattagctgggattacaggtgtgcaccaccacacctgtctaatttttgtatttttggtagagacagtgttttgccatgttggccaggctggtttcaaactcgtgacctcaagtattccgcccgccttgacctcccaaagtgttgggattacaggcgtgagccaccactcctggccttgattttcttttaatctgtagtttttctgactttgcctagatttttgtgatgacataaaaaaagaatctaataattataaaggtattttacgtaataaagaattcctttctctcataaagattttttttctctgttttcagtggcttgattaaactggcatcccagaatttttcctatggagttactgaaatgtataaagcatgttttcttggtgcaacagtgaagtatcttcaaaaattcatccctgaaattactatcagtgatatacttaggtaaggaaaagggataaggagtgtaaatacagtcctgacctatgtgaacttgagaggtgggtctgacttggtgattagtaagtaccatttcagagtcagtctgcatatgcactgaatttttgtttgctttctttcccaacatgttgttgaattccctttgcagtgcatttattgggcattgctacatcatggcccttagtgctggtccatttataattatctagactgccttacagctctaatctgaaatctctatgacagctttattgtgatgctaccttagcctttttgtctaactatcactcctgataaaaacaacttgcctgaatttttaaaaatctctctggccagttagtcttgtgattccaaagccttttggccttaattttgtataagattattgatcactatgttaactaattaggtaataagcacattaaaacattatattttgattgattcttaaaacttaaaaaaaaccttttaggtttggggtacatgtgaaggtttctacataggtaaacacatgtcatggggtttattgtacatattattttatcacccacatattaagcccagtacccaatagttatcttttctgcttctctccttcctccctccctccccacttaagtagactgcagtgtctgttgtttccttctttgtgttcatgtgttctcatcatttagctcccac

SEQ ID NO: 75276 - DNA, 1050 bp, Homo sapiens
atattctgctgattgggtaaatcctcatatttgtgattggtatattgaatttttaattaatccaaattaaaagctgtggggtgggtgggggagcaaaaaaaattggtggaggctgtctaaatgacatttgcttcctcatgcagcaaatagttaagaagctccctgctaggtcctaataaacagatttgtatgtatttgtatgtatgtatttgtgtgcatgcatgtataccttactaagtatccttgctaggttgaccattattatctttacagtacaaaatttaaggtgacatcctcttacatgccactatcctaagtttctagctgccacctaaatgctaaagaacatattttgctgatacctgtattgaatatcctcttttagaaaaaattctatttctgtacctttttttcttttctatcacctgtttttcccctcttgacctattctactccactttatacaaataactgttcttttattttgcactagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtaggtaatgatgcttcctacttctcatttttttcaagcaggtggtggtcataaaggagatgaaaacaactttcacttgggtcagaaataagagaaattttgaaggaccgtttttgtaagcatttcatcggtttctcttgtggttaaatccctaaatctttatccctgtatcatggttattaaattgtaattaattgcctgcaggtacatgtctccagaaagcatgagtgcactctgggaagtgctatcaagaaggaactgaattctaccttctctctggtggagggaaagggaaaactttcccttatggaagtccctgatacccaacccttttcctcagttcactatctgtaggtacagaaaagggatgtggccactctgtagtttca

SEQ ID NO: 75277 - DNA, 1006 bp, Homo sapiens
tctgttgcccaggctggagcgcagtggcatcatctcggctcactgcaacctccgcctctggggttcaagcaattctcctgcctcagccttctgagtagctgggtctacaggtgcccgccaccacgttcggctaatttttgtatttttagtagagatgaggtttcaccataattggccaggctggtctcgaactcctgaccttgtgatccgcctgcctcagcctcccaaagtgctgggattataggcgtgagccactgcgcccggccgcaaaatgaaaatcttctaagggccaagcaggggaatatgttggggtgatggtcaggtggtgaatacaagagtgagatctttacaatagtattatatcagatattattttaaaaccaccacaacaataatgctgtgctggccaaatgagaggatggcagaatttattaatagcactcaccgtctggatgttatcctggataccaggctaccctcttggggaaattgattgggagaactgatatatacaaaaaaaggcaacagaaaatggtgctattaacaatgatcaccaaaatgtagtcagtacttagtgtgtgaaattctcctcttatccttttctttagaattagaaacggccaatgacacgttcaacatttattctaaaaaaataaaataagcatgtgttatataggtcattcatctacagattgatgaacattgatttggacatgtctttagggacaaaaacagaaacaaacaaaaaaatccaggctattaatttcttgtattacctgaagaaaaagtttgagttaaccacataaaatctccattccatatttgtagtctcaaagatagggtctgggcagcaagtcaaagcaatgctctggaaacattgtgagtagctagaacaactcttgagttcttactaagtatggacaacatagtatatactactgggaaaaatctcactagagcttatttaaaacataattgtttgatgatacgtaattcaactcagaat

SEQ ID NO: 75278 - DNA, 1276 bp, Homo sapiens
ttgtgaattctaatataccttcgaatatgcacctgtgttttcctttgcccctttctttaagtaaagaagaaactgtacctcagatatttttcccataaataaatagaaaagaaataaataagttgatgaattgactgttttccccctgcaacagaatgttttgtaaatactttataatatattccaaaaataaaagggattgttttgtcagttatgttccatcacattcagtaccagttgtctttctgatgtgctgatattttacattttcctgaagaaataagaaggccattctgttttgggggggaaaaaaagtaaagtccaagcaacttatgcttctctcctttctgggtttgagaatgtggtagtgatgagttgcttatggccaagatgcacatagagactatgataacagaagtggaaattgaagctacatttcatttttagggaaaatttgttttaataacattttcttaagacaacttttcttggtggaggaagaaaatagtcatgaagaaaggaagaattagatatgtgaagaaaaaataattttaaaaaattaacctcctttgggtcatacaatagttgatgattttccattgactttatctttcatcgctgatgatacattcacctctatccatgctccttacctttttttttttgaagcttatagtagctgttgaacaagaagaaattcccagacttcaggccctatatgagaaaggcctccagaatggtgtcccgggcctgaggctgatccagcaggaggatataaaaaagaaggagccatattgtagggtaagtgattaacaaagggatgtttttatttagggcttagtcctgagacatggaggctgagggtgagtgtataggaggcaggaataatataaaatcagttagataatcctgtcacagaagtagtgaagtgacagacacaagagggcattgtcacaaactctggacacctgatttctttctctgtgagaaaataccaggtctgaccaacatgaagacaagaggaggcctgagaccacatggcatgtttggaaaacactgagcagtgaggtgtggttgggagcattgggtatgtagggaaatataagagatgagactgaaaaggcagggttaggcccacataaagggtttggcattcatgttaataacattgaagtttatccagtaggcacggggagccattgaacatttttggaggagggcagctgtagtgtctgatctatacgataggcggataaggctggcatgagtttgatcc

SEQ ID NO: 75279 - DNA, 1869 bp, Homo sapiens
agggaaggaggaaaagacatgagaacacatcaagattgtggctgtgagcttgattccaccggagcctctgaggagcaatgtagtatttcccaggattgtgctcactttatccatcggctcttctctctattggttgaggattgccgctagtgatgttgagcaccccgtgcccttctctaaaaaagttaccagaggccccaaggcagagtgcaaagagccctagggggcccctgaagtggtttgctggtaatgagaggtgagtttgtgcaccaaagttgtagttgaaatcagagatgggctggagggatgtgacatggataccagggatgttagaagaagttaccagtgatctgaacaaattcaggcagaattttacatgatgtggtctctaatagcttcaactataagtttgttctcttacctcttatgttttgtatgaatcatgtacttactcttaccctgtttctcttgttctgtagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaaggtatggcattttattagagccttgactaatttccaactagcatttgcttagtgatgtttaatattacattttttaaaaatgtatttttttctttgtatctatgtaatttttcaaatctaatcttagggaataactaaaaaaagatggtgtgacgttatgtaattttctaaataaaagttttattgacatataatttatgcaccatacaattcgcccttttaaagtgcacagatcaatttttagtatatttatagagctgagcaatcatcaccactatctaatttcaggctttttcatcaccccaaaaagacaccccatacccattagcagtcacttcccatttctacctcccccgatgccctagcaaccactagtatactttctgtctttgtggatttgcctgttctgcacttttcatataaatagattcatatactatgtagtcttttgtgactggcttctctcacttagcataatgttgtcaaagttcatccctgttgtagcatgaatcagtacttcatgtcttttatggctgaacaatattccattgtatggatataccacattttatttgttcatcagttgatagacatatggattgtttccaccttttggctattatggataatgctgctatgaacattcatgtataagtttatttgtgaacatatgttttcatttatattggttatatacctgggaggggaattgctggattgtcagggtaactccatgtttaacattttgaggaactgccaaattgttttccaaagctctgtgctattttacattcccaccagtaattaataaggattccaattttccatgtccttgccaacatctattttggtttgtcttttctattttagccatcctagtggaagttttgatttgcagttccctagtgataatgatgttgagtgtcttttattttttcctttttagaaaatagttcttgagcccaagggtttgagaccagctcgggcaacatagtgagaccctatctctacaaaaaatttaaaaagttagccgggtgcggtggtgcacaactatagtcccagctacttgggaggctgaggtgggaggactgcttgagcctgggagatcaaggctgcagtgatccatgattatgccactgcacttcagcctgggcaacagagtgagaccttgcctcaaaaaagttaaaattattattttttaactttatttcttatttaaaagttgagacaggatcttgc

SEQ ID NO: 75280 - DNA, 1533 bp, Homo sapiens
taactgaaaactcttaatcattaagacccatttcaaaagacacctctagtgtgaaggccttcttctcactcccttctctagattctcatggtatttgttcacacctctattatccaaccacgttgggtgttatttatctctttatatgttatctctctttattaaattatatgttctatgaggtcaggaaccttgtctttctgtgtgtctctttctcctttgttcttgtttttgtttgttttgtcttaccattgttgcctttgcactaagtatagcagacattcaataaacattttttgagcgaatgaatgaatggacatggcatttgagtaaggtcttgaggttgggtgggatttccacagattgatggtgatgggggagggaggctaagagaaaacagcctgagtagaagctgggaaagcccatatttgtaaataagattgacaactaatagagttattcaaggtgggcacaggcagagagcgctttaacaaaaagttggaaagggttgagaacatgataagaggtagtggagcagaggcttgcagtaatgaagacggctgtagtgaaaaagggatgaaagggtagttggttctgtcttcagttcacatctctcactgttccacggcctcagcatcctcaatcacttcctcagctttaaggtgtttccctctcaggcatctttctagtcctcttctttctcttgaattccagaaccatgtaatgattgaggaaaggaccctgggctggtagagaactgggttcaggtttcaacactgccaccaattagtcatgaaacattgagcaagtccctttaaacacatgcatttattaataccccaccttgtttcagaaaggatttaggatgtcaggaagttacttaatatcagggcttcagtttcctcacctctaaatgagagatttcatccaggtgatctaaattccttacagctctaatgttttgtgacctctgattccaatgatttgttggtcatctgcacttagaaatcctgctaacacttagtatgtagattatgaaaaactaaaagaaaaaaatctgaacctataaccctgttctcctaatgtgatttcttttaatggcatcaccatcctactaccagtgacccagggccaaaacttggtgtcattttcaactcctctagcccttgcccctacatctcacttaactgagtcatatggaactaactatgtaatgtcattcccatccttccccaactaggccctttcgtatggcctcatgtgattgaagcccttgctgactggctgtcccattctgttgacccttaatcttgatgctgctgagtcaatttcttgaagcacaaccgtaacaatgccaatgctttgttctattttatttatttatttatttttgagatggagtctcactctgttgtccacgctggagtgcagtctggtacaatctcagcttactgcaatctctgcctcccgggttcaagcgattctcctgcctcagcctcccgagtagctgggactacaggcgcatgccaccat

SEQ ID NO: 75281 - DNA, 1094 bp, Homo sapiens
actgctctggtaacaccacttgcagccttgtcataggtagatctattttcatgtctcctcttctttcctggatgcaagcatcttaaccttgacacgttgctctttcggtgattttagtctgtcattttgatgctggaaatatagatggggaatagaggagccagcttcagcaaattcatagctacagcgcctgaatggacactagatggcagtacgacaggcagactccaattgaggtttcaacagtggaacttaacgttctagccggaaggagccttagacaccatccagtccaacccctcatttttttgcagcaaacaaataaaaaaccccaagaacaagaaacaggagtgacttgctcagtaattgttgagtggcaagtgagtcatcagctttatcagtacaagagcattgactctgaagtaagttgctatatgtatgggactcggatgatgatctaatgtaagtactgttttgtgtgtctagatcaaatgatgccgtttggaaaaatttcccagcagttgtgtggcgtaaagaaactcccatggtcatgtgactccagatacttctggggctggttgaatgcagtgtttaataagtaagttactctaaataaagtgaagaaatgtggagatggttacagctaaataagttcccaatagcttgtttggctatttctcatatttacagtttgtgcagtgtgatcctaattttgtttacaaacaaacaaaacccacacaaacatggaaaaaacaccagaaaaacagattacaaaatattaattgtggctgtttgggttgcaggatttcgatgatttttcttacttgtccttttgatatatttcaagttttctaaaacattttataatcagaaaaacttattaaatataattttaaagtattttatttttatggctttttaaaggaatgtagttaaccttttgaattctatcaaagtaacttgggttttcaaaaaattagtgggtggcacacttagaaatgtcattttgaaacttgaaactaaccttctaattacttaatacagcattatgatcactagctagagaaaaaagcatatgtagaaattaataaata

SEQ ID NO: 75282 - DNA, 1103 bp, Homo sapiens
agattcagaattattttctctttaatcttttgttattaatacaaattctaaccaagtatagtcattcgtagaatagttactaagtatctctggtgtcaagcactgtactatatgtgaatcaatgaaacgttgtgtctgataaattcatataaaaataatacgccttgacagcgttcacgtggaaacaaaaacaaaactaaaaaagtcagcagatagactgcaggtttttttgtttttgtttttgttttttttgcatggatctcactaatttatcttcctcgtcagtcacttgaaatgaaaatttgttgcgttctgtattatttatgtcagttaatatagttaacaagctagtgattattgtaaaagcaaactgctttttttctcttgccaacagggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatgggtaactaccctatcgttttgctaatagaaaatgcagatgatttgcagtgaccattttgttgcagttgactcacgattatagtcataggtatgtcctttttgcccatttcattatagtcaagtttgtttcttcctgtgtttgatatttattttcaaattaaattgaggttacagacaccttcctctccttcctcctctcactaagcttgtttctgtatgtctctagtctttggtttattgacttaaaatccagggccttgtttgtcaaactatctttgtcaaacttctgtcattgagaagccctcaataatgcaggaataattatatccacacagcttctgcttacgtgggcatttttttttctttctttcttttttttttttttgagacagagtcttgctctgtcgcctaggctggagtgcagtggcgcgatctcagctcactgcaagctctgcctcccaggttcacgccattctcctgcctcagcctcctgagtagctg

SEQ ID NO: 75283 - DNA, 1567 bp, Homo sapiens
gtatctaagaattttcccagcttttgcccttttggggttgagattcacatttcatgtttcacatgcaaagaatatctacatcattataaatatatattttatttagaatgattcagctagaaatattgatgtaacccaaagtctgtgttacttcctggcatgaatttcatctctaaggctactgctctaaaagtaattttgaaggcatagggtgatatagattcattttctacataattttctttctttaagtcagtaaattgaatttatttttaatgctcttggccaaattgaagtgacttttttctttatttgcagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctcaaaaaaaaaaaaaaaagaaaaatgtaaactaggtaacattttaattctaatatattcatttaatatgtaaatctatagatatctcttgatgtagatatttagaatcctttaaagttatttgtacaacagatgtttttattataacagtaatttacatttaactttaaagttagtgaagcatactaccataaatgcacaattatgaaaaattagaagctaaattacagattcattgatggagtcaattatgcaaagtggtcagtggttgttgaagcatgcattgcttcaacaggatttgcgtgcatttcccatgatcctgcattcttgtgttcttgatagcatacagacttactcagaatcaacagttgctgcttaatttgtctattttgtaagcttaggctactattttattaaaactggacatagatacttggctgaatacaaatagttttgcagattgcaatataataaaggaaacagtaaaaactagtgggctatgcttaggtttttcttgaaacctaacattgctttaggctgggtgccgtggctcgtgcctgtaatcccagtgctttgggaggctgaggtgggaggatcacttgagaccaggagtttgagaccaatttgggcaaca

SEQ ID NO: 75284 - DNA, 1050 bp, Homo sapiens
tactaaaaagcttaattacctcttttgtgatatattctaaataatgaaaaaaatgcatggcacagttttgaacctaattctgtgttttgcatttttagttgcagtacctaccccagctaactggcagcagcatccttccagctttggataataagaagtactactgtgataccaagaaacttaactaccgttttccaaacatttaaaggagctaggagacatgattttaaaaaaggaatcaatagatgctttgaagaaaataaaacttatacagttgattgaaaacaattacaatgttgaaaacacaccaggagaaaacataagcaagaaactgggaggccaactggcaagatatgaagggaaattccagatccagtcttccatgcttgatgatggtgtccagaaaagaaaaaacctgtttggagttgcacttgtatttcagtttatgtaagtagccgaacttatggacagaatatgaactgtcccatacctctggcaaaactagatgatatcaaaaagatttatgcttcagttgtaccacatgccacacaagaaaaatgaaccacaaaatgcccatatatatttcctcggatctctgttgcctgagtcctatctcctgcctctcagattgtttcagcatcatatttaagatagttctatttcttgaaatcaaaatgtttaaaatcccatttcctgcttgctctatttcttgatttttatattttaaaacattttgagggtaacacttaggttcaaaatatttaaaagcatatgaattatcacaaaagcttggtaatttataatttaattatatgtttccacatttcatccttactttatcagtaaaggatacaccttagtcacttttgcaggcaacgtggatttactgtaatctgtctacatttattcacccaattccccttgtaaacaatggcatgaagctcggcagctgattaaggcagtcaaagggtagagcaagacctacaggctttgcaggaactgaacctatcagcctgaaaataattagtatttcattctctctggcacagc

SEQ ID NO: 75285 - DNA, 1053 bp, Homo sapiens
gaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagt

SEQ ID NO: 75286 - DNA, 1060 bp, Homo sapiens
tgttttactctctaatactcattggttttatgatgaaaattattacagtttattattgtttgcatgctcattgatcatatgtcagtatcttccccaggagtgacagaacttgtgaaaaaaatgatgaatggaaacatttttaaacatttcatgatatgattctaccataaatcaaaggcactaaaatgaagttggtaatttttatttgggccataaaaaataacatgtactttataattacatatttttaaaaacacgattttcattacttagttttttatttttaagaaacattttaatatgtatttctcaattggagttttatccacaaaatgtttgtgcctctgtgtgacattttacatgaaaatagtttgcttatgattgggaaatttaatttattaaagcagaaaacctaaactttctgtaaatgtcaggacaaaagaaattttggaaactagtttcttcttttactccttatattacatgccaatttggatttaacatttttgagagagattctgacataggaatccttaattcctcttcactttcattgaaacacactgatacctcaactttttcagatgtgccaaattatcttcgtaattttaattgttacacaaaagtttgttcctcctaggctaccatcttttcttgccagtaaaccttggaataattacaggaatcctcctggggaaaaaaaaatgcctttacaacacctcttaaaaataaaatcagtaactaggttttttatttgtcacagttagtgaaacacatgtgatttgtcattgtcaaatacttttatttttattgagcttaattatgttcccagaacattcttacattaactttttacaaaaagttaatagtctaataaaacagttaattttcagttactttcctccatcacttttaattatgcttttctaactctaatacttacttgtaatggttaaatactaagaattttatgtaagaattgactcacagatcctaaatattcaatgtgtggttaaatgttggattgtggggcaggtttattttattttattttttattt

SEQ ID NO: 75287 - DNA, 1285 bp, Homo sapiens
aataacactgtttatggagagcatattatttgattgtgtgttaaatggcttctaaaaagctggagtcctcaaaagaatatttaatatattttaattatgcttccccaaaatcttttttacttttgtttggtaaaatattaatatgttaatattttatattactgttatgaaaataaagccaattctgtttgagttgacaattatgaattgtatcatataaacttttctctaactctcttactgcttatccctactcatacttgtctttggaaataagcttaaaaattacacagggtacatcttagatagcaacgcccaataggaggcatgtacatgtgtgtttagctgcctggctagctgggtagcaaactatgtagattggggaaatggagaaaggaagggtgtttaatgtttaggcagaatatttctgttctgagaacatacagataattttgttgaggataaaactgtgtatatgtgtgtgtatatatgtatgttttctaataataaaaagataaatattgttttgtattgttatattatcataccatatatagtgagaaatcagatgatgtttaccatatccatccctcttacttaatacagccatattttttattatatggaattgtagccctgttatccttgtatcatggcttataatattggttggttttacttttttaagtatttccatctgttatatttaagacttcattcacaatgatttttaatccaaggtaatttgttaagttattgataaataggtctgtcccagagaaataataatatagctttatagaattttccatcttgtattaaaataatcacatgtacatcattgtaactcagtccataacataagattttgtacaacaatttctttttgtgtgctggcatcattaaggtttagtctgcccagatcacctattagtacctaatttatatattctgaattaaaattatctgttaatttaaaaacattttatctattgtctttcaaaatagtattaactgagggtttttttgtgtgtgtttttctattttgcttggctttttgaacattactggactctcgttttagaaggtaattacgttttctttttctcgaaaattgtatttctctgctgtaaatgattctcaaaaaggtaacatgtttttcttttataggaaaaacctttcagctctactctcacaatcttatagctttgtttgaacatgccaaaaaaccaggattagctgcccatattcaaactcacaggtttccagaccgaatactaccaag

SEQ ID NO: 75288 - DNA, 1394 bp, Homo sapiens
gatttctaggctcagcatctacttttattgccccagaattggaagcagtctttctctaagaagccctggttctttttagtggaaagtaatatttagaaaccaagatctggatactaggtgtgctcattatttctagtgtgtcgtgatttataatttatattaactttttgtttccttggtcaaaagagtgtttgaggtgtcttgcaaaaatgtgtaactataaaaatcttaaaatacaaaaattatgttgaaaggcagggttatatagtaagataaagtcagagtgagttagtctaacatagaatatatctgcttttaaaaaataagaaaggaattggggaaagaggtaaagaaggtgatacaaatttaagaaaataattttattttagatggataggtggctaattcttgatgccattacaatgtaaagtcattattttagtgaatgatttcagaagatgatggtaaattctggtgatttatctcaactattttagatcagtacattatttttggaactgaagatggtatttacacactgaatctcaatgagctacatgaggcaacgatggaacaggtaattaggcattttaattcaagaaattaatttaaacaaattgaataaagaagtgtcttaattttaaatcaatctgtgtaggccccaattttaatttttatgatttaaatatttaaagggataaaattgtactctttgcatgttcatgttgaaagattttttttcttaagggtttgataattacctgaaagttagaaaatagttatttttatatgatttcagaatgttggaatttaaaagattaaaataatgacaatgagagaatcttaattatcttctttttcttagttatttccacggaagtgtacttggctgtatgttatcaataatactttaatgtcattatcaggtatgtatgtgatgatgaaaaataaaccatagataagcagagaaatgtaattttaatatacaccatttttaaatgttatttgtaattctggatgactataatctaatatagtaactctgggacttgtggatatttgctacccacctagaatgggaagaaactttgggaagggatcctgtcttcagttagggctgcactttccaaacccacccagcatctaaacacctgaagggtatcacagtgcttatcactagaggccgttcccttccactcagcctcctccactatcactgtcaccactcctggcctcctttgggaattaacaggaaagaagcagaggatcacactattttctttctctgcgatcctgaacaagtcactgtctctcagcctcatttatcttaattataaaatgaggatgatggggtaacagtacagccttatgaggttgtgagagttaaatgagat

SEQ ID NO: 75289 - DNA, 1555 bp, Homo sapiens
gtgaaagacaaatagtgggagaaaggggaaataatttttcaaggaaagtgcttatttgtgtggtcattcaacttttaacatgattctctttaggaaatggtgatggtatttcaaaactgatgagtgaaaatacagaaggatcagcacaagcaccacagttaccacgaaaaaaggacaaacgagacttccctgtaggtataacaggcatttagcaattagttgtaaataatactatatttatcatgcaaggggcatagtctgtttaattcagtaattcaagtaacagaagttctaaatgtctcaagtttctttttaagacttaggaggtcttacactagtaaattttatttttcccatagaaaccagccatcaatggccttccacccaccccaaaagttctggtaaggaatatttttatgtgaactatttgccgttttttctctctttagaagcagcaatatattggctatcaatatacttgagcctttgaaagttaagatatcataaaatacaaagatattgaatgcatttggatatctcatcatgtattctaatttgagtgtgtgaattggaattgacagtgtttcactttttgtaaatactggcagttgagtcatcagattagcctacaaaggcctatttaattttaatgcgatgatattaatagtactgtgtcctcttcttgatgtggattaaatatctttctacctctaaagtgattttcacattggactatatacaattaaaaggaaccagggaagcttatattaatgcattttcctggccagtcagtggaacttatctgtgaatgggaaccccatgatcccatgaatgggatgggaaccaatcgtatgaatgggatgctttatacattgtccttttttattcagtgaaagtctaatgtataatataaatatcaacctttttgtctcttatgactattaaagagttatactgcaattgtaatcactataatgttactgaataaaattatccattgtttcacattaataattgtcagtcctaaaaaatagtagtaacttaaaattcctagactatgttattgatgtatgtagatcttttggtaaatttgatatttgtgccataaaatagtggattacaaaaggaaagaatatgagactgtcttggtagtaggggtttaatgatgtgaaaatatgaattttgttttggaatgaaacaacaagcatacgcaaataagagttaatttggtatttcaatgatgttagttattttccaagaatatataaaattttctaatcaaataagttaacatttctttctttataaataagatgggagcatgcttttcaaaagtttttgatggctgtcctttgaaaattaattgtgcaacatcctggatacatcctgatacaaaaggtaaaatgtttgaattttatatacatctccaataaaatatttattatgggaaagatctttatgatcagtgacttgaagttgtttattttaaaaatacgactttagagacctaatggtataggaacctgcaacaacctaaataggtcaatagggtttt

SEQ ID NO: 75290 - DNA, 1921 bp, Homo sapiens
agaatcctgaaagccgcctaattgattgcaatgactgtggataagtgtgtgggaccagtggactagataagtgcttctcaaacttattgacctggagagcttattaaaaggaagattctgtgcatttagaaaagttcccagatgatgccaattctgctggtttgaggatctactttgagtaacaaaaggtttgatgatatacccacttgaatctatgggtcccaactctaaaattctgaatcagttttttaaccaagaagttaacttagtttttattacataagaaatatagcaaagcataaccataaaagtaaaataagactttgtgtccactttttaaaatctttattttatagacatacaatttgacaatatgagtgaggtcttaggtcttcctaaagattttatactctgcatcgtgatctgtcttttacatcctctgtatagaaactgattttaatacatatttaatagtatctgtgttttcggttacggtcatttatcatcatctaaattgcatttcttctttgtattagatcaacctcaaaacgtgcaataccacctcccctacctcctaaggtgagctacttaatgattttgaacactaaatccttatttaaataatatagttaaatttttaaaataattttgagttttttcaaaattttcttaaatgtattttagatgaatagagttttcttcaaaagaagtgtatgatggtgtaaaatatatagtaaagaagatttcatgaggaatacaatatttttaatagctattagaaaaaggcggccaggcgtggttggtggctcacgcatataatcccagcacttcgggagacaaaggcaagtggatcacttcagatcaggagtttgagaccagcctggccaagtggtgaaaccctctctactaaaaatacaaaaattagctgggcatggtggcgtatgcttgtaatcccagctacttgggaagctgaggcatgagaatcgcttgaacccaggaggtggaggttgcagtgagctgagatcgtgccactgcactccagcctgggtgacagagcgagactccatctcagtaaaaaaagaaagaaagaaaaaggcaaaaacaggttattgcttattgaagaaaatatttgactacatggaggggaaacagttcatcatttatcattcttatgactacaatttgacatattagtggagtcatttttcttgattgtttctagttgttttgtggatttttatataattatattagttataaaaattttatcagttttaaggctgattaaaaatcacatggcaagttgatagttgtgttgggcagtaactcacctcttactttgctcacttagcccagtgaattgaactgtatagaagaatgaaaaaaggtgcatttccctttccctaaagactctgatgcctaatgataactgttaaagtacttttttgtctttgtaccactagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggtatggctagcattattagcagccatggggtacatatggctagatattgttatctgggtgaataaatcaaagtgaaaactgaaatgagagtcatttgttcctatttcaaaaaatatcttttttatttagtcaatcctattatagcttaaagctttgtaaaggctctttaattctgcatggatgggctataaatagatttcagttcacttcaatcctaatttgaatccttactaaatatttattataggatctagaagggtgaatgcatgtttctgcccccagaacttcagggtctacagcagaa

SEQ ID NO: 75291 - DNA, 1022 bp, Homo sapiens
taatttcctgattccaaacaagaattaagtagagatgttaggaagatcccactttgttatttacttttggtaagcataacaaaggggtactcttgtagtcaaaaaataacatattttttgtcttctttcccctcttctttctccctcccccaccccatatacaaacttgtcattacatttctgagatcaaccctttgagatgctgagtttgtacatacctgttatatattttgcagttgacaaattacaatttgaacctcctctgagaaaagaaacagaagcacgagatgaaatggtaagaattcatttttaaagcattattttcacattaagatttgagaaaactttttttttgttagttgtactttgattagaaaacaaagtaatatactcttttaagcattaattttgacaatttttcccgtattaaagtttttaaaagtttatagttagttttatttttactagagtacgatgtaatacactatttcaatcattcattttaacctccttagtcttttgaaggttttacatgatgttattaaatacgcagaatttgattctcagctttaagctcttaggacctttttttttttaactgattctgtttgttttatagtaaattctacattctgtattgccttactattttttaaatatattttatttgttaatatagtttcttttttaaccattgctgctattttgaatttactatctagttacctctttccttatctaaaatgaaaaaagtggccgggcccagtggccaactcctgtaatctcagtactatgggaggctgaggcagacagatcacctgaggtcaggagttccagaccagcctggccaacatggcagaaccctgtctttactaaaaatacaaaaatcagccaggcgtggtggcatgtgcctataaacccagctcctcaggaggctgaggcagggagaattgcttgaacccaggaggtggaggttgcagtgagccaagatcaagctactgcactccatccagcctgggcga

SEQ ID NO: 75292 - DNA, 1089 bp, Homo sapiens
ctctccgcccaggcgaattactattctgatctctgtcacataaactggcttttacctgatcttgaccttcaggtaaatggaattatacaaaaagcaacttttgttcctggcttcttttactcaactttatgtctgttagagtcatgtgtagtaatagttcagttttcactacactgtagtattccattgtatgaccataccacaatttatccattcttctgttgatgagcatttgatttatttctggttttgggctattatgactactgtaagcatttttacagtgtatttttagtggacataaatgattattatgaatcacacccaatcagtctaagaccaccaggggcaaatgtgtagtccaacaaagtcaggtttactgactccctgcagtgagagagaacacacaccagaggaaccaaaccattcaagatttcatcaaacaagggaaaagaaatacaggattttggaaagagtagagttcaggtgaattttaaatgatgacttaatgcaaagtagggatgtatctgaaagggtgaacatcaggtctccgctgttaaagtaaacccgggagtatgtttccttggaaactttttgaagtgttgtgttcagaaatgcctttatttgaagctctgcatctggactggaaattgagtctgtttctctgtgtcagtgatttagtccaggcaagaataggatgattcattctaaatgtgatttcatgtagcaatgtttctggcagtcagtgattttagagagagagacatttctcagttagaaagcagaataactcagagggggtcattatatgaaactttacatgtacaaagtatccttgggagaaacattgtttcttgttgactttgcatttggatttgtgtctgtcctttcagctttatgaatggcaagacagatttcctactttctcagtctgattcagatatgactgtattagctaaattacctaattttttttctttttttttttttggtttgtcatctgaagagtgtattggtggttgagtcgttacctaggaaaccagctgattacaaggaattggcaccaagggaaggtaggaggtattcacg

SEQ ID NO: 75293 - DNA, 1008 bp, Homo sapiens
ctttcccttctcagttgtttcaatcaggccttttcataattaagccagtaattcaagatttagtgtctttgttagtgcctagattgatgatatcttcttatgctgttctctccttttataatctgaggtgaagtctgtgggcctccaatactaaagagaaaagtaacaaagttgatattccattgtaacatcatattctttattttatgcagttctgtagtattccattaatgtagtctattttatctatcttttctcgtatagttttgggttttgtgtcatatttagaaggctttctcgattccagagttatcaaataattttcctattgtttcttcttgtgtttttagtttctttttttaatatttaaaaacctgatatacattatttggtagaaggtaagaagtatggattcaacttgagtttctttctagatgactactcatttgtttcattatttattgaaaatgcaatctttctactcatggatttgatatgccatctttattatataccgaattggcatagatattttagggttgtttctggaaattctattctattctggaaattctattctgttgcatgtctgtttttgtgccagtagcatacttttgattattatatcttgataatatctgttagaactaatcctactcctactctctgcccctccccacaacacacacatatgtaccttgtcacacttctttttcattatgacatttggctattgtgccttcttccccacataaacttaagaatcagcttatgtggttaaaaaaaaacagaaaaattcattgtttttacacagatcttattactttgggagagttgacatatttatgatattcagtcttcttaatcaaaataggcttcttcagagataagatttagttcttttatattccataatattagcccaaaatactaatatcctcatagagtaagttctggttgcttaaagcaccagacaaagcggtagagtagaaggtcactttattaatg

SEQ ID NO: 75294 - DNA, 1043 bp, Homo sapiens
taagggtttgattgtaaaatacagaccaaaaaggaagaaagcaaaattacttttgcaatactttttctatatacttaaataatatataatctttttcacataatataaacctattttcatgtcacagcacactgtactgtaatttatttaaccatccttgcattattaaaccatactgtggtaaacatctgtctttgtacatatctccttaagaaaaaaaaaatttgtaagtaaaattgtgggttcaaagattctgtatattttaaagacttctgactttatagaaagattctaccagtttacattttcattgaagtattaagaatgcctcattcctcatctctaatatttattgtaaagttttccttccttcttttcatatgtagagattttgagtaacatgataaacaacttattttgttttccaggagatgatttttctttgattcaacaagaaatatttatggttaaagaatgtaaacattgtaacatcgttgcctactttgggagttatcttaggtaagagaaaaaaaagcatcatctctctctgtattttatatattctttgctactacactctctcccttgtatgtaagtgctactatatttgtatgtttttaaacactgcaaagttctaaattttttaaggttttcctatttctacggttttcccctattacatattaataatggtactcccatttttatagttgtacctcatctggcaattttaatgaaacataagtgattacaagtaagtgttttaacttacaaaactgatcatattctaaaccactgaagatgggaacaaagctgaaattaatgtgcttttctgtatattgtagcaagattacatagcagtttcctgttgcacttcacagtccattctgaaccctggtgtgctaaagagtgagagccttagagtatttcagtgattgaaaattactagctaatataattttcttttttttttgtattagtcgggaaaaactatggatttgtatggaatactgtggtggcggatcacttcaagatatttacca

SEQ ID NO: 75295 - DNA, 1074 bp, Homo sapiens
cagtatacaagggttctagcttctccacatcacctctaaccagttttattttctgctttttttaattgtagccatcctaatggatgtgaagtgatatctcattgtggttttatttgagtttctctgattaatgatgttgagcatgtttttatgtgcttattggctgtttgcaggtcatctttggataaatgtctattcaagtcctttcccatttttaaaatcaggtcatttgattttttcttgtgagtcgtaggagttctttatatattctgggtattaaacccttcttagatacaggatttgaaaatattttctcctgttctataggttgccttttcaactctgttgattttgtcctttggtgaacaaaattttttaaatttcatttgtagtctcgtctgttttttgttgcctgtgcttttggtatcatataccagaaataactgccaaatctgatgtcatgaagcttttcttctgtgatttcttctaggagtttgataatttggggtcttacatttatatctttaaatcattttaagttttgtgtatggtttaaggcaggggtccaactttattcttttgcatgtgaatatccagtttccccaaaccatttgttgaagagactgccctctccccatcaagtagttctgatacccttgttgaagatcatttgaccatatatactacatgagggtttgtttctgggctgtcggttctattccattggtctttaatatatctgtctttatgtcagtaccctactgttttgattatggtagcttttagtaagttttgagatcaggaagcatgagtcttccaactttgttcttctttttcaaaattgttttggctatggagagtctcttaaaattttatacaaattttagaatgattcttttttatttctgcaaaaaaaaatgttaccagaatttttcatagggattgtgtagctatttatatcactttgggtagtattgacatcttagtaatattaagttgggttgggcacggtggctcacgcttgtaatcccagcactttgggaggctgaagtgggcggatcacgaggtcaggag

SEQ ID NO: 75296 - DNA, 1060 bp, Homo sapiens
tttttaccttgaatataactttatctgacattgatattgccaaccctcctttctttttgtttatatttatgtggcatacaacaaatggatagaactggtatacttgggcctatcattatcctttctaggttgttgatgtttctcttgtaaaaaattatatttgacttttgttttataacccaatctgaatttttctttttttaatatgtgaatctgtccactattatattgtttggagagatgtttaattttaattctgttgttgtttttgtttttaatattttcttaaattttaaaaaaaattatagctgggggtttcttttatttttactgctgataatttgtaagatacaattctgtagttttgtcagagaatggcttgtaagaccttgaataatatacttaaatttgtgggtgttttagtttatcagtttaagaaataaaacagtcatctgttgaattcttggtttacagattttgaaatttgcatatttatactcttcctgcctcatcatccccccaattttcaactgttcattggtttatttggggattttagcccagaaactttctgattgcactggggtatgagtatgtattactatgtgtaccttcttttaagaaatataatatttataatttataaatgccatgaccaattatttagacttagttttatatttagtagatttactacccaccattggtctttttatgccatttcctttccattctcacctacttagtatcaactatcaataggctaagtcatattatcaaaaagattttcccgtattaggaatattataatttaaatccataaattgattattcttctcaaacctgcttttcttctgcattttgctaagcagttaacccatccacaaatgtaggcattaacctcgatttctctcttttatttgtgctcaagaatcagtctgtcagcaagttccctcagctctacctccagaacacatcctgaatccatctacttgtctttgttacccatctccacccttctagtgcctgttgccttgcccacacctcccattccccacca

SEQ ID NO: 75297 - DNA, 1051 bp, Homo sapiens
aatatcttcaattaaattaccctgaaggtggttagttaaaggtaagtttgatgtgacagttttgttgccaaataaaatttgacatgtacacattcagaattggaagacacattgacactgttaaagtaattttcttttaagatgatagtgaagtatttgaacttcaggtttagcttttatgagaatttgattaggaaagtattcaatgattttttggggtgaatatttgggataatgacatttgtttgtcagctattccctttgattgatttaggtttgttaattctggtcttagcttaatgcttattttattaacacttctgtgtgtcagaagactgcttgtttcaaaacacattgaatagtttgctttgcaaataaaactatagtcctggaacggttttatgattttgatatcctaaaagtttctaatgagtgcagtagtagtttttgaccaggtaagcgaatatttggtggtatgttcatttgctggttcataagcttaggcacgtaggataagtttgtgaccataattatgccagtttcctagtttgagcggttaaaatgactttgcatttcaaacacagtatttgaatcattatacatgtgattcattagagagataatagtactgaggtagcatatgctggaacactttaaaaataagctttcagatatgtcccagtatcttttttgtcctggcaaatagaaattgttataataatactctttcaggatcctcttattaagtgccacctaataagtttaaaatgatctccaaaatgtcactaacacaaatagggaatataacagaactatacaagcctttgcctgtcctggaaaagtcactagagcaaatattcaaattatgttcaaggatggttattcaagttatgtccaggtactggcgtgtgctctcagagaaaacaaagatatttatcccttttctgtcttaagcgagtgcagtgggcttgttacaacacggtttcacttacttgacttgagggtatggcttatttttcattaggttgatgcataaataattgcagttttt

SEQ ID NO: 75298 - DNA, 1056 bp, Homo sapiens
aaaaggtcataaattagtaaattccatttccacatatgatgtaccacggggtacgatgaaaatgagcactcacattaacaaagagagtatagtggtaaaatgtttttagactatttgatggtatgtgttcatattcacaacctttgacctagtaataccgtatcttagaatccatttaaaacaaatatgtcttaaataatgaaaagactatatgtaacatcctttatgtccaacaataaagaggattattatatggactatgttataatcatttaattttcaccaacaataagttttggcagacatggttttaacatccaaggttttaacatccaaggtcgatgacagtaaaaattcgcacagtgttttagagcaatatggcaacatacccattataagtccacataccttttggtctcacaattgtatgtctaggttgccttccttataagctgatctatggtaaaatattggtaatgatattcattgcagtgctaattatagtaagtttgttgatattgtgttaaatagtaaatagtttctcttctagacatttaactgaaggaaataaggctgtggatagatacaaagctaagatatatgtatccctatttttataacttgaaaataatattaaaattgtaaatgcccaacaatagagggttgggtaaattatatatcctgtcagtggaaaatcaggcagcatttgtaatcatgtcttagaagactatgatggggtcatcttcttccataatgcacatgcatatacatatgtgtaccaggaaagagatgcatgtacactgaaatgttcactgtttttctctaggtagttagatacagatgatgaaaatttttaatgacctatgattatgttttctgatataaataaaacccatgagatttttaaaattaaaaatattaactaacccgaggctgaagaaaagccttggaggaagtagaccaaattttaaacaggagctgtttttgagtggtgggactattggtaattttttaaacacttttgtgtcttatctatatttttctttaatgggaaaa

SEQ ID NO: 75299 - DNA, 1063 bp, Homo sapiens
gtttatgtattcacctattggaggacatcttgattacttccagttttgggtgactgtgaataaagactgctttaaacacttatgtataggtttttatgtggacataactttttagctcagttgggtacatgccaaggagtggggttgctggctggctcataaggtaagactatgtttagctttgtgagaaactgccaaagtatcaaggtttgtgttctgtccatatgtgttcttaggactcaacctaattaaaagtttggaaggatatactctaaaccattaacaatagttattttggaagatgagattgggatggagagggactgtcatctttcactgatttatattattttaatttttctaccacaaaatcttacttttgtagtaatttttttcaaataattttcttcaaaatactttaattcatcataatatgactcaacataagtgaaaaaagtaagactatttaaaataatgtattgtcagtttcatagcattttctagttgtggaagattttaatttttttaagagagcaataaccttcctacaaccatgattgtctattcaacaaatttgtagagcatctaccatgtggcacagcctttcaaaggatcatgcgtagagctaagatgacaacacacttaatccagccttaggataccagggagacttcctggaggaggtgataactaaactgaattctgaaggacgagtctgagttaaccaggccaaacggggagggaggcggggaaaggagaacgtaccagaatgaggacagttttcagatcagagaccgagctattcacttctgattaatctgactaaaatcagaattaattgttccaaactctcagagaagcatattagatcttttcatgttgttgactcttgtttaataattggtaaccgagaagaatggagtcattttcttttggttcctcaaagtaagtggcagtgaatggcagaatgcattgcccaaatgcctgtttttgcttggcataatgaattgcctgaagatattttgttgttgaaaatgtgttagcatcagtcattgtcatatga

SEQ ID NO: 75300 - DNA, 1027 bp, Homo sapiens
tgtttgttgaataaatgaaccagttaaaaacagtgtttcagccgggactagtggctcacgcctgtaatcccagcactttgggaggatgaggtgggtagattacttgaggtaaggaatttgagaccatcctggccaatgtggtgataccctctctctactaaaaatacaaaaaaaaaaattagccaggcctggtggtgcctgccttagtcccggctactcaggaggctgaggcacgagaattgcttgagcctgggaggtggaggctgcagtgagctgagatcacaccactgtgctccagcctgggtgacagagcaagactcggcctcaaaaaaacaaaaacaaaacaaaacaataacagagaaagcaatgttccataaagtattgagtatagaggttttacagcctatgacatagttgacttttcacttttattgtggattaatcagctactttgtatttttcaaaccttatgggtgctgcgttgcttcttttgtattgtagatcatgttcttaaatctggaatacataattatgactctgagaagcagtcactggccactggagatagcttgttaaaaatattgagatgtctggattttctgatgttatgttatagaataaaggggcatatttaaaactgaagtccacagttggcttaatggaaaagttttgtgaccctaagaatgtgctgggagaaagttgtctggggtaggatgagagacccaatgtgaagaacagagaaatacaggagctttttcatttttcttcatggtgatggtcttggttgccatagcttttagatggctgtccttacttgctggtttttttttttttagccccagtttataaaaaattatctttcaacttcatgaatactaggatgtattactatgtattgattcgtgtcttccaattctgtgttgaaaccttgtaggtaaaatgtttagacttttcttcattaacttttagttttcattaaaaattttacagtatgtagaagagttcatagtttacaaaactggcaatt

SEQ ID NO: 75301 - DNA, 1049 bp, Homo sapiens
caggtgatctgcccttcttgacctcccgaagtgctgggattacaggcatgagccactgtacctggtgatacatgttcatttttaaaactatataggaatgaaaaattacttgtgtctcctttaccaagagataaacattcccaacttttaaaaattcatattaaggacatacgtataaatcatagaatagatatgtataataatatacagtatatattatatagatgtatatttgataacgtgcttttaaatttaacaatatataacaactttttgtcagtaaatatacatatttaatacttgtgtattattttcttgtatagttatataatttttagttcattatatacaaacatacaagcaattgtctccaatatttctttattgtaaataatgctgggatcagtatccttgaacagatttttttcacacaatcttaattatttctttaaataaatttctagagctaaatttcctaaattgtcttaaaggttttggtgaattttaaccaattattctccaaaaaaatttgcacccatcaacaatgactgagagttcacatcttccctaccctgaaactcaagccctttcctccctttcctttgccattaagacctccagataattagttcaatttaagtaatcctctgtaagtaattcttcttttaataaaatcagtctgtgttagaaaagagttgggagaaaccttttcagagacagatgagtatcctaatagattgggcggaagacctgagattgaagtcatgtgaacagattttgggtcattctaagggaaggctttaggctctgaatctgtctgcctgggagtggggaaattgtgcagtatagcctccttccatgggataggaagcacctgtccagacctgtataattgtgtggaagccagcctggaagtaacttgctccacaaaaattaaggagttttgcaccgcatgttctcgcttataagtgggagttgaacagtgagaacacagggacacagggaggggaataatacacactagggcttgttggtggtggggggtgagg

SEQ ID NO: 75302 - DNA, 1019 bp, Homo sapiens
caggatgtcgctctgtcccccaggctagagggcagtggtgtgatcttggttcattgaagcctcaacctcccgggctgaagtgatcctcccacctcagccccccaagtagctggcactacaggtgtgtgccaccatgtctggctaatttttgtatttttttttagtagagaggaggtcttgccatgtttcccagtctggtctcgaactcctgagcttaaatgatctgcctgcctcggcctcccaaagtattgaaattacaggcatgagccaccacatccggccctgtgatgctgtctaatgataccctgcgtgtgtatttttattacaaatttcatctatttgagttctctggggaaatatttctgaaaaactattttatagtatatccactatcagtgatctaagtcctatagaattttgtcagtttaaatttactccttagtatgcctaaaaacacataacctgaaactgtagtgctgaattttttaagctctgggcaattagagtaattttgctatttatcactgtgtttctgatgagctgaacatcctaggacgttttagaagtattttcaatgtaggatataaactagtgaaatacctgcagtaaagaataatgaaggtaaattagccactgttctactcagataatatccccctgtgtttttgagagatggtcttgtgctttaggctggagtccagtggcacgatcagctcactgcagccttgaactcctgggcttaagggattctctctcctcagcctcctcagtagctgggactacaagtgtgtgtggcaacatgcctggctaattttttttttttttaatgtaaagacagggtcttcctgtgttgcccaagctagtctcaaattcttgaccccatgtgatgcttctgcctcagtctcccaaagggctgggattaataggtgtgagccaccaagcctggatttttccctgcctttttttttttttttttttttacaccttaggtatcttttgaagcagaagctttaaaggac

SEQ ID NO: 75303 - DNA, 1056 bp, Homo sapiens
aactcctgacctcaggtgatccacccacctcagccccccaaagtgctgggattacaggcgtgagccactgcacccggccaggacaacctgttcttaccctctccaaaggtaaacactttcattaatttgaagtttctaattctcttgataatttttacagtttagctataaataaatatatatatatccctaaataatatactatttagttttacatttgaagagcctaatataaagggaatctagagtgtgcatttttccacaagatattttgttcactccacatccttacccatagttggtaatatgataggtctgaaatggtatctcattgtagtttcaatctgcattttactgattaccagtgagatgtgagcatatatttattgtccattcacatttcctcctcagtgcctgtttgccctttgcccattttaaaattaggttatctttttcttcttgctttgtaggagttttatacatattttttatataagtcctttgctgattgtcttatagatctcttttaccactttttgcatgactttgatctctatggtgtattttaataaacagacattatgtatttaaacgtagtccatttaaacaatattttcctttatggcttgtactttttatatttaaaaaaatcttctcttacctcaaagttataaaatcgtcttctatattatctggttttaaaattttacacttcattttttttcagtttttaaaatttgtggtaaaatacacataacataaattttaccatcataaccatttttaaatgtacagttccgtgatactagtacacaagtaaaatattgttgtgtagctatcaccactgtctatctcccgaactcttcatcttgcaaaactgaaactctgtgcccattaaacagtaactcctcatccctcctcatggctactagcagccaccattctactttctttcactatgactttgactactctgtgtacctcacgttagtggaatgatacatttttttttttactggctttttcacatagcaaaatgtcctcaagtttcatcca

SEQ ID NO: 75304 - DNA, 1035 bp, Homo sapiens
tatttagagcatcattacatggtgatatggtgacagatatattttttcttttctttctttctttttttttttttttttttttgatacagagtttcactcttgttacccaggctggaatgcagtggcgcaatcttggttcactgcaacctctgcctcccgggttcaaggattctcctgcctcagcctcccaagtagctgggattacaagcatgcgccaccacatctggataattttttgtatttttagtagagacagggtttcactatgttgaccaggctggtctcaaactcctaaccttgtgatccacctgcctcggcctcccaaagtgctgagattacagacatgagccaccatgcccagcctgatcgacgtatttctaagtgtagttcagggaagggcatattgtaggcaaaagtaactggagaaagcttcatagagatattggaagttagaatagattttgaagatgtgtggatctggaccagaaaaggaagaatggacattctggactatgaggaataagtataatatatgtattaaacagagtgtacaccttcttccctagagtggaaattaagtattggagatgaagaagaaataagattgaataggttattgagccagataatagaacaaattcacagaagaaccaaagctcttgataacggtctaaaatgccttttagaacaagataggatataattaaatacatttttctttaaattagtttatgtagattttttatcagtccaagtagtcctctcccaaattcctctgcattcgttactgtaaggttttagattggacaattatctaatgagatcttccaaaaactaataacttattctctgtaacagatatcaaaatgggggtaactactatcaaccaaggtcaccaattactgacttactaaatctatgggatattttccatgccttatccaacttgatcttcagcctttaaacaattgataatttttcctattctgtcttcctttggcttctcaaactccacttgcatcagtacttgtctat

SEQ ID NO: 75305 - DNA, 1063 bp, Homo sapiens
acaggtatgaaataagcccattttgatgatgtttctttaactaaaaattatgagtatatgtgtttctacatacatgttataattagataaacaacagaaattgggaatcatatatattgtttgactcaattagcatacgagttctcgtgatttctgtgagagtggaattgtttttgttactgtagtttaattactgacaaactttcaaattgactgctttggttagaaaaggtcatattatcttattgggatttttgttgttgttgtttaaagcctacaataaactcagtaacataaatcttatatgcgtatacattgagaccatctattgtaagttatgtttaatgaaacagtgtttataaatataaattttgttctacatagccagtagaaacatttctaaatgtaaaaacatttacatgtgttcatagcttttaaaaacaccttaatgtacatttaggaaagtaaatagcttatatataaaatttatctttctttcctttccttttttctttcacttttttaaaagtcttatttttgaggttattgtgggctttctaaattgtcctgaaaatccttgtagagttttattagaaccatagaatccatagcataaaagattttaagactatttttagatattttcaatccactggcaaaagcaaaaagagagtggccaaggaacagggcagatcaataaaaaaaggtaagatagcttaaaaaggcagaaaaggcaaagcagttaggatgagtgagtcaagactaaaattacaagcaagcatagagaatggagctagtgaaccagcaacaagggcgtcatatatgattaggacaaccaagacagggtaaacagaaggaggaaggaagactgaatttattaaataaaggactttaaagtaaaagtcataaaaaaaaaagtcatggttataacctacttaatcaacttttaaaaattaacttttctttcagttgacaaataaaaattatatatattggccaggcacggtggctcacgcctgtaatcccagcactttgggaggccgaggcgggcggatcacgaggt

SEQ ID NO: 75306 - DNA, 1021 bp, Homo sapiens
acaaaaccttcaagaggacactctctgtcttttcaatgcgtgagtcactttgtatagcacataatacaaaatcagtaattgtcagattattgatcatacaactctgtcctagcctctgcttgcttaaagaacccaaaacacttttcatgagcacatactattgattaacttttatgttacaggtttatatcaaaactgcaagctcctcctggaagaatttctgcttcctatttctattaaacaacactaatttttgtatcaataatagtaaatatacttttaaaaaatgagaataactgtggccattatggtgaactttggacatgtaagaataaacaatacagttaagaggagctctttaaatattgagacaaataccaaacactcattagttagctgcttcaaataataaactgaggcctcaaaataaaatgctgactccaaaatgcagtctctacatttgacactgtaaccttctgaaacctgccctccttgcatttcttttcattcagttttatttttaccactcaatacatcccttcaattccttctgctccttcccctgaccttctaaacaagctactttttcctcggaaattttcacaggaaaggagtgggcacactgcccaaatctacttaaaactgctagatcagaaggctattctacagaagttgaatttaaaccctggtcttgagctgagtgttaaggaattcttttaacccagaaagataaaaaatctgttgcagacttgttagatatttactgtcctgaactatcagttctgttccaactagttcacttaattgttagaccttcaggtgggaaaaaatggttaaaaacagtgggataagaaagaccaggagaatacttaaataatccagctgtttattaaaacataatgataatacattttaacaatttagtggcctttagggggcaagaaaaataaaaaaaattacagaaggctattttggaagactttctcttaaatatcaattggacaaaggttctaaattataa

SEQ ID NO: 75307 - DNA, 1046 bp, Homo sapiens
ttcagatagctcctaacaaagctaatgctaatcaaatcataggttgtaaatatgagataatgttaacacaagtcataattagctaaataaaagctgttgtctcttacaacttttaatagatataacatttttagaataataaaaagtaggctgggtggctcacgcctataatcccaacgctttggaaggctgaggcgcgcagattgcttgaggtcaggagtttgagaccagcctggccaacatggtgaaaccccgtttctacaaaaaatacaaaaacttagctggggatggtggtatgcacctgtagtcccatctactcgagaggctgaggcacaagaattgcttgagcctgggaggcggaggttgcagtgagctgagatcacgccactgcactccagcctagatgacagagcaagactgcccccctacccaaaaaaagaaaaaaaagtatatatactactaaactgatgtatatttttttaaatgctgaaatgttaactggaaaatagttgtgtaggacttcacattttacacagtattatatagttagttgcttgtatctgggcaggtcataacattcttgatgactggggcccaattcctgttgatctgtatttccaacatctaatgcagtggctggcacatggatgacattcaaatgtgtgctgaatttagttgtgaattaaaggtgttcttacctggtcccacagagctgcagccacctggtctattacagctcccagctctcggtattctccagagtaccggatatatgcccaagtgcacagggtgataagggtcagtcccattatcatattgcataggctagctatgatgtccaaaccaatgaatccagtcacaccagcaatcacatatgtgataaagatgactacaaacagtgtggctggggtacgagctgcatggaagatatttttgctatcattgtgcttgatatattggatgtaaagttcatctatttcactctccaactgctgcaggtaacgccggctaaattcttccccacccatcttcttcacccctcggaa

SEQ ID NO: 75308 - DNA, 2236 bp, Homo sapiens
actgtgcccagttatttttaattaaaacttatggtttgtttagttataaataaagttgacattttaaaaaacagactagtttcttgctagaaatacatgtttatgtatgtgttgtgaacatatatatgattgtgttttaaaacagatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaacgcagcggaaatgtcattatgaacagatgttaaataggaaattattacttgttaacttcttacagcagtagtaccttctttaaaaaaaaaaaagaatctgcggtatttttttaaaaaaaaagtttaccgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaactaagcgcgtggtttttgagtccatgttttagacatagtgctgtatttcatttttctgttcaaaaggccatagacaaaggaatcaatataattgaaaggggtaatgaaaaggggtattgaaaaatgaaagtgtggctagtggaattttatcactgggaaaagataatttgctgaacttgtgatcagacttttctaagatgtcagtatatatatcttatgaactcccacactcctctatcttaattgttctttcctgtcacttcttactttatatcgctacttaattatggtgtagccatttctgtgacagtctttagaagtttctctgttttggacctcctagat

SEQ ID NO: 75309 - DNA, 1096 bp, Homo sapiens
actgaggttgttgtcctttgaaagaatcaaacctgtggtgtggtcatcaggtggcaatgattgttgcagtccagataaccagatttgagagtttacttttctgttcgttgacatggtttggctctgtgtcctcacccaaatctcatctcaaatcgtaatccccatgtatcaagggagggacctggtgggaagtgattgaatcatgggggccatttcccccatgttgttctggtagtgagttctcatgagatctgatagtttaaaagtgtgtggcagttcccccttctttctctctcctgccaccacgtaagatgtgccttgcttccccttcatcttctgccatgatttaagtttcctgaggcctcccaattatggaactgtgggtcaattaaacctcttttctttataaattacccagtttcaggtaattctttataacattgtgaaaatagactaatacaatcatcattaaccttatgttattacagaattttaatagttttttaaaagcaatttcataattagttaatttacttctctcagcaacttggtagaagttgaacaagagagaataaacgctgcccttaagctcacatatgtagtattactagttgtctggttgtctatcttaggccaatccttatacaaaattcttgacttacattaggtcatttaatcctgagaacaaccacctgtggtatgaatttattattccacttttacaagtatggaggctgaggcttagggataggaggagttttgcttacatttacatagtttgtaagtgttaaagctgtggttcaaatccaggcgtacctgacttcaaagtcccaattcttcttcacccccagttgtactatcaaagaacattttcctttgaacctatttaggaaagaagagttgaagatagaattcagttccatttgcatattgatcttttaaaattgttaaccacagcataatctaaccttattttaatcccagtttagtaaacagtgaccttttctaatatacacatgcatttttttctccccattgttatatatacaccacattttcttttttttctccctaacttttattttaggttcagggg

SEQ ID NO: 75310 - DNA, 1143 bp, Homo sapiens
ctgaaggtaattttacataatattttaaataattttgtgcataaaacaaagttttgactgaattttgactatgactcatcacataaggtcaggtgtggaattttctgcttgtggcaacatgtcagctctcgaagttttggattttggagcatttcaaatttcagatttttggattagggatgctcaacctgttgttaagtgtttgtatggcctgttgatggaagcatcagccaaaaaaccctctactaatttcaaagtctagttcctccccctttttataattccttaatagtaataccgactagttttatgaaaaccatcataatgggcataatcatgaatttaaatagaagagtacaatcaggatagttaatgttgtgactttgctagctggcacattttttgcattgaataattgttctgtttcttctctatcattttctctttccccgtaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctaggtacagtatcaactttattttcaactttttgtttcgggattgtctaatgttaggttttgaactgatattttcatctaagagaatagcatcctaaagcttgagatttgaaagccttatatttcaaaatttacatttttctctggacatacatttagtaataaatgactttaataagttaaaaaaatacttttctctttaaaaaaacctcaaaaacaagatcattgttcttatgatcagattctgctgtagtaatgccagaatgtttttgttataggtgtccagaaaattaaataattaaagcttctgccttcttacacttaaatttttacaaataataacagacctaccccctaagtcagaatgtacaattgaattataacattttgctgtttattctatttcagacatgattgtatg

SEQ ID NO: 75311 - DNA, 2035 bp, Homo sapiens
gcagaatacattttattctagctgagcttttacgcatagtccattaatgcaagttatataaattcatttgattgggaaaatattaatcttcctcaatttaaaatgcccaagtaccatcctaaaccaaaatttaaaattgtgttttcttaagttgactgacattttgattttggggtggtagacataaatgaacaaatttcgaaaacttttgttacttaatgatgaaagggtaattttatcctttgttttattgtagatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtagcttaacattataaataatatagtagtttatatttattgacatgtcaattaaaaagatgttcttttctagattttcttgggacacgaacaaatactactagcgaaatgtttttccactttgctcatcctgcttaagcctgtgtgcaaatagttgttaatctacactgaatggaagagtccttgtgaccatttattttattaactcatgttatgtaaacttggtatttatctcaaggctgtctagactcttaatgctgtgacccttgaaaacctagagaatttaatgtctccagttgggctgaatttaggtttaggtttggtagaataatgggaagggtaagtcttcagagacacttgacggagtcctcagagacacttgacaaacttgggaaaggaaagaagagtaggaacaactgggcatgctcagtgataccctgagcaaccacattacttcgctagatcctgccctttttctcaacaaaaagtagttcaagaattatttcctgagttgatcaaaaagacttattgtcatatggttaattatgtgttgagcatgtctttttattatttttgtaacagacaaaaaaaattaccatataatttaagaaaagaaggtactttccatatctcctgagttggagatacttctgaaaggagcagaagagatgggagaaatgtacaattctactttattcctgaagtcctggttttaccagataaaatgaagtgagatgaaaattaaactttcttgtctgattttttttttctaccaagttatagactttaaattttggcaggataaaaataaaatgtgagacagatttactttttggctcacataacttcaaataaggcgacttaaaaatggtttggagcattagtattttgactgtagaaaaaatttattcatttaatattaactgtttatgtgtctagcgttttccttgggtctgttggtctctgctttctggtaccttatttgtctagtaccttatttgtggaaacaaaaccaatctatacacaatggtcacagaaaaattgttatactttgtgatactaactgtaagtgcaacagggaatcagaagagagatgagtataggctggaatacttaaagagatgattcatggaagaggtaggacttggagtgggccttgagcttggcctttagattaacaagggccagaagaaggacattttacgtggaaaattgggaatagcacaatgaaaacagagtaggcatggtttaaatataaggaacagtgtagttctgcctggtttgaagaaataagatgtaaggttgagtggagatttgtggttcaacaataggcttaga

SEQ ID NO: 75312 - DNA, 1052 bp, Homo sapiens
acgtgaagaaggagacgtcgcctctgcttcggagtgagtgtcaggcggggcgtgcccacacctggcccaggcggccaggtgctccggggaccctggcgggggcgccggcgggtctccagggcttctccttcgtccttggtcgcgtgaaatactggttttgagattttcttgtgtctgaagtggtattcgttgattgaaagcccataagagtaagaaacttgggttagtcccccccgcgcctaacccccccaagagcaccccctaaaaataacagacttcctcgccccaccaggcagagttgttggttttgattactggaagagagagtaggaaacatttaaattgcttatcacctaatgctataggagtaaaagtaattagacagggacactttttactcttttagatgcgtcgagatgtgcgtcatgtttgcaaacattgcgggtgtctctcgactgtgctgcaagttgtgcgaactctggggcagaattccttagtcctgctgccggatgcagacttgagaaggtgaaaagcataccgtcgttcttgtagccgccacccaaagcctcatcactcttacacagcagagcagagagccaaaagcctttgtatttggctatattcgtgagattccaagaaggcaactcaaaataatttctatcgtattagagaacccccccctcgaaaagtttttttttttaatagggtagatcccactcccaatccccacctccggtcccccgctgcttttcttcttaatgtaagtatttgatttttgagttgaatctcttgaatttttaattcttgtgtgttcaggacatttgtgaggcatggagctggtattttggtgctcttactgcgccctgggccctttgcttaagtttccttcttggaagctggtagtaaccttgtgacttaagtattacctcatattgtaattgggaaagttaggtttctagtatttgcccaagatcacacagatgggagagcatgtttttccatcataaccacattgtcagccttccagatttatggtggtacttgcaatactt

SEQ ID NO: 75313 - DNA, 1080 bp, Homo sapiens
tatgtggtggttgctgaacacactgacttggaaagagtcttttttccttttgagacggagtttcgctcttgttgcccaggctggagtgcaatggcgcaatctcagctcactgcaacttctgccccctgggttcaagcgattctcctgtctcagcctcccaaatagctgggattacaggcacatgccaccacacccggctaatttttgtatttttagtagagatggggtttcatcatattgttcaggctggtctcgaactcctgacctcaggtgatccgcctgtctcggcgtcccaaagtgctgggattacaggcgtgagccaccgtgcccacctggaaagagtctttaagtaagtaagtagaaaaagcaagctgtccaaacataaaatttccaaattttgctaaagagaagaaaagaatctgtatgtgtgtatgggttctgtatatgcgtagaaaatgatctggagggacacatatccagctgtggacaatgggctcccctgtagagtggggtcagactgagtgtctcacttcttcatacacttgtgaatggaatgaatttgtaataatgagtgtgtattatttctgttttgaaatatatatatattttaaactttatataaagagggaaaagacaattatgtctctaaatctgtttttttttttttttagcacaagtagggtaacaagtttgaaaaacttattttaattttaattagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcaggtatggcctgtagccacctgacagctttttttgaggaaatcccaagaaatagaagaaatgtttgtattaaacttccttaaacataaagccttagtaattaaaacagtatggtcctggcacatgaatagataagtaggtaagtggaa

SEQ ID NO: 75314 - DNA, 1048 bp, Homo sapiens
aaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggtaatcatcttattagttctgtggtctgcgtccctgccgggaacaccacgtggaaaactacagctttggaagtgggcatgtttgcacagggttcagtccaaaaatcctccaagtttgcccagctgggtcttcacccagacttggcagggccctgctaaaatctggatttcagcagggctacccaggctcctgctttgctcacagtattgattagcatctcttgttcttctctcccactgcgggttcactaggtcttcagggctgtttggcacctggctgaccccttgattcctcccgctgctactccaaacctggccctcaccctcagatccccatcttctcgcctgcccgcccccctcattctcagcagatggtcttgcctcctgctacatggatgcctgtttctcccggcctccaaatgtgccttttctttttttttttttttgagatggggtctcactctgtcacccagactggagcgcagcggtgcagttataacttaccacagcctcaaactcctggccccaagtgatcctccagcctcggcctgccaagtagctgggactataggctcatgttattatgctcagctaattaaaaaatgtgttttgtaatcccagcactttcagaggccgaggcaggcatatcacttgaggtcaggaattcgagaccagcctggccaacatcgtgaaaccctgtctctactaaaaatacaaaaaattagcagggtgtggtggtgtgtgcctataatcccagctacgcaggaggctgaggcaggagaattgcttgaacctgggaggcagaggaagttgcagtgagcagagattgtgccactggactccagcctaggcgacagagcaagactctggatctaaaagaaaaaaaaaatggtagaaacggggtctcattatga

SEQ ID NO: 75315 - DNA, 1107 bp, Homo sapiens
ctaaaacattaaagcaaaaagccaacacactcagtattgttacaagtaaggttctaaaccccaagttatggatttcagattccaaatcttaattgtaatcagatcattgtaatctgtcccagaccaaattctgctgtgctagcctaccaatttcaaaaattcaacataaagaaaatatcactgagggtcaccacagtataaaagtgtaacagatgtccaaccactttctactgttatgacactgggaagcttgtatctttatattatttaggtattttttaaaatttgtaagaataatgtgtaacaacattaaagactgcctattgtaggagtgtgagtaaaagagaatatagttaattgctaaattgcataagattatgaagatgttggaaattgacttttatttagtttgtgggaaggaggagggcatatcattactggaaagggaaaccagtaaagtgagaataaaggggcataattatatttctggagtcctgggaccaaccatggtactgattactactggccggaagtatactttgggccttgtatacttgaatggagtatttaaaatatgtgatgactcttttctagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcaggtaaaaaataagcagaagtgctttctttgtgaataaaagttagaacccatttaagtaatgtctaataaattaatctgttgtctgaagcaaaatactaaggaaagagagggaagcaaaagaagaattagaaagacttaaccattaggaaggaaaggttgggtttgagaaatgaccgtaaattacagtggaaagaccactaattatgccttgtcatgtcagctctgggtcagaagaaacctggtgttaattagggacatatctcgtctatgtcatagaactctctaccaaaacagttggttttgataagctccgtaggcttgactcagttgggaacagagatcagagaggctgcatgacttttttcct

SEQ ID NO: 75316 - DNA, 1010 bp, Homo sapiens
aaggactgttgactttaccacttgctccccatccccaccatgcctcagacatccactagattggagagacgtctttatgtagaaatgtaggctgagtgagctgatgaaattgttatcacaagcaaaaatcacacgtcctaattcacttttcattgatgccatgtttattagtgactttccattgtaatctgcatgaattgtagtgaacttaaacattttgagttatggccttttggtgtcttccatttgtcagcaacaacccatctcagcattgtcagcttggtatggccaaattaaatgaactctctgaattgatactatcttaaatatctaacatggacctgtgaaactgtggtaggtggttggccctcatttaagaggtgagaactaccactagtgagtgtggagaataaagtagatgagcgtaggttgcctgaaagaagaacttcaactcgtattaacttgaatgaactactgaaaaacaacatttcatctaaaaattttacgtgccataccatctgtcatgaggaatccaagttctagagacaggtattaattaggctgactttcctgtcgagtttattttcggattctaagcaatcaactagtcttgtacaggtcagctacccagaaaacgtgctggttatttgttatcaaaggcagcttcattcataaagctggatcactgctatgacagcagccccgtttggaaagggcgattcaccttttctaacagggttttctttgatggttgtagtaaccccccataacagtgattagttttaggcagtttgctggagaggctaaagccatttgctggaagccacagccactgtggacctacttgttgcaactggtcaaaagacgacctgtactatccccgggcagtggagcaagggctggatttcggtcctgacctgtgctcttagcggggcacttttatgcagtacacaaattacaactgtatgctgtgactttggagaagaggcaggagtaatgaagcctgataa

SEQ ID NO: 75317 - DNA, 1051 bp, Homo sapiens
agaatgtctgtttgagatggtctcagtccacaaggcagatctcagtcgagtgtctctgatcttgccactttaggaggcattggcatccaacattcaccagcctgagcagcacctgggcttcccaccaaaccgcctcatctgtcataatatgggggagatgctgcagagcaatatttaccaaaaggagggagcttccctttatcccacccccaagtcacaggaaataaatttagtgagaatttagtgggcaaataaatagtgagagttgtacctatttctgttgcataaacaacatttataacagtaaaataataaaagaaaattgtttcccatagtccttcaaccaatatgcatctgtttttattatctctatttccttccagcctttgtctaattgtataaatatttttgctggtggtaatcataggatagatagcatttttgtaatggtctttcatttaacatttcataagatgtttttccacgttcctacatggttttttaattatacttttaatgactgcattataatgtatcattatactttatgctcgattgttgaatatttaaattgttttcaatactttcttgttgcaaaaagtgctatcatgtacatatttacacatatggcttttcttcctccttgattttattgtctttgaataccaagtgaaattattggatcaaaaagtatgaacatttttattgcttttgatacataaagccatttacattactaaaagtaataatcatttacagtgctacccataacatataaacgggcctattttaaatcataaccttgatggtagtagaagttatatcttaaatactttgctaatttaataggaacaaaatgacttcttggttttaatccttctttgattgctgttgagatgaaccttcccccatgtttttttgtttttggttttttttttttaattatgttgcttcttatgtgaattgtctgtgtttcttccttctctgctgggaagacttggcatttttcttacaaatgtatatccataacagatacctccccaggtctacc

SEQ ID NO: 75318 - DNA, 1007 bp, Homo sapiens
tttatatttaatgtaagtccactgtgaagcttcaggcttcattacttacaagcgacttggagctcatctggtgcctattcatagtgcccactgtgatatggtggcacgggtgggagagcctatgttggcactagggggtagcaaatgatctgccaccttggcctcctctcctgggtagaatgtatgaaaagaaatcttgttatgaattgcttttgatcatattttacttttgctttagttcgtacatgttaaagccccaacataaattgtaaacattttacatgtttacatgtttacatctatgatgtcttcaggatagacttttttttttaacagaattccagtcttttcctttattgtcttaagtcttatcagatggaaatcccttcccccaccccatgcttctatcagacactttgattctttcctgctgaaacagaaaatatataacctagctactaagcatgtctcttctaccaaatttagattacaaggcaataaagctactctgtagggaaaggctactgtaacctagctaaattttcagcaccaaaatacacatttcagaatttcacttggaaatcccgaagcagaatgtgctaattcataagtgacaggtaggtcccaccatgaggctaccatgagtgtttgacttccaatttcatgtgtttatttggcagttggatcccttgggagtctgacctctcatcttgggtgatattgaaaagaaagtggtgatttttctttttttatgggatcattttcgctcaagtcaattcagttggccatttctattctgaattaatccagactaacaaagggcaccttcttgattccaacctaaggtgtgattaatgagaagattttggttgtcactgtttttgctttactttgttaagaaacaagtgagagtaagaagagtacattttttcccttgaatattaatagctactgaactgaccttgaattttatgctcatgtttcttctgagggcaggtggcagggaa

SEQ ID NO: 75319 - DNA, 1070 bp, Homo sapiens
gagctttaaaaagtgtactctgtattgcttgaaacctggagtaggggaggctgtgtttctcccctccacactgctgctgggaaaggaactgggagaggaatgaggcgggtgtttgttatttcccctggctgcagctggcttatctactctgagtggtcattctccctgacaccatattttaactttctttttattatgagtgcaagacctctggtcaagcatcatacatgtgcatggtggtttatcctgatttggaaggggaacattatcgaagctctggagtttctcttcttgggacagatgagatgtgaaataacaaatgtggcgtgtgagcaacccagctgtcatttctaaggcccgaaggcatagtattttcttcatctttttaactctcgaatcagatgttttccccacgtgctctgtagagactgtcactcacttccacattactccagtggagggttgaagcaaggtttctctactgtcccctgctcataaccaagcatttggcttatggaataaaacctagatcattaaactaggtcaggttggactgcctcaaagccaccttcctctgattggtgtgtctcataataagctttccagggatggggtctgagacacctccaggcaagctgggcttgtctgctttcctttgaagcccactttaatttttgtagtgatgccaaataggagaaatggaaaatgggaaagaaggaaaaatgactcagaagcttaacaatccagggagaatcataaatacactttcaaggaactcaaacactgaaacactgaaagcatggcagtcatttatactttgttttgatagcatttctttttgttttgtttcgtttctgtttttgagatggagtcttgccctgttgcccaggctggagtgcagtggcgcagtctcggctcactgcagcctctgcctcctaggttcaaccgattctcctgcctcagcctcccaagtttctgggactacagtcacgagccgccacgcctggctaatttttgtatttaatagagtccaggtttcgccatattggccaggcatttcatgtcccttc

SEQ ID NO: 75320 - DNA, 1922 bp, Homo sapiens
aaccaatattccgactcctataaaatccattagctttactacatgtttcaaagaaaacaaatgagaactctgaaggacatttaattggaaaactgctttagcacattataaacttaccaatttgcttgtaaacgctaaccatttggcgccaaaatcctgggagggtcttttaaaccgttcttcctcaaagcaccgccccactttttacaccacgcctccttttgctctgttccttcccccacaatattgggacaccctaggcggtagaagcagccgcttttctgtcatgcgcattgcggagagtcgttcttccctctttcccgacttcaccactcactgggatcagacccctgtcatgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattgtgagtgcggggcggccagggtcctacgtccgtgcctggacacacgacttcaccccgcacgttcctcgtgcgggtcgcaggctccccaggactgcgcctccgagttgcggagcgagcgtccccgacttctgcagctccccaaactcttgggatctgccgccagcttggtcccaccccctcgtctcttacccgtgaatgttaagtttcttctggggtgcaccctcgtttcgtttcttgggttgtggtgcgcccaaagggttagtgccaatgcgaattctgacatttttcatgactttgaggatgcgactggggcgcggggagggaggtgtccgactcgtgtctaagtagttaaagtgattcttcacagacttctacacttattttcaccacattttacataagagaatattgagcaaaatttctcctctcgttttgtctgtccttaaaagatagtctctttatggtgttggaatttggcgcttttaagctttttttaatggattgggtacgtttcttttttattgtaaatactgagtcaattcaagttgggttatttttaagttttcgttttctctttttgcctcctcttttgctttctctttttttcactcctcatctcatttttcctttgggtgtctttgtagtgtagagaataccttgggttgtgactcctaggtctttgtaaatggtattacattaaaagataatgtattaatgtatacactctcaagagcgccaggtcatcatttattgctcgaacgaaatcatgtattttgtgtggtgatttcaatttaataatatctgttctgccgcggtgggaaataaagtatctgtctttgctttagatgctaagtcgttgttgatggtggtattatacatattagcagtatttactgataatagtaaaagcataattattaacagtgtactggacaccactaagcacctttacacgaataccatatttaattccctacaaattctctatgacaggtgtttttcacgttttacaaatgagtaacaagatacctaaatactttagttaacctatgcagatattgctgtgctggctttctttgggtcttcagagtaggcatacaataattgttgttagaacaccttcttctttaaaaaggttcagctggaagtggcgtacgctacccaggagattgaggtatgaggatgacttgagcccaggggttcaagagatcctgggcaactagcaaaataaataagtaaataaataaaaatgaaaagacaacagggttcaggtgagtgttttcttgtgtc

SEQ ID NO: 75321 - DNA, 1013 bp, Homo sapiens
atggaatatgtgctttcttattcaccacagcccaggacacttctgtttttccaacaccttgcatttgtgactctgcattataaattattaaaattggtaagctctaactttggtcttgagctttctggtggccacaccgttaatagagaaatgcaaaagttttctaaagagctgttttgcatgtgaaaaaatcctgtgtcttattctcagaattttatttgattagcatcatcagttcatcattcttgatttccggattgttagatctacccttaaaagtttttcatctgcataaaattaaccaccttatcatcttcagtgttttcatatgaaatattcttcataaattatacatttaaattttttatcccaagataaatggtcatactaaagtgcttaactttttttaaaaaaaaatctgtatttcttagttatgccccgtggtgccctgcttgtcaaaatcttcaaccggaatgggaaagttttgctgaatggggagaagatcttgaggttaatattgcgaaagtagatgtcacagagcagccaggtactgtaagtctttggttagttttgtttctttgctgtttgggttgatatatttatccttttttctacattgcatagtcttaattctacctttctttaggttttgaaaacctaacagtctgcagctagttaacctgacttgtccacctccctgctgggggctcagtgtgcaatggttgcaaaatggagattccctggttgtgtatacacctcatttcttgaatgtgttgctttaagggttcttgaagacattaccctctttttattcttgcccacataactgcctctgatttgttgttctttgcatcccaggccccagactagtatgtaagatgcctttgagaagtcctaggacactgtggttcaggtgaacattggccaagccacatttgcatccataccaggcttcagaataaggagcatgtggttgagtgtttttctggagtcaaggtcacgttccctgacaa

SEQ ID NO: 75322 - DNA, 1019 bp, Homo sapiens
agcagggtgtctgaggtgatgctattatagccaaaagtactagaaaaatgccttaaaattttaagttatagcttaacagctaataattactatgtgccaagcactattctaataatttttatataattcttttaatatgtgtattacacataaggcttaaaagtactttcctgagatttatctacttactgtatttcatagtttcattacttggaagaataacagtaattacattttaaggcttatgatttaaaaaaatgtaacctcattgttaaattgggggctaaaatgtcatgagtaggtaaatagtataatttgctattaatacttgtacattgctaatgcttttgaatgttagaattgactgtaaagtgaagtgaaaaaatagcaaaataaatattaaattatttctcagtgctggataatatttaattctgattctctttagttgtaaagatggtgaatttaggcgctatcagggtccaaggactaagaaggacttcataaactttataagtgataaagagtggaagagtattgagcccgtttcatcatggtttggtccaggttctgttctgtaagtatgagggctttttctcttacccatttcataattaattggaacagataattatattttatgtaaagcattcatactcagtttgtttcttgagctgttaaggtatatccacatttattacatgtttgattttttttttttttttttttttgagatggagtcttgctctgtcgcccaggctggagtgcagtggcgcaatctcggctcactgcaagctctgcctcctgggttcacgccattctcctgcctcagcctcccgagtagctgggactacaggtgcccaccgccacacgtggctaatttttttgtatttttagtagagacggggtttcactgtgttagccaggatggtcttgatctcctgacctcgtgatttgcccacctcggcctcccagagtgctgggattacaggtgtgagccactatgcacggcctacatg

SEQ ID NO: 75323 - DNA, 3243 bp, Homo sapiens
tgttccttgaggagggcgagaacttacccttggtagggaaccactgctgtaaactagtattcaccaggaccgcctggggtgtggcatagaaaaggggctgttagcccaaaataaagatggatgccaggcagactaaacaacagatggttcattactggtaatttttccccatggtttattctgccttattaacccaatccttccttgcgggtgtcccctccctggccccaccattcttgattgcctaggattgggggcagtctgagatcattgaacagagtaaagctctttgacccagttctgtctcctgtatctcaccatggtgtgctctaagcttaagttaactagcagctggccatataaaacatcgaaagggtgtgtatttattcattgagatgtacacttaagatttgtacattttattcttgtaactatgttgtaataaaatcatacatatgggggatgagtaaggggaagcacatttataagaccagaagaagatatggacagaaatacaaccttcaactgtaaatgtgtgatttctgttcccctgggaactgaaacaaggatactgtttaagttttagtatacttgttgaccagaagtttaatagcaaattaatatgagatagtttttttaaaaggcagtcaaatttagcagtgggggttgtgtatcaccattagtgacagtaatagtaagttctgataacctactaccattggaccaaccagttttttttaatgctgtatattttctcacaacttccatattcacaacattaatgctgattcattaatttcagttcagtttataaataggtgggtaattagaatgactttgataactaaaatggctcaaacaatttttatttttataatattcatggttttttttatcttatcttgaataactttccttttggacatccaaacatgataaatttatgccaaagcagttttggggcatatgagacattgtatcttgattttactctaaagcaaatctaatacatcaacaaaaatacatttttggtctttgtctttaagaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaagctgaagaccagtatgatttctggttgctttttgaaggtatgctttattactttgtatttaacgatgttcagatgagtagttgtgtgttcctatatatgtacttgatatgtgtaatcaaaagactgccttctttttctattgagatgtttaaggacagtaatgctcattaatcaagcattttttttttttagtgttctagtatatgtgacatggccaatttttttattagaaaatatgtgaccagaaagattctatagagtaaaaaatcaaagcaaaacaaaaaccacaaaaagacccctgtactatagaaaatgtaaagttggctgaacagatagggtcttgaaatttcaggaaacatataatctcacggttcttaaagattgtcactgtagacatctgagtaattaattttcagttagtaacaggcttatagaaactttgggattatttacaaatggtttaggaaagaataaggtatagtaaaagtaatat

SEQ ID NO: 75324 - DNA, 1039 bp, Homo sapiens
gttgaagctgtgctgatggtacatgaaagaattttttatatgtttgaaactttccccaataagagttcaagaaacctacgtcacagcaatatctaaaacattttagaacaattctaagggctgaacaagagtatggtgcgaattcatttccaaagtacccattcttactgacttcactgcctgattttggtctattctagttcggtccacgcttacattgctgccagaattacatttcaaaaaaattaaatgagttcatggaactcccttgcccaaaataattcttttgagttcccatcaccaaaagaatacagttcgcaattctttcttttgtgatctcacagcactttagtctcattctcctatagaaatctcctgtgtagtataatcttttcagcatctatgttcttgtgtcctgcaagatggtgaaaaccatgagtacagagatcaggtctttttatcttcctatctttggtgcttggcatattatcaagcatgtggtagatgctcaataaatttttgatgagcaaagtaaatgtgaaatgcaaacagattatataaaagtaaatgcttagaccaatgaaactataacaggtaagtcatgatagctaaacaatttctacttagcagttttgttttttatttttctttaacccttctaaataaggcatgaaatttatttataatcaaaattaaagggaaatacttatgctaataaaaagtatcttttaattgaaaaagacacaggtaaatgaatgggcataatttttgatactcttacatatatacacctaaagcaaatctagctatcagaaatatactatcctcaacagataggatcttggtaatactgtcagtgcaagattagttgttttactgctataatcatggtcataaaaatcataatcaacttgggtgcctttctgcaagcaataaaaaacagataaattagactttgtcaaaagtaaaaacttttgttcatcaaaggatactatcaacagagtgaaaagacaattcatagaatgggagaaaatatttg

SEQ ID NO: 75325 - DNA, 1047 bp, Homo sapiens
agctggcagattttcaggccgtgtagttgtgtagctagtgtccaaagaaatattagctcgttttcccccttaacaccttttcatttttatttttttacgcaaaatctgttttgccagtatttccctcaggagctgtgcattgctcacagcagggaaggaaaacttcagcaagcgttctcaggttgcttctgacttccagcctgtgctctccagcatttctgaatgtggagaaaaagtatctcttgctggattttccgagtatgattcccttctgttcttctctgggaccgggcaatgtttgtttatgggttttataagcatctatttaaatttagtttttgcacgaaatactccctcttgccacagggtgtagtttggggtttagaaaatgctgttggagaaagctgctagtggcttcattttccaagaatgtaagtcatttcctttctgtgatttcagggagttgatatttcacagcatcaaaactttgtggggaaaattttccgtaatacatctgtcattaaaaaggcttgtgacttttgggtttccttcttagagcagtgcatgaatttaggttcagcagtgttaaaggatgagaaatttttttttagaatttagagcattatgagactattgtagaaattttaactaccaggacctacaggatggagagtgggggaggggagaagaccagaagagaggcaggaaaacagatgcctttgctgatgtcctttgtagtataaaacttaacagcaccacagcacctaatcattttctcaggtgtggctttgagaaataaacgttttatgttaaaaatgaaaatacttcacaatatgagacagctggcatttgaatacttttcccagtatgtttgtaaacattttggattcatatttcatattaaaatggacatttagtaggattattagatgaaaagggtcccccaggggatatctaatatcaaattatctgcaggacatcttctccagaaagcagactgactgtaatatgaactaattttcccccctttgagttgcttgcaagaat

SEQ ID NO: 75326 - DNA, 1054 bp, Homo sapiens
ttgcacacattaaaattatgtatttttagaaagtctttgtatgattatatcattacacattttgggagtgtgtttatgtcgtgattgtgtataaaacaatggagagttaggagaggggaatgggaaagatttagtgaaggagttttatgagtagtgaaatttcagttataatgtatgttccccaaaacccaaacaggaaaaatgttatcgttggtctctgtggttaaacttttatacagagggtagttgagagggctttctgaattgcacattatcctgaggaagaggctttgggggcctttaaaagtaagtagaaacaagttaaagggataatttgagaggaacgaggaagtggaatactggacattgaattgcaaggaaaaagttagaaggataagtatttaaaacaaggctgaagtagagagaacttactgtttagaagtgtagattaaagaataaggtatttttagctgagaaaaaaggatcagaatgattagaatcaaggtgccctataagatctgtatacaaacttgaaataggactgctaattgatagttatcctggaaattttgcctgtctttgtgttgaatcactagtttggtgttaaataatgtgcagggactggatgcttataactgtatcccgtacactccaaaagccacttcccatttcaaagactggaaacattttttgtttaagtgctaatgattctacaaatatttaattagtcccccaacatttgaggaaactactaatgtctacttcccatgctgtgggaccagagggggctctacagcagtaatggctgaagttattatgaagttttaggtagaaacaagcaatctgtgcttctcattactttatgcgatttagtgatgtaattacttctgatgcaagtttgtgtatgatcactttttgtatatatcaaatggaacagagcagtcatgcagtatatataccatattgatcaaagatgaattacagaacactgagaaggggaaagaaatcattgatctctcagctgattgtattgcttcaagtcaagaagagaaaa

SEQ ID NO: 75327 - DNA, 1021 bp, Homo sapiens
cattttcttttcttttttttttttctgaggcggagtctcgccctgtcgcccaggctggagtgcaatggcctgatctcagctcactgcagcctccacctcccgggtccaaatgattctcctgcctcagcctcccgagtagctgggattataggtgcctgccaccacgcccatctaatttttgtatttttagtacagatgaggtttcaccatgttggccaggctgatctcaaactcctgaccttgtgatctgcccgcctcggcctcccaaagtgctgagatcacaggcttgagccaccgcgcccggctagcatggcattttcttgaatgtctttccccagctgtatggtcttgtcttagcagagttaaattgatatatcaagaaactaggtagagatttggtcattatccaggtcattgcattaatgtgctgataattgggataattctgaccaaaaatatctatttagactctcagtattccaaatggatcctcttgggggtgttttcagatgttttccaacaacattatctttgtacatgttttatacaactttgagcaataatgttttactgatacatgaagacagagggaaaaacaatattttgaattaatttatagccacagtttcatgtgagggaggaaatcatttaaaaaaattaagcaatttcttgatgcatattttaggaaatataatgaagtttctcacttagcttttcagatgatttttctctctgattgggttaaataaaatgtaattaattttctccccacaggtagtagcacttgtgtgtacagtttcagtagatgacttttttttttggtccctgtagctttatttctttgaacttgttactgaattatacacaaccagacaaatgcacagatcaggagtgtacagcacaaaatgatcacatttgggcaactagcatccaaatcaagaagcagaacattaccagcctctctttacagtcatcatctttgcccccaggataaccattatgctgacttttattgtcatgg

SEQ ID NO: 75328 - DNA, 1038 bp, Homo sapiens
tcagtttttggacttctcctgcctttatgcttctccctcttttctccctttttgtgtcttccttccacccccatccagttatcgtttcttaaagatccctggaaacatccaatctttgtctactgagagcagcagtgaaattctgacgctaaaatctgtggcagtctccaggaagtacttattgtaaaacataagattatgatttcactgagagatctaacagataaaacaaagtgcttgcaaaggaaaactattcatgtatacattttattttatgtttccctaaagaataaaggacagttttattacttaagaaaagactcagagcttcagcttaagctcattaaaaaggtgaagagaagttaaaattagagaattttataaatatgtggtatttatatatcctacccgaataagatactgcttatcacagcaaaaatttagcatatgtaatgttaacaagtaaaaaatatgctgaccatagggccacagctctgacaagttgctcatgaaattactacagaatagcgtaatccgtattgaagacagcatagaagagggatagtaaaatataatgataggaatgaggtcttcgagatcagttccctggggcccaaatccagactccagtattctcccatgtgtaaccttggggaagttacttaactctctacacctctttttcctcatcagtaaagtgggagatagttataatagctatcccacaggattgttcttatttttaagtgaaatggtacgtgtaaaacaaatggcatggtctttgatatataataaacgtcttacgtgatgttagctattgctgcttaagacaaaaagaagtgatgtataaaaggacttatagttttattggaggttcccaagccttcatttataagcatttcatgagatttaactttgttttttgatggcattaagcaggcaacaaaacctagtatttctcagttacagatactggcaagtctgtgttgctgcagtaggagcagctggcctgttgcactgattactaattgatcgagt

SEQ ID NO: 75329 - DNA, 1078 bp, Homo sapiens
gagatacaaatttggaagttgccaacagaatttgggtgagatcacttggggaatatgtgtagtcagagaaacaggcttatggaccaagccttggggcatatcagtatttacagtttgtagagagaagaagaaatcacacacataatccaagaagtgttttaagccaaagtaattatgcacgtttttccaacatagtgaacccaattaagtgtctccattccttgagtaacaatgttatcactagaagatattgtgaactctattgatctacacaatggaagaatgaactatgagttgtttttctaattgcgttgatggtcttgggctaaacctggatgcttcatcttttagaggttgtgttgataaggaggaatcagtaaaagaaaattaaaaaggagcaagcagaggataggaagaaaattagaaaaatgtccttgtagtcaaagaaaatatctccagcagaagagtggatcagttagctcacatgttgctgagaagtcaagcagggtgaagactgagagttgctcattggatttagcaacctggggagtcattggtgatgatgacaagagctgtgtcactggagaagtggagatgaaaaccttattggagtgggttcaaagagaataaaaaatttatgaaagataactattacttgtaattcagttttgtatattacaaatattcaatattgatgtgggtacattttaatatgcctggtaggatgtgcagtgggactttggaaatgggaatgttggaggccgtgcatatcttcagcaggctttgtcagggttagggagcctttgagcttttccctagttattattggtaggggtagggctctagtatatagattgtagtttgtatattttgaaatagagaaacggttctatgcagttttttagttctttgttaaatgtctttggatgagaactatatcttgaaaatactcatactttgtttaaagactttttcatttctagtaaagatgtgttctttaattcaatctattgatccttgtcttagattgttttttgatactataatggagtaccacacataaggtattctgtccata

SEQ ID NO: 75330 - DNA, 2264 bp, Homo sapiens
aacctgtactcatacccttgaatttaaaataaaagttaaattttaaaaaaaggaagttcatttagcttatggtttgggggccctgaagtccaagagcacggcaccagcatctggcccaggtcatcccatggtggaatgcggaagcaagggcaagacagaaagcacaaggggctggactagtttttataacaacctgctcttgtgataactacgttaatccactcataaggacttgacccttatgactcagtcacctcttgttaggccccatctcccaatgctattgcatcggggattaagtttccaacacatgaacttttgggggacacattcaaaccatagcagtcctttttcatgaaaggtgagacatgtgctttgaggtggcttctttttcagcaatggtgataggtttgatctgactaggccacacagcatagtgccccactggcctggaagccatcattcacagagtagatggctcaggttagtgaatcccaagagccagagcaaattgagtaatagaaaaattgcctcgttaaaattttaaataccttgttgatgactttcatcatgaagtgttatttcaaagcatgtgattaagcaattttcatagttctgtattttataattatacaccaagaattttctcttctgggaactacctttgaattttgctaactgtctgtaatactgtcatcaaaatgaatcaacaggtgtctgatactaattatcttctctttctctaagcttattaaaatgctaacacataggcctttaatgcatacgtattgtttttggatagttagaagctcagagtggttggtagaatgaaaactttgttacatatattttagtgtttggtaataccaaagtatagtattagtctttagaaagttgctaatttagaaaatgccggaaagggcgaagactttcctttgcagtggattagggcacaaggtttttgagaagtggagctctggtgattatatgtgtgtttccagtgggttgtggtatatgcatataatgtcagcattctcttaggtactgctttgccagcactgttttattcgcatcattttgaatgtttttttcagctgaaacttgtaagttactctacagttagttaagttacagtacagttagttagaatgtaattggcttggaacaaatacacgaggccaatgtggaataatttcgcagtgctggggattttacattgtagatactggagtatgcagaggtataaaactgagcaagttttgaaataaatcttatgtcacttgtcagtgactacagaataaagtccagatctcttagggtggaattcatcatgccagcccagagttgcaagcctgtggcccaccaacaagtttggctgcagacatgttttggcttttaacatagttatttgccaacatttaaaaatagagaaattttacattaaaaaaattgcattttataccttctcttgaaaaatttgaaggcctggcaaggtctgttgtagcaacataacagcttccccctttatacggggtgtgtgctctgtagtctcccacagtccctggcagagactctcttgtcctcaacattgggaccaagctgttgtaggcatttttcatcctgcaggcttcacttctttgctcctgcccttgtaggcatgtgagtttgctaaccttgtgtttagatacttatttttttttctcagagttccttaaatctagccaaattgttcttcccattgtcctgtctaatgcgtacacacttcgtctacctcatgtttctgcttctggcttctccttccgctgcgtccgagctgcatgttgctcatgtcacatcattggaacttagcacatttctagctccccagctgtactagtttcttgaagacaaagactatttaatttactaacacctatcaaatttattttagatcttctgggttaactatttgctaatggtttggctgcgtccccacccaaatctcatcttgaatttaactccaagaattcccatgtgttgtggaaggaacttagtgggaggtaattgaatcatggcggtgtgtctttcccgtgctgttctcgtgataatgattaagtctcacaagatctagtggttttaaaaatgggagtttccctgcacaagccctcttctcgtctgccgccatatgagttgtgcctttcaccttctgccatgattgtgaggcctccccagccacgtggaactgtaagtccaataaacctcttccttttgtaaattgctgagtc

SEQ ID NO: 75331 - DNA, 1267 bp, Homo sapiens
gaaaaattaatactttattggtcggaagaatgaagtaatatggtatcctgaaaaaaactcggcagtgaatttactgacatgtgtgacccaaaatatagagtggaattttgtgtggttgcgtatgttttatcgcaacaatcagaaatgttttatgtattttcttccaaagaaaatagaattctatacttaacccatctaaatatagtggtaaagttaattttttgcatagtttagtgacatactgaaacaaaggtcagctgcagtggtgccatttctgaaatctcttttgaggaactcacgttacttacaattatagaaggagattcagaaacattgacatgtttaagggttttacttcaaagaaacccaagattttcaagtgtaatattaaggatatttaaggaaattaaaatcaggaacagtttttaataaatgttatctcatctagaatttaaaataaattctaattaaatcttaaaagtaaaatcttttaaaactcaaatactgattttctgaaccctcattcattttaaatctgtgaaaggatgttgagagctaatggtttgtaattgactaaattatttgcttctacaggtgcctagagaaatgtaaagagaaattttcatgaaatataagttgtagagtaaaacctagcagggaaagctaattgaagttatctaatttataaaacaacatttgctttaattactgccttacatattcttgaactaggctcatgttgctgatgagtaaattttcaggaaatttttaatcagtatattatagatacagggtctaaattaattcacattatcagtcatttgttcagagcagctgttaccctgaaaaatactctattaatttatagaactggttaggaaagggatatgaaagtaaaggtgttttgaaatgattacatattatacatttaagggtaagatactaaggacggttgcttgatttactctttagaacttatttatttattgagacagaatctactcctttacccaggctggagtgcagttgcataatttcggctcactgcaacctccgcctcctgggttcaagtgattctcctgcctcagcttctgagtagctgggattacaggcatgcactaccatgctcggctaatttttgtatttttagtagagacagagttttgtcatgatggccgggctggtcttgaacccctggcctcaagtgatctgcccaccttagcctcccaaagtgctgggattacaggcatgagccaccgtgcccagc

SEQ ID NO: 75332 - DNA, 1743 bp, Homo sapiens
ccagctctatgtgagctgtaggaattgtttgacctattgcttgtcgaagattctttcctctgccttgtggagtttttttttttccacgttagcacagatcagtagttagccaatgtaccaggagaacctctctgaagatctttgtacctctatctgggttcccctacttcctctttgggattctgtgctgccccccaaattctagctgcctctgcctcccaaacttttctctttatcttctcaattcagggaatcttctcagttctttttggattcctttcctcactgtggaccaaaactgcctccagtcattaagtttggggaatcattaggctcacctagtttgttttccttcagtgtctaaaaaccatttgatgtgttttatccacttttctagttgtttatggcagaggacaattcctgcagcaattaatatttgatggccaagaactgaaagttcctggatgtaacaggttatttttcagaactccccaaaactggaagaaacgcattgaaaaatgtggaggggaaaaaaagtacagaggcatcttttgcataattatgtgtggaatatgatgctttttatactcattctgagaaatggtccttgaaagtaatcacttgccagtggaagtttgtagattgtccagagtttgtggtgcatgtgacaagttaagagtctgaaaggaagtatttcttttttattatcagaatctttgcttttaattgctttattcactaaagtggataacttagacctcagctacagttttcagttattatacatggaagcttaggaaacatcacgacttttactcttggagaaaataatttccaaatcctagacagatgactttcaattggaagatgcttttgaaagaaagactcattagagggagtttcaggattttgtctcctggttattgaaacttgtactgaaggtaaaaatccaatggatttacaactttgcaaatcttatatctgaaaaaaagaatccaacttttcctagaaagcccactatgaggagcaacaccatgttttcttcattcattcttccaaacgtgaaagtcatgaaggaatataggcactcctctcgatgagtgctttttaaatatttgaatgattttgcctgtgaatcagagataaggtgattccaaggcaattaattgtaggcaatatatagtctttttctagggtaggattgagcgagtaagtgagccatttgtgttgagcagtggtcctgccatgcctgctgacttggaatagtctgctccttgggtttctccaggataaatgtttatgtgtcagtctcagtacttctgcctttccagtatgattagagccatatgaaaaagcagtgctgagcagaggtagggtggtttctggtttttgtttgtttgattgatttggggttttcttttttaacttcaaccttcaaggttgaggtatggttccatttttcatggaagattaaccctatttgtgtagggtaaggtgtaattctggtttccttcccccacaccctttaaaaagcatactttaagcctctctcaacgcatcagaggatgattactgtgagaaggaatgttctcttttggtaatatggagggggacgcacgaaccgaacaaccagatgatccagtaaataggtaggtcaaatggaggtgactggactgggctcttcagttactcattcctggattttgttgacttcacacaccagagagaccagagaggttcact

SEQ ID NO: 75333 - DNA, 1044 bp, Homo sapiens
ggttctgtgtatgacaatgtgagccaccacatcaaaccacctgtggggccacccatttcactttaggctccaagtcactctatttataaatttcgcttatttaactagtcctgttgtttactaatagttaacacttatctagtgcttaccatatgccttataataccctataaagtatgtactgttataatttccattttatagatacggaagctgagatagagaggtgaagagactttgtcaaaggtcatacagttagtattaataaatagctggctaagagtcagacccaggcagtttggcttcagagtccagatttgagttggatatttttggtacttgcaacttagtgcgtcccaaacagtgtgtctccttatgtgtttgctttcacataagttggcttaacctgacacacatggagacttttgcagaaattattttgtggacagtgttggaggatcgtattctcacattatgtccactaaatttggagacaagaagaaatgtacacatttcctctataactaatatgcagaaaatattcaagaagctctgaccaacgctgactcccattgtgggggaaaagtgtgtcgtaaaggaacataatttttaacttaattgctagggattcattcacatttctggtaagtctaaatagtgtatttaacaagtcctactggatacctatacagagccagtactaccctgggcattagtgacataaggatgctgacagcctacccttgaggagactccagtcctccatggggagcaggagaaaaactgctgagttgcctaggaacgtggaggcatgcttcacagaccagcatcttgagtttccagggagaatgaagatattttgtgatttcattatgttcttttggagtgggtgggtgggtgggataatatgcaagggataatattgtaggcagagggaacagcatggtcaaaagcatagaagtatgaaagcaagacttgttcagggatccgtgaggaaaagaactgcagtaattcagaacatgaattggaaaatactcacactga

SEQ ID NO: 75334 - DNA, 1046 bp, Homo sapiens
ttttgccatttcatgttcaaaaccctttatctcccatgtgggactgaaaactcctccaagacaggatctctgtttctgtgaggcctgtagtacttagtacatccttgaatgtgtgaggctctcattggttataagtttaattcctgactgtggatgaaagctttaaaactttgtgggcaaaatacagaatgaatttcagtgagttcccatgtattaaataaggtggtgctggctggagatatgctgtccctgtgcccacaatagtagtggtgctgtgcttatcttcctgacgcgctcttcgcagtcttcaccgcctttcttcaggagtctcccctttggctttttcacagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgtgagtagatccagttttagaaatgtctaaatattgtgttttcaccagtggccacattcaacttatgacttgattaagggtgaaatctttacagaattagggcagtaatcatgtggcagaattgggttgtcaaatagtccatacatacattaacttagctttgtggcttgtgtgcagctgccttcaacattctctcacctgggttagaattagaggactatggttactatattgaaaaacaaacatttgctatttttaaacttttgatcgaaatataacttttattgaagtatatgaatttatgtcttaaatgcttagagttgtcacccacacacatgaaatggtaatcatcgctattaggttggtgcaaaagtaattgtggctttcgccattgaaagtagtatcaaagactacaattacttttgcaccaacctagatagttttttttgtt

SEQ ID NO: 75335 - DNA, 1024 bp, Homo sapiens
acttaaaacacacagacctgaattcaaatctcatatctgaatgactttgggaaagttaattatacctcttccagcctcaacatcttcacctttaaaatgagaataatacttacgctgcagggtgattgtgagaatttaggattaacactcagcataatttctgatgcatatataatagctgctattatcattttaatccctaggcagagataaattatactttttcaactcttctcttttacagtgttagtatgataatctctctaacatggttaggactatgatcatggactgtgaggtcatatatcacgattaaggtgggttttggagtcacaggtacctgggttgaaatccctactccacaactttgcaatctagggcaaattttctagttgttttgttttgttgctttggtttcctcatttgtgaagtagggataatcttaccctctgcacagggacattgcaaggatttaaagatgtcacatgcatgaagtattcagtgaagtgcctgcatatgtgaattgctcagtaagtgaacccttgagtgtcagtttactttttagttccttgaactgtttgttcatttcattagtgtactctgttaataaaccaagatgaagagtctgaatcccatgtaggcctgcaagatttcttatttcagggcaggtctaaggtaggacacaagcatgtagactcactatgcccaaactcctctccagtaagcggttggaccaaagaagggactaggttacgtaggatggaggcttccccactaccagaaaaacaattcatggctgccaagaggccctccctttttacaaagtgttatctttgtgttcagaaaatagcagtcaatgtgtatagagtttgagtgtaataaattaactgtagcaaaaacgattttattaactaattttttcataatttctctctctataacaatgaaagtttgttccctgacaggtgtggttgatagaatgttgcctttttgcatatggaataaatttagtgttttggtcatt

SEQ ID NO: 75336 - DNA, 1037 bp, Homo sapiens
aaataaacccatatgtgtttattgttatctgctaatgacatcagctatgaatctcaggtaaacattcaacctgaaataatgtagaggcaaatgagctcattaaaatatgtacacacacatttttactttgatcacaaaagcatcctatttgccagtaaatattttttggagcttttaccatgttttccccagtcagcatttcttaacgtatttaatgatgactgtatttatttctgatctcaagagattgtaatgagtgctctgttagtatttccttttgtggggagtataataattgtcgtgacatgtgcctgtaaaaacataacagtaatgtaacattcacttcaaaaaaatccccaaaaaaagatttaaggaaagcattcattgcatttcttcttggagaagtttaaaaaacggaaaagaaacctttgttaagcaaatttttttccagaagagtatatatgcaaatacttataaagggccttagagtatttgtagtgtgttcagttaaaaaataataaaaagaacagcaaaacactgaagcaggattgctcctcagatttttccttatttatgtcacgtgtgtagcatcattgtagcaacattagtacagacaacacatgtctagtttctattctaatacttgttcagtgaaatatttaccattttagagtggaatgattcagacctttttcttctctgaatgaatcaaatgctgtaagccttaggaaacgttatttttattgtctggatagtctgatttggggttctgaccccctgcaacctcagtgaggcagctatcagatattagctacaaccgcttccttttcagtgaggtgggagggaggagcagaaacagaagggttcctgtcaccagatggagagaaggatttgggttctgtttacatgtcattggattattccatcaaaatgtgagttctgttttcttttatttttctagtgacagagcagcaagatactattattactggcacctgagaaaacaagttcttcattctcagtgtgtgctccgagag

SEQ ID NO: 75337 - DNA, 1047 bp, Homo sapiens
tcagtccactcatggtgctgcctgttaggttgctttatatcaatacagtaaagaagtaaaaaattaaatatgcactacttttgctttatattgacaccagttgctttatattaacatatccagcagactcttttcactaaattttgctgctgtacctgacacttaactactcacatcttgggagatctcatccaaattaatgcttttaacgatcacctatgtgaaggcaagtcccaaatctggttttttcccctatatccataaggtagctgtttacccataggccgttcaaactcaagatgtcctaaatcaaattcattttcttgccacctcatttctacgtattcctacctctgagtacgtgggagtcatacggaactctgccttatcaccattccttctccctgtcctgtcccatcaactgtaacaccttgtaatgtctgtgcttgaataccaatcacccagcttaagaaataaaattatcttctatttttattgccattagccttcctaaatgtccattgcctcctctccctgtcttagctcctgctgtttctaggttcgtgttctcagcagcactgttgcagaaacttgtccctgcttcggtctttactccacagcttgcagatgagatgattttgcttctgacttaaactttcagggcctcctctgtcacctgtggagtgaagctcaggctcccatgcataacctagaaactctccagattatagtccctgccagccattccagcttcctttctggttgtcctgcaccttgaactttaggctctggcaacatccagccattggtgtgtctccatacttactgtggtgtttcatgcttcaggtctttcttcttgcagttcctttagccagtgaagcccctctctgtttcacctggctaactcctactcatcctccgagactcagcccaggtgtcgctccttctgggcagaccatctaggtgcccagtgctcaagaagaacctgggaatagtgttttacatcttattttaaaatgatttatttcttgctcccagtaaactgtt

SEQ ID NO: 75338 - DNA, 1043 bp, Homo sapiens
ggaaagaaggcagtgctaagggtctgtaacatccgacttcaactttacattaatctgatagccctttatcttgagttgtggcaccctggatttcctccatttaacacaccccaaccctaatcctcaaaactgctacattacgtatttgggtttgtttttttttttaatgctttggggttttgtttatgctttcaaagatttgttttgcaaaaattagttttataaattcatgttgtagtaatatctaacagtaatttgattagattggatttggtgtatttgtgtgaatatcagggtgaagattcatattttaggttcatgtctgagacaagttttgacacctcagacctcatctttcctttagaaaccaggcaaatacccatcctttcttaaacaaacaaaagaccttgtagaggtttgtgcttctgatagatttctctcaaaaattctctgtcaatccaaatgagacccggtttggcaattcttttgtaatttcgtagcgattagaacatgaatcattcctcactgtctgccacaaactgcctgtgtcttcagagagaattggtataactgtcaggtgtattggcttcagctgctgctagactgccacttcttccccacgatgactcatcagtgtaacaaatatatctctcctatgctgacatgaatatgaaaaggaattcagatggggacaggaggaggatgaagaagcaggagaacctgtgagaataggtgacataattacgtgcagagcccataatttgccaagtcagcttcattcctaaacgtctaacatggcaccttgagaagttgatttgttctatcagctttctgcctgcagcattttagtacattttttttgttcagatgaccttaagagatcccttcagagccttaaagaattaatgaccttcctctataggttctaaggtaaaaattgcaaagaattttgagttttcagagagacagggcgttgttcattgccaaccatagtaccaagtgtattcggaggcttaagtgagtaggtgtctttgtttgttttg

SEQ ID NO: 75339 - DNA, 1028 bp, Homo sapiens
gaacccactactgcaataatggcactaacccattcatgaaagcagagctctcatgatctaatcatctctttaaactcccatgtcttactactatgatatttgatatcatatgatttatgatagcaattagatttcaacctgagtttaggagggaacagacattcaaaccatagcagtagaggaatgaagaaatgacacatgcttagtttcttctacttaggggttttccaggtctgaaaaaggcctgaaattaagtttctctgggtcaactttggcctgaatccaagatctcacccccatttaagggctttatcattttaacatgaaaagcccttttttgggcattagtttagcaaaaaacagcataaaaagagtctgtgtttttcttaattttatgtagagtcaccttgtctaaaacactattttagcattttagtagaaaatgatcacaaggatttttccatagggtttagaagagaaacaaaaacatgccttgcgtcatttaaaaaaatgttaaagcctaactttattcaacagctggagcttattcctaggataagtattcacatttactgcattattttccaaagtagcgtatgaaaaacctcattgtctctgggcttttacaacagagggagtaaaaagagcacaggcatgttgatgatctgcactgttgacaccagtgattattagggggatgagaggttgcattttacatttcttagaaaacatttcagaattatttaatgtttctctcagtttgtaactgaacggtgtgaagcttcctaaatgtctggaaagggtctggtacagcactagggagggaagagaagccagccatgtggaacacccaggccatgctaacatgttgacaggaataggtagaaaacaggctggcaagtacttgtcttctcgtgagcatactagtgaatatagaggaactatagtgatctctgaacctatcaggaagttgagagtaaaaaggctatatgtaaagatacagaaaagcttttaaattattaggtcca

SEQ ID NO: 75340 - DNA, 1070 bp, Homo sapiens
catccctctagttgtgatcctttgcggccacaagactggatggttgtagactcagtcttagctgtttctatgaagtagattggaaattagtcctgctgcccttgtgtctgtatttctgcttcccagattaaataaaacagtggttaggacagcacagtggagtgcagtaatagtgacagaaacatcttgaacttctggacccctccccacaaagtaaagattggagtccatgccattgagttacttagtaatgtttttctgaagcgcctcccatgtaaccagaactatagggaggataaaagaaatatagcacctggttgataggaacttactgcatgttaaggagataagatgaatcctatggcttatcttagccaaacttaacatttgtgtccctcttttatattatttttctgtctcaaataagtgctgtagcattcaggcttgacggaaaagatagactttgttaaagaaaagtgcagaccatctttttggtttctgtagaatttgtgtggctctcaagtcactcagtgcccttcagaataggcagctatggacatggggggctttgtgaactgtcatctgcctgtgtcagtgagccttgctttggtatcaggcaaagggcccatcagtttcggtttgtcctttgtcattgcagcaaggtggtatagtttttcttcttaaaaaatacagaataatgggcaaattatagtattaaaacacatataggtaatgcagcaatccgataagaaagaacaagtaggccaggcatggtggctcacacttgtaatcctggcactttgggaggccaaggcaggcggatcacgaggtcaagagatcaaggccattctggccaacatgatgaaacctcatctctgctaaaaatacaaaaattggatgggcgtagtggcgcgcgtcttcagtcccagctactcgggaggctgaggcaggagaatcgcttgaacccaggaggcggaggttgcagtgagcggagatcacaccactccagcctggtgacagagtgagacttcgtctcaaaaagaaagaaattgagaaagaaagagagggag

SEQ ID NO: 75341 - DNA, 1726 bp, Homo sapiens
acagaccttggcctaaaaggtctgaattgccatatcctactgaaaaaaaaaaaggaagccatgtctttacctatatgaccttatttcaagataattacttgatttctgaaatgctagggatagttggattcctgttgtatttgcacctctgtgctttggattatttgtaaaatgaggagaatgatagtgcctgcttcctaggactgttaggaagattaaatgagttaatgcatgccgagtatttaggtcagggcctggcacatagtaattgctcggtaaatgttagctgctattattactgatggaggtggtgttgatgatatatttccccatacagcccagaaaccacagattggaaaccactttctaacatgtaaggattacttaaccttttgtggttctgtagcatctctctttacaaggcaaatattctaacctttcactttaaagttgtttcatccttcccttatcttgcagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaacgttggtgcttggtgatgctttatttgtttaattatcaagaacaaattatggcaatgctagtttctgcttaaccaaaatactctgtgtatatattatacatatataaatacatgggattgtgtatgtctatatgtgtttaaagcttactatgtcttcattttggctt

SEQ ID NO: 75342 - DNA, 1136 bp, Homo sapiens
gaaatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaattgcctttttgattattagagctctcaagcgagaagcattaaggagtgacagtgttttcttcatgttct

SEQ ID NO: 75343 - DNA, 1027 bp, Homo sapiens
gtgtgccaggaagggggccgactgagcagtgtgtggaagctgtcgtggaggtgaccgtggggggatgagaaaaggggaaggaaggaacagacagcaccagagggacttgaacaaagggagaagggggattaaagtcaaatcactgtcagcagcccaggagcagacaaaaccaccagagtaagccctgaaatggaaatgagagggaaaagaagcaagccgctaacagctaccaagaagaggaggaagtgggagatgcgctgcttcctgtagaaagaacgttgattgaagacaaagctgggtggggactagtccctgggctgcagccgctgctacacatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaaggtaaatgaaacgttttccatgttgctcgtttttaattgagaaaaacgaccgtcgcttgtggttttaaggtccgatttctaagggatgatagagacatcgcttcaggactaggggaaatgattagattcttttggaagggtctttgagaataaccacatttatgacacatttgatttaaaaaaacctcatcatcagtgcttagatttgatgactaaacaggccaacatgctaaatacaagaagctgtttgtatagttctctcggaggaaaaccagggctgagtcgaaatccatctggggctgtgaagctgtggtctggtcatcggagcccggcagtccccttgttttaggggagtgagtggtgtaaaatattaattgcattctctttcttacacattgcactgggatatcttctgttttgcaaaaataatggctgtgatttggcttttgggggagttaaattcttttgtacttagattttgccaacaaaggcttgaattgcgtatgtgaggggcagtatttaccattaaaaaacagtgtctt

SEQ ID NO: 75344 - DNA, 1610 bp, Homo sapiens
acagattcttgaaacataggttcttagataccaaatatgctagttgagagtgtatgtatgtatatgcctcctcctttatcatcgttctcacttgttaagagctatagggctatttttaatgctatctttatgaaatcgatatggcttctcaaaatctgtggagtagcagcacattttgagagatgggaagcttttatagctactaaagaaaaaaaaagtctatttctcagaggttttttgctcattaaagtaaacctgcaccatgcctaagagacaaagtactgctagtattgaaaccatggaactccttgaaggattcactgaatttaatcaaacttgtgggcaaaacaagtcgtgacatggattttgcagttccacttcctatttgcatcttaaagggaagtatgtaaagatcatcttcttagagaagagacctaggatagatcttcgatccagaatgacccagtggagttctagaatcaagctgtgcatcatgaaatgaagtaaaaagttggcaacctgagctgcatggataaggacaggcttaccctttggtacttactcctctgcaggctgtattcactagataatgccaacaccctactttgtttggggaggcacagacaatctgcattagtcttctgtgtgtgtttcacacatgagtaagaaaatgaaaccttgcccgacgggcatagtagagtcaagagggccttgctatctttctgaaaacaactaagaggtgcctattttctgcacagcacaaaacatttcttaatcgttaaattccagcttgaagcagaacattagtgagtaacagcagatcagtaactatgatggtagaatgtttaggaaaaagatgaatatgcttctacattgtaaaatgaaactatttccacttattctggccatatggaatattgaaagacttaatgatttttcctggggtattcactggcttttgaggagtagaccaacacagaaattttaattgtgctttttttttttttttctgccatatggccaatggctgaatggaaacatgactccattatttcattgccagccttgggcctcatatggtggacatgtagtgaatgtgtttgtttgactgactttgtttagcctgcttcagaaagcaggcccaacttttaagtctaaaagctgtatagtcaaagtagaaagcctgttcataaaagacttctgtgggtaggagaaaacactgtggagtgaaaagaacgcaggctttggagccaggcagatctgcctttgaaacctattactggttcttactacttaccttggtacattaacttaggaacctcagtttcctcattgtaaagaagggctagtaatacataatcaaagttgttgttttgctttgtttttgcttttgtgtgcggataagtgagtgatttctacatagaaggtactgaaatgttatttttttcttccttggtggcataaggaaaagttagcatattcttggtctttaccactgcctcacaggtttagggagactttttttatagtgataaaatatacataacataacatttcccattttaactatttttttaagtatgcagttctgtggtagcgagtacattgat

SEQ ID NO: 75345 - DNA, 1039 bp, Homo sapiens
cgcgctgagccatgcccatggcctttgcctcccatgagaaaatagtcttccctaagccctattgtgatgttccagttataaacaatggtgcttagtacatagaaggtctaaaatgatatttattgaatagatgagtggaagcagtgcactgttctccaaatgtctggactctttcatgtttgcattttaaaaatagatgctgttgttttgtagatttgtttaaaaacatcttggtattaagactgacatctattcttttataacactttacatgtggtcatgtacccacagatttaggctgttttattttatagttttcactacagtttatttcacctgattatttcatttgggtctctaaaatcacattatgaaataccttaattatttaaattaggaacagattaattatctccagtgtacaaactcaaattaatttcattataaacctgaagtttaaattgattaatcttggagtgtttaaggaataaaatgggtttttcttcatccttaaggagaaaggcatatttgatttgatgagtctctcttcatcacaccagttatgatactaggcacaagatatttgcaagaaaacttcagatggattttataaaccagccagaaacctgtgtgtctggggcttctgggggaacaatctgtgagtcattttaaaaaacaaacacactcataatcacggtgcatgttgttaccatggtaattaggcctgttgagttggcttgcttatgttcctgcaaaagcaagagggggagagaaactgagaattcagagctttgactattagcttcaatttgcctactgcaggagagagtgaaggggtttctcaagaatgcactggcacagtcattctgagagggaagtgaagaaaccctggcatcctgcctttgttattgaatataggttagccatattagtgttggatattgtggttcacaagggagaaaaggatcatttggcattctcttgggaaaaaggggaaaaatagtttctttctctgatatatgacttcatgtaagtctct

SEQ ID NO: 75346 - DNA, 2640 bp, Homo sapiens
ctgtccttggttcacaaaaggctgtggcatcttccagtcattgtgacatccagagcactctagggagacgttgtgaacattgtgaactaccgtgtctttgcacacaaatttaaagaggttatttggcatattccactcatctaaaagcatttttccttcatacaaaatcagtggtttcagttatgctcagtagttccttatgtaagtagtctctgtgctaacaaacgcaagaagctaaacaaagtagacaagtaaaaggaagtattgttctgtactgtcagggggattttgagtatatttggtctagggctaaatttagttttcaaagtatatacatggaaaaaaattaaacatgaggtaatggtcaaatattgaggttagaagcaaaataccagcaaggcattattgaacagcaactgtgattaaaggtgtattagttttctatggctgctgtaacaaattattacaaacctagtggcttagaacaacacaaatgtattatcttaccattctataggttaggttctatagggatttcactgggctaaaagcaaaatatcaacaagactgtgttcctttctgaaggctctctgggttggatttatttccttgccttttacagcttctagagcttcctccatcttcaaagccagtagcattgcctctccatgcgtctttctaccatagtcccatcttcttaatttttagccaggaaaggttctctgattttttaagtatctgtgtgataagattgaacatacctggataagccaggctaatctcctcatcaccagggcctccatttaatcacatctttgaagtctctttatctgtaaggttatgtatttacaggttcctgggattaggactgaacatatttggggcctattattctgcctactacaaagtcaaagagactaatccttcagaaaggtagaaatgcttcaggtagcagaccatctaatgtctaattatataggattaaaacattaaggtttccaactttgatgaagccaattctcatcttgactctacagttctcattttgtaggtccaggtactgaagacttttggttttcttgaagtgtctggcattggatcaaggggactggttgaagtccaatggctcctttcttgcccagacttttgggtactataggtatggcccctagagagtatgctgcttttgtcatttctccaactctggagggtttgcctacagtgtacagattacaaggtcttgaacagaaccaaagaaatgtgaggtttttattttatgctgttatgtctggctgttattttatgtattatttattaggctttaaaatgtggaaattggaggaaaaaataacataataatacagaacctcactagagtggtatttattatagccaatttctaggtatggtataatttcctccatacattaagttatccccacaaagtaagaaaccatttcttgccgggtgtatgaaatagatcactgggttattttttaaaaatcatcttttgagtagaatatggctggaaatttatggtgaagatttaaaaattttcagcttttttttgttgtagcaagtcctcttaaaatccacttttagacacttcagcaatacagacctgaagtccaaacctagagctagcagcagggcaacaaactgcccttatttgccaagacagggctttcctgggacataagactatcggtgctaaaactgggagaatccggggcaaatcaggacagttggtcactccagatgtctaacaaaatgactcttaatagaaagtagctgtcacattgatgcattgttaaaatataaattttgagtgaaccaaataatgaccatatcccataatatttgggttgaaaatgggggttaatccaactcttggaaaatctgtagccatatatgcatgtttgttcagaccagcttaaaaagacaaaaaaaaagaaaaaaaaaaaaaaaaaaaaaccctgagattcagaactgagaagcagcagccacgtttatagtcacaagccctagctgccctttcagttctcctgtgttaccagcaggctcctgcactttgcctctgatgatggaagctttaataactttgttactgaggtgaccacaggacctcgctgaatctttttcagcagtcagcctgcatggaagttataaaatccaagtttgccaatgcagcacagagctctcttagctttaatcttgcctttcatagagcaaaatcgaacttttcccccctaagagacagcacagactgttcaagaagaggtaaatattaggaagactatctggaatgcccagtgggaggggattggagtggatcatgtcttggagtctcatttggttctaagaacatggcgcttcctgactcccagcggtggagcatgagccacttacccccatgtaaagttgctacatctgggtaaagacgcttgctgggcctttccccactacttctgcagtactctgccagcatcatccgtagcaaaaccacactgagaaatcagggaagctgaaggtcctggggcctcatcccttacatttctgtggcttttattttgagaattttattctctaaatcattaggactaagcaaagagagctgtaattgtacttgaaagaacaata

SEQ ID NO: 75347 - DNA, 1163 bp, Homo sapiens
gaagtcttgcatgaaggaatggcagtatttccaaaaagcgtagataacttacaaaaacttgtttaaaccagctttcacatttttattaattttacttagtcaaggttatagcccatgttcaaatggacccagatacaatggtagtatttggacagagttcagttgtttgtgtggtgaaagatgatctggaggagctacacagagagagaaaaccaccctatgctttccttattcagagacaggatgtcaacctcaacttacggttcaagtttgctacaaaaactagctggacccctcagagcagctttagatagccaccttcttgggcctcccgacatcaaaggaaatgactattatcccaaagaaatgtaatacctggctagtgggttgagtggccaatttttggtgtttttgcagcttactttgaatctcaagtgaattattttcatttctttgacccagggaccaggattacttgccttgatctaatctagattaaccactctgatccactgaaaatgaataaatccactgaatcagataaattggttggggaggtatttgtggcagcacaaaatgatggacaaaacaaatgtggaatgctatcctaaagcatcaacctcttctgtggatgggaaaattccctgacttgggaagttctgggacgggttgggtctataataggagcagtgagaggcagtgtggtgtagagaaaagagctggggctgtggggttaaaatgaactgaagttagcgtaatactgactgtgaccaccttggcaaattactgaactttctcaaccttaagtctcctagtatgaaaaatgagaataactttacttgctataaaattaattgaaattatatatgcaaaatgaaggcagtgttttccacacagtagtcatgcaaatacctttttaggatgtatacacgtgttgaaaacaaccatatggaagtataattgagattttaaaaagctgcacatatttgatgtatgtaatttgatgagtatgcctatgctcctttaaaaaattatttcttagcagctttatttaggtatagttgatatacaataaataacacatattcaaagtgtatgatttgatgaattttgactgcatacacccatgaaaccatcatcaccaacaagataatgaacgtatt

SEQ ID NO: 75348 - DNA, 1072 bp, Homo sapiens
atggctgggtgtgtgataaatataaaaataaatagcttctcttttcttaatgctaaaacttgttctcagactaacatactgaggagttcctaattcagatctccagggacagatgtcataagcttgacttaagaaatgttaaagcagagctttgcgccacttgacttaattccaactttgctacaatggatcatattattgtggattattattatggaggaaaacagtactttgagctctgtgtggttaggcaggatgtttcttcttttagttctagatcagtcatgatgttaagagtaaaatcctaacagaggaaactaattatttacatttcagtttttttttaagtataattttatctgttggacagaggctcatttgaagataaaacctcaagatataagcttattggtacataaaagtacatagaggagtctcacttattggaagaattttatcgttagtttaacaaaacctacagtacttctgtacttatttctaaaaactagaatttaaagtaaaaatactgttgcttctgggaaattaatggcctaagtagcagtatagatagccttcttcatagtaaacccattcaaatgccaatgacattttctcaaacaaaaatcttcaataacatagcctcagtatccaaaaaacaaagaagaacttttaaaataattcagctaatttttaaaagttgtaattccaaataacaaaactataaaagaataggaaaaaaaaaacaatgaactttaaaattgcctgacataactaaagccaggaaataaaaagccatttagtgaaaattacagtattacatacaattaagaatatttccagaactagtaaagagaagagtttacatggagaactactaaatagttaattagggaagcatatttattaactacagaatcaaataaaaaattggatagcttaaataaacatgtataaataatgccaggccaaaatgatccacttctagaatggaacacagtgttttaacttaaaaataataggtgaaagtacttgagctaatagaataaataaatgttaacgaatcaacaattta

SEQ ID NO: 75349 - DNA, 1049 bp, Homo sapiens
caaacaaacagccacaaaggaccagggaaggctctttgtctgaattaaaaataactaaaaatggtacaatgtgcactgaacgcaaatgtgcaactcattgcagagccctcgaactctgtaacgttccaacctctgagatgaggaatgtctctgccatccatagggaagagcttcccggccaactgctcctggaaccaaggcactgtcccctttctttgacagctagctacagcacttgggtattgtcaattctcccttcagtgctcctactgcaataccatgaggatttggtggaaatcaaatgctgaggtaatccagaccactcattaataaagaccataagattctggtgtatttcccttcagcagcagtgaggaaagatggaaaaagtggaaagaaagagcagctgtgagaagatctctgtatctgatagtgccttgttgagctttctgggacccccatctctactctggaattgacctgatcttcaaggacctatgtcctggtgtatgattctctcccttttaacaccaccctgtctctacagcatatttcttgtcctgacccctttctgacaaacagtttgctctaaggcttgtttggagaacttgatcctttcccctctccctgcctgtttcagcccccgcccctacctccatcagctcttgactggctttgcctccaccaggttccagccactctctaactgatgccacagtctctgagccagccctactcccttgagggttaggccatccctagctgggatggaactgaagtaataatagttccgacattaaacagaattaggacttgtgttcaaaattgaggatagagaaaggaaaataaactttttaaagtatggtaaaatacctgtagcataaaacttaccatcataaccatttttaagactacagttcagtggcattaaatgcattcacattgttgttcaaccatgatcatcatccatctacagagctcttcgtctggcaacactgaaaatccaacacagtgaaacccccatctctatcaaaaaatttttaaaaatt

SEQ ID NO: 75350 - DNA, 1728 bp, Homo sapiens
ctatctaagtaagtgttaaatctgccagaattatgtttctgaattatcattttatataaagcatttgttttgggatatccagagttggcatgcaccattagagctatattgggtgttaacatactgaaatgttttcataccagttggtaaagagaaagtatttctttttttttttcttttcttgtttttggagacaaaaaaagttgcccaggctggagtgcagtgtgatcatggtttaccagagcctcaacctcccaggctcaagcaatcctcccagctcggcctcccaaagtagctgggaccacaggtgtgcaccaccatgcccagctaatttttttttttctattttttgtagtgaagcagtctcactttgttgcccagactgatctcaaaactcctgggctcaagcagtcggcctgcctaggcctcccaaagtgctgagattacagatgtgagccaccacgcccagctgagaaagtatctctttattgagattataaggcatcttatcatgccacccatcagtgaccatggcggggtagtggacatgggaggacggccagcatagatattgacagccccagtagccactgagtggtccgggaggtgagagtggaggtgtgcatagtgccctccctctgctctacgttgtcagggatgacaaagcaggcagtggagcaggtggcattggtggcagtgttttggaagtgggggttggggagaatgggggtgcaggggcagagtcagttggagcataggccctctgggaggcattagcatccaggtatataataacccagtagtgcagagcctgcagtatgcccaggagcagactgtcagtataacagtgaagttattgatgtggttattacatggtttgaacaggagcatcacttagctaggtgatagctacatcaactaagatcacaataacaatctgtaaaaaaaaaaaaaaaaaaaaaaaaaaaaagaccaatgatttggaaatttccagaatattttggaaattattttctccataatgtagcatgtatattttaggatatagttaattcagcaaacaaaagaaattttaaatagattttgattaaatatttttgattttatcacatattgatattttatctttctaattattaaatatttttattttgagtatgactgttatttctggctatataaaaattatagttatttaaccaaaccatcaaaactaagaaaagagtaaattgggaagatattgaaaatataataggtacatatttgttttctatattacataaagtgcttattcaagctaaaaagatggcacaagcctcctataagcagatagttgaattttaacaggcagtttgtataaaagtaaagacaggtggaggagaggttcccccaaaggcagggacagtgtctgacacaggcctggtttcctggtctgcctagtaggagcttgataaatgttaattaattgaatgaataactgagtcaatgtatgaacaactcttcaacctcaccagtaattaagtaaatgcaaacgaaaacaaaaatgagatatagtcatatctattaatttattaaaattaaagaaataggctaggcatggtggctcatgcctataatcctagcactttgggaggcgaaggtgggagattgcttgaatccaagagttcaagaccagcctggacaacatagagagacactgtctgtacaaaaaatttaaaaaattagccg

SEQ ID NO: 75351 - DNA, 1018 bp, Homo sapiens
gcctgggcttcacagactgatgtaactgctctgtatatatacccctttcactctagtgttgagaaagagggaaactagatgcaatgattaaaaatattttaataccaaacttcaagctttttgactcactcatgctccaaaaacaagcgcaacatcaagactaaaggtgtttgtgtccacacccattgtgagattcaagttgagttttcggtgtcatatttgtgtcttagcaagttgtcgatcagcttcatttctttaaaaaattattcttcggaaagcactttgtgcccattgatatatgagacatcttcaaacagtcgctacgtctgcctgattgcccagtcagctggggacacacaggacattacggtttggatatgtaggttctgacagatcttgacagataaatgtaaatggaaatatatctacacttaaaaatattttttcttttgccattgtattgaatattttttagtgtcagtttcttgttatgtgagtgtgaggaattgtgggagatggaggagtttatattctctgcaacttctgacttggttggctcgctgcatccatgctcctgaatcaccccatcactcagggattggaaatagtttgtcccaaataactatttacctttcactgtggctccaatcttgagaaaagtctattcttgcttcctagacacttaagattcaataatatttgaaagaattatttgtggaagtatatttgttttacgtttttattgtgagatagctgtggttttcaatctttaagggggtttatattttctgtttaccatataaacgaaaactacagtagataagtatcttgaaaataaaaatgatcatctgtgttaaaattgcaataaaattttcatcctaaatacctcactacatggtttggctgagcttttctgaccatacctttagattaacagtgaaaaaataaaaataaatttaggcaccttagatccaccttagttacctttactctttcagtctgaatgacaagacaagtt

SEQ ID NO: 75352 - DNA, 1123 bp, Homo sapiens
ctccttggaccgagctagcaatgaattgatggtgctatgggagaaattggttccttccagacatgctggccatgctcctctgacctgtcattgatttgtgaagtgctgattcattcagacattttttagttatataaaaatacatgtacaaaccattttaaacagaaaataaatcatcctacaactatttgaacagatatttatggctggattcaaaagcattgaaattaagggtcttaagtagaagtataacaacggtaatagcagaagaatttctgcagtgagaattcatttccctctctgcatttggtgttcagcaaaactaaacctgtattgaaaaggagtccattcctctttcatcagagattgcctttagcaaggaaacaatggacagcttttcccagtgttctctccttttctcattgtcagggtgttcttctgtgacatttaatttgaaccactgcctgtctcaataatgtaacaatttgattgggtcagatagaaaaggtagaagtcttttttaaaccaaaggattttcatttgaaggtttgataaccaaatttgatttctggatcctatgatcccggtgatgtcccttggattcagtccccctctcctcatcattagtggtatcctcctgaggagagaacagaataccctacactaactttagttgctggtctttaccgatttaggttggtataaagacagaaccaatgtgagactaggcttagagtataaagttaatatgtgcaggttgggaaataggcactaaaaattatagagttgactggatcctgtattagttatctatagctacttaacacattaacccaaacttaatgtcttaaaacaacaaacatctatcttctaatagttttgtggatctggaatccaggatggttctggctcaggcgccctcacaaagatgcagttaaggtattagccagggcagctgtcatctgaggcttaagtgggcctggaggatctggttctaagctcattcatatggctgtaggcaggaggcctcagtttctcttggtcggggcctctccatagactgctcatgacctggcttttcccagagcaagcgatccaagaaagagggcccaagacggaagcc

SEQ ID NO: 75353 - DNA, 1052 bp, Homo sapiens
ataaaggaataagcacagagctcttagtactgctgtaaaactagaagttactgtgggagtggaggtgacatcctttaagttacatttacaagttctattattaggattaaagtactctatattctcccttaaaactgaccaccaacaatgaaaatgttgcatgtatataatttatgcatatgttgcatatataatgtatgcataaaagttacatatatccaaatacctttttcatacatatgtttcatttcatatatatgaaaaacaatgggaagaatatcactaaaattttatctgtaggtaagaatttccatgtgtgcttaaaactgggagtcactgtatccaatataaagttcaaggtgttttgtttgcttgcttgcctttttatctacttttgcagaagatattgaaattgcaatcatcttgtttttgggggaatggagtcattccatattggctcttgagtatgtctgccaccactctgattctagctggaggctgccagaaatgactgtgccattgaatggagttattaggcaacataaaacggacaagccagaccaaggtagaatggaaaaggactgccgtctcaggccatttcattatgtctgaaagaaaaactgatgaagaaacacaggccacagtaaccatagctcctgctctaatcctttctccctgaatcttcttgaaggatccttgtgctaaggttcccaaggtgcgggagggattagaatgaatgctgttttggcacgaggtttggtaaatcatcttgggtgttaagtcccgtgtagaattacctaatagtaatgaggtgtcggcagttttgtatctatttaaagctttaactagaccacatgagtaatgtgctttcaggtgcttatctctaattaattaattcatttgtaagtgaaatacctaattaaagcagtctaagggagctcctttgcggcctggatctggtagatccggtaacaaagagaggtctttgctgatgcaacttgttgaactgatcctcatgggctattagcttcatcagatttcatttgaagagt

SEQ ID NO: 75354 - DNA, 1808 bp, Homo sapiens
gtgggatgaaggtagcattatctgggtgatcaggtgtttcctaggtccctggctatgagacttaaggaagcaaaatctatttcagacctcacccattgatggagatctgattttatctacactgccaggcatgttcagggctggcttgggcactggtgggcagagcctggtgaaagcatgactgtggctagaggggaggatgtaggagttaggaaaaacgcgatttaatggactttccctaaacttttggtagcccttaggcatgtaagtacatcctaagctactctttcaaaatgatatctcatttctgaaatttcttccatcatagtgaaaagtccccaaatgttctggagtcaaaatatccaccagtcagcacacttcccagtgaatcccagccgctgccacgaagagggatagggaagaaacaatttttccatagctgtacttactgagccccaagtgtaaagcacaagaaaatcgcatcccatttgtcagacagcaacgacatggctggttgccttcatactgcaatcgcctctgtaatcttcctgtgagacgtagcatcctccagggagtgagttggaaccttagcctagtgcagagtttattaaaaccatgtctttttttaaatcacttaacttccagcaaatagcataaatcttgcacacactgaattacctctgattaaaggtatttaggattaatcaagggagatgtgttgttccctgaaagtaaaaatcagacttttttttaatcattcctttgagatattaggtcatgattattttaatcacaaaggaaaatctgaactttggatcattttcttattaagcatcagaaacactgtattaaaaactgataaatggctgagtgtggtggctcacgcctgtaatcccagaaccttggaaggccaaggtgggcggatcacctgaggggtttgagaccagcctggccaacacgttgaaatcctgtctctactaaaaacacaaaaattagccgggcatggtggcgggcgcctgtagtcccagctactcgggaggctgaggcaggagaattgcttgaacttggaaagtggaggttgcactgcgccgagatcgtgtcactgcactctagtctgggcaagagagagagactccatctcaaaaaacaaaccaaaaaaaaaaaaaaaaactgataaagaagcctcactacatccctcaaaagtgaagacaaaagctacaggataataaaccagaagcaacaggggcaaaacagtgggctgaaagccatcccaaaagcatttttattagacagtgtcaaagacacctgcggaggtggtgacctgacctaacaagctttgaccatgttaccacgctgtcttcatgcccgtggtaaagagctgcactgtctccactctgcaaagagctgcttctggccaattttgcttcctggttgtcctcatgtagacatgagtcccagctgagagcatttttccaaaaaataaagtcaacttttacctccttcatttgaaaaaaaaaaagcagattttgcagttgtgtcttgataaaatacggcaaagggttgaatccacattttcaaattatcccaacttacacaaagatattttctaaaaataaaagaacagttgtacatctatggtgtgacctccatgagagaatacttgccttgtgtttgcaggccttctttccaataattaatgctgtgaaaataagtaaaaaaataaactaacttatataacacaaaaataagacaatttatacttggagatcagctacagaatagaaactaaagcagatttattacttagg

SEQ ID NO: 75355 - DNA, 1034 bp, Homo sapiens
gggagctgggctgcttaggagaacctgagttctttgggtggggtgaagggtgtggtgtttacacatttcattaggattagagtgattttggttctgctgcaaacattgccaagaactcatcatattcctctggataagtcacttaatttcattgaatctcattctttctcctataaaattagagaattaagatgaggtcatctctgaggtcctttcatattcagtgtcctaaaaggctgtattgtatagtgaaaaaaggtacagacttgggaaccagattgtgagggttgaaatcccagctctgtcacctaccagctatgtgactaagtacatttcttaacttctctgtgcctcccgttccaaaactgtaagatgggagataagatagtatgcaccgcatagtgttgtgagaattcagtgaattaatctagtaaagtacttagggcctgcattatggtatgtaagaagtgttaactgctattactattccctgaaagaaggtcacctcttctaaagcctggactccagaagaggcagaatactcgagaccctggagtgaacatataaacaaaatagtgtttgggaaccaataattgacatttccacaattcttaccaaacctgctttgtgttaggcatgttttaaagcacaactttttattgttggaagaaggcccaaaccatagaatgctttatttcatgcccacagggactctcttcttccttgggacacaggcaggtaattaagcccctgaggatggggtgcacacaggatattgaactagtgcttacttcataatgctttcacacctgcggccaggacaacaaagcaggagaaatcaatgccattacttcagaggctgagaggtggatgctcttatgccaatgggtttttgctctacttaagcaacatgagacctcataaattaaacttgaaaaggatttttcaaattatgaaaaaattcattaaaaatgtataagcattaacttcagctgacttagtgtatcacagagattctgttttaattaaaccca

SEQ ID NO: 75356 - DNA, 1071 bp, Homo sapiens
gagcctgtctaaggcttttttctgttgtggactggcgaattgctgccatgataagctgatgtgttgccctttctgttggaaccttcaggatggtgcccagagtgagagggagcatttcaaagaggattcccttttggtcttaggtcttaagttagaattacatagggataagcaaattcaaatcagaaagtttgagatttggatttgaactgtagaggttaagagagggttggtgtagagattcacattttttgaaactgtgaaattggatggttagtgttcacttttccccatacatacacaaatatatatatatatacatgtttacattttatattctgtattggcaaatatatgtatgtgtgtgtgtatgtgtatatatatgtgtatatatatacacatatacacatatatatacaaacacacaatacacacacacacacacacagacatatgttcttcatttgatttaatgaataaatatttgtttggctgaccttaaatggatttcatgctatcttagcactttcttaaatggagaaattgcaaccatgtgccaagattaatatggtaaaagtttcactttattttatttaaaactatgtatatagacatggaatagaatgtaaaatgtatatgaatttaagatacaaatggaatacaacccttgcttgtgacaggaaaggatcccagattccctggggtaggggtggactcagctttagcttcaacagactctgggacacctctgcctagggctgatcatgcgggtcagcaggaacgggcaacaaaactcagaaagattctctgctcagagatgttggaatttgtacttcctaccccagtcttcattctgtagttataaaattatgatccttttcaggtctctctttaaatgtgcatatttattgataggcttaagctattggtcattcataccttataaattaagccactaacatcatattgagattggcttcacagaccacagaagcagctttgggttcctaactgaggtcccttaacagttttgtagactagagcaagccagctaattcacttgagcccggt

SEQ ID NO: 75357 - DNA, 1050 bp, Homo sapiens
agtgaacaaagcccacctagcgtctaagaatgccagctcccatttatagatacaagctgtttccttatccaagtctcagataaaaactaaaagcttacatgtcattttaaagttgcaacatggcctattcgtttcattttacaaaatttgtgaaatccatgactttgaagtcatttttcgaggactctgttttttgtcagggttgttagaaacagctaaccaatgaccctctttcccagaggaaggctgcatcttgtaaagttaatgttttcaaaaccagcagtttactggaaagcagagagctgtcatttcaaatgatggcttctggcacctgcgtgagacagggaagccatgttgcgtcttactctccacccacacagcatagacggctcccatgctgatttgagggaagaaatacgttgttttgtctctctcccacttggtaagtggcaacttcccagtgaaaccgcatggaaatagtccagagtggattttaggttgctctgtcaatatgttgctcccttgggttattttcttccttcttgacccccacagcaagtttggttgttggggtttccacactggtcctcatttgcatttgctctccctgtgccatacaggtcataaaattgctgttatgtatgtgaaaacggccaaatataccatagaccccagattaggatcagtctggtgcctctgaaaatgtgaattgagaagaactgaaagaaaatctttccctggggagactgcagccgaaacacccttctgacgaatgtgctgacctaatctaagcctcaatttccttcaacaagggatgcatcgctcacttcccttgagttgtgagaatgaaacaagataatgcgttaaagcccttggcccagttcctggcatgtggcgagctcttggtccataagcaaatcttcgtattagtgtgagttcctggtcctccatgaaagaacaaagcttttggcctgtaaaatctaatttctggaaatgagaagcactaaaaagaagaggagtggggacggagtggggaggcacttggaaggc

SEQ ID NO: 75358 - DNA, 1055 bp, Homo sapiens
tctagacagaaaaattgttttattgccaatgtaatcctaacttgtaaatacacaaaacaaaatctctcagcacctactgcaaataccaaaacacagtcctgagaaacatacagttgtaattgaaattacaggccttagggaagtctgtctggatgccacccttgaaaaacaccattgaagtatgaaaaggatggaatcctccacaattaacctacacactctccacccattaacaaaccatttatttatctttgtgccacagaaataaggggttgtgtgtttattactaagcctaaatgacaagaaaatgtatggtttcttaacagaaaagttccttctgaaagaaattaaagtgctgaatgtgtttttagaaaatgaaatctcctctaatggttattgttccataacaggcctatttttcatgtttcttgttggttgggtgggacggggactataatcctctcatcagttgaaaagaataaaatttcttctgtattattcttcagtctggaattcaggtgggataattagggcattctttcagaattctatcaatctcttatacacaattcctataattgttccagggatttttgctatttgtatcttttttgcttactggcaaatataacccggaataatctcattctgtcagtagactgcataaaagagactctgctctgttttagataagccgggaccagatatcgataaagcatattgctgagaattatgaatgcttaacacttattcatcatcagtgagaaaataatagggattataagacataagaatataaaaacccagttagttgaaagtttgcacatggagtgctttctttgagcagatttttcatgatggctttgtggctatttttttaggtatcctttcatttttctcactgggggtactatgggcctttgagcagcacaattcattgttgactggcctactacaaggcgttagagtctccacttctgcacactaactgccagtagcacccccagttattgtcatagccctaaccaaccccacacatttccaaaagcctcata

SEQ ID NO: 75359 - DNA, 1586 bp, Homo sapiens
ttactttaaaactcatgtgaaggtagaagacaaaagcattcttctccagtaagaatcagtgaatgtagtatgtttattcactaacaatgaataatctgaaaaggaaattaagaaaaaattccattaacagtagcatcaaaaagaataaaatagttaagaactaaccaggaaggtaaaagacttattcaacaaaaatttttaaaaaattactgaaagaacacataaataaatggaaaaagacatctcatgttcatggattagaagacaatagtgttaaaatgtcaatgctagccaaagcaatggacaaattcactgcaatccatttcaaaatcccaataatatttttgtaagaatagaaaaatctgtcttaaaattcatatagattctcaaagaaccccaaatagccaaagcattcttgaaacagaacaagttggaagactcaacactttctgatttcacaatttactacaaagccatggtagtcaaaactgtagcactggcataaagacagacaatccatatatagagaccaatggaatagcataaagagcacagaaataaacccttacatatatggtcaaatgatttttgagaagggtgccaagacaatttgtctgactcaatttgggctgctatcaaaaaaaaaatgcaattgacaaggtggcttaaagaataagcatttctctctcacagttctaaaggctaaatgtgcaagatcaagatgtcagcatgataaggtcctggtgagggttctcttcctaatttggaaacggctgtttttttgctgtttactcacatggctgagaggaagaaatcatttctctttttataagagtactaatataatttatgcagactccaccttcatgacctaattacttcccaagggctccacctccaaataccattatattgagggttaagctttcacatgtgaatgtgggaaaggacacaaacatccaggccataattcagtggataaaggccaaccttttcaacaaatcatgatggaaaaactggatatccacaggcaaaagaatgaagttggccgtaacactgtgaacaaaaatgaacttaaaatggatcaaacgcctaaacataagagctaaaaactataaaactcttaaaagaaaacatagggcaaaagcttcatgacattgaatttgtatataacaccagagacatgggtaacaaaagcaaaaatagacaaattggactccataaaatgtaaaacttttgtgcttcaaaggacagttcaacggagtgaaaagacagtccacagaataagagtaaatatttgtaaaccacttatatgatacagaattaatatcctaaatatgagacacttaaaactcaacaacaataacaacaaaaaccaatgcaaaaatgggcaacagagttgaataggtatctccgcaaagaaatatgaatggccaataaacacatgaaaagatgctcaattcattaatcattagggaaatgcaaataaaaaccaaagtgagatactatctcacacccattaggatggctactatgaaaacaaaacaaaacaaacaaacaaaaaaaacggaaaataacaagtgtta

SEQ ID NO: 75360 - DNA, 1096 bp, Homo sapiens
agaaactaattatattgacatgagggtcattagaatatttttgtaaaacattttaaataatattatttaaaatatcaatttttaaaaatatatgtgatgtagttatacataggtactcctttgttaactgattatgtaagatctaataggtctacaatcataaggtggatgaacagaaatgcagtgttgaggtgtctgcaatgaatataatgtgattgaaagtatctggtatctatcagtggccaagtcacatgtactgctagggctactgcagtgtgttgtctatatttataatgagaggaaatgttaaatttccatttgaggttagtgaaaaataaagatgtaaattttttgtattatttgaagttcacataccaccccccgaattcgatctgtggaaccctggggtaatccaaattaattgcctttatttacaaagttattttagtaatcacaaagagagaagactgcagtatgaactggggtagctgcaatagatataacaggaagggagccaaatttgagatatctttggaggaagaatcaacaggacagaaaagggagagattttctggagttattggggaaatcttcatggaagaagtaggcatacgaatgtagaagaagctgtgtgcaaaatgttagcagggattgtcagaaagcagaaagatctgctaggcacacgattgctgtgactcattataaggcacaggacaaggaagacagccacaggttagaaaggaggaatgttcatgaagattaagtcagggacattgagactcacaactcagtagctcaggagctgtgggacctggggcaaacacttaatgaagcctccacttcacatatttaagatgagaatgataatagcttgtgacccataatgttgttgtaaggattaaataagataccgtatgtaaagtggttagcacagttctgacacatagcaagggctgataaatattagcaattattctaattactgctgggattctgacactgttggagcattgcccacaggagattgcagtcttgttgaggaaacaagataaaacacataatatattttaagaaggaaaccattcagaatcaaatg

SEQ ID NO: 75361 - DNA, 1050 bp, Homo sapiens
ttagccaggcaccatggcacacacctgtagtcccagctactagggtggctgaggcaagataattgcttgaacccaggaggcagaggttgcagtgagccaagatcaagccactgcactccagcctgggcaacagagcgagactgcatctcaaaaaaaaaaaaaaaaaaaaaaaaaaaacaaatgaaggagacagccacctgcggggctatggaagtgcagggttgacacctgcatgcccctgccagcgagtgcctccttcggttctgcaccctaagtgcctcactcaccttaacctagtcccagacttgctggcaacaatcctgtaaggtcagtgtcgtcaactttcttctttgcagatgaggaagcagaagcttttagaggctgagtatcttgcttcatggagcaaggatttgatgccaggacattgggctctaaagccttgggccttgactgactgtaccagactccagtgttggttgtttttgtctccctttccaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgt

SEQ ID NO: 75362 - DNA, 1077 bp, Homo sapiens
catctcccaattaattttattgtctctttcctctctattcgctttctcctgttttttttttaaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaaga

SEQ ID NO: 75363 - DNA, 1096 bp, Homo sapiens
aaaccagggtgatgttacaattggtcaaagcaaaaatttaaaaagagacatttaaagatcaggaatactgaaatgaatttccaaatggatgcaaaactggcttctttactgaagggcagacaagtcagttgagcttccactagacaggattcagttgcatgtctaaaacaagaattctgttccattgctatcagttatctacaatttacagttacaaaatagctcaaagacaaggaaaggcactgagttcccacagaatcagaatgagataactcagagccaagtgaaatggcacgtctgcagttccagctactcagccaaatagttcttctatttgcaagattgtcatagatactgtatggcctacaaaagtgaaaatatctattatctggccttctacagaaaaagtttgccaattctggcttagagtgaccttctgtttcagaataatttctcagaaacaccagagtaagtagctcagaacgacttcaagatggcatgtcctaaaggccacagggctcagaattactgggggaaattctgttatttcaggagacttggtaaaaaggccaaaccccactagaggcttgaaatcctagcctgaataccactttgggaaggttctccgctaggtttcccgcaattggcaccgctatcactccatggctgttctggttcatgttctgtggaaatccacttgcctttaccattctttacaataattacagctaagtggtgcctcctgtgtggaatttgccatccctgaccggaacaatcttgcacatcgttcttctttctcaagagcgccctctgctggtcagttctcagaaggcgccacatcatcgcgtctttcgtctgcagatgctctttgcagccagaagccgaaggtcattttgatctagagaagaaagcattttggctattgtctccatggctgttcgaattttcattcgagtacataggcattactgcgtcaagatgtagaacttcttcactgtagaagacgctgagagaacaaaactccctttgaacgcaaacctttgaatgcaaagtaataatcccttaggtaagcaggaaaggcctaggtaagcaatgc

SEQ ID NO: 75364 - DNA, 1834 bp, Homo sapiens
gtatattttactttattactttgctataaatttaaccttgccctccttcccctttctgtccgcaaaggaactggaatattaatatgtaacacttaaatagcaaaactatgtgccaggcactgtttttatccgtatttattttatttaagaaacttcttaaataaaacaacttcttttaatcttcataactctatgaggtaagttctattagcaccctcattttgtagctgaagagtctgaggcacagaaaatgtgggtgattatcccaagttcacacaaccagtaagtatctggacccaggatttgaacagatcattgttaatctgtactttcaactccagaatctgtactttcaactccctcttttggttcaattaatttagtattttgaagttaagaaaattccacaagaacatatatctgaacatatacctgagaaggaggtattttatgtagtgcttctagttatttatgtgatattttttattgcagatgaaacagaatttagaaacttcatcgtttggcttgaagaccagaaaatcaggcactacaagattgaagacagagggaatttaagaaacatccacagcagcgactggcccaagttctttgaaaaggtaatgaattaggaagtaaagtaaaaatacagagagtttgtctgaaaaatcatgaagatgagcttaaaattactttcttcttttaagaaaaaaatgataatgatcagtgttaggaaagctggatttcagggattttgcttttttcttagatgtgtcttttgcttttagagcaaattattttatgtcttcctaccaagctttcagtattaggtagaaatagttttctctagaaacatgaagtttcttaaataaataatgatgtaaatatttcgctttccctttatggcccaaatcagaatttttgttaaacacagtactatttcttatattaaaagaagacattggctaggtgtgatggctaacacctataatgccagcactttgggaggctgaggtggcagatcatttgagctcaggagttctgacagcagcctgggcaacatgatgaaaccctgtctctacaagaaaatagaaagttatctgggtgtgctggcctgtgtctgtagtgtcagctaattgggaggctgaggttctccagcctgggcgacagagtgacaccttgtctcaaaaaaagacattattgagatgcttgaaaaccaagactgtcgtgtttatgcttatatttaatgtaaacagatatcccttgttgtatgctagggaaatagtccttaaatgatctctggtatatcatatttttgtgccttgaatcattttcccattgatttagttttagtaacacttttgcataaaaaagaattctcagattagaataaaaatgcttttagtgtcatttcttacattaaacattttcatcagttatatttgatgagtgagatatttttcttgaaaaaggctaagtttttcatttgcgagagcagtgtgattaggcactttctccctagaatcagtgattttataaattagggattgtataaattacatcattgttattaacctttccgtgtctcaattttttcatcaataagtgagggtaacaatgatacctatctcataagtgtggctttgtttttaatgagtaattgttcacagaagtccctggcgcatagcaagtgtgataagcttattactgccaatgcctctatactactactattaatactactgtattcttttcctttgctcttagaaaatatttttaaaattttcagtggacttcttaaaactttgaaatatatttttaggattttatgtttgtt

SEQ ID NO: 75365 - DNA, 1046 bp, Homo sapiens
tctatagcaaaaattaagcttgattgaatgaattgttttatgcttatacaggttaagcatccctaatccgagaatctgaaatcctaaatgctccaaaatccaaaactttttgagcactgacatgaggacacaagtagaaatttccacacataagcacttaacacaaactttatttcatgcacaaaattattaaaaatattatatgaaattaccttcaggctatgtgtataagttgtacattgaacataaaaatgaattttgtgtttagacttcagtcccatccccaaaatatcccattttatatatgcagataatccgaagtctgaaaaaatttaaaattggaaattattggcatttccagtaagggaaactcaacctgtaatcattttggctcagttaaatttggtaaatagcagtagtcattttaccttgagttgcagttgtacaaattatatttttgcctgtttttatagctgaaaaatacaaggatttagtacctgataattcaaaaactgctgacaatgcaactaaaaatgcagaaccattgatcaatttggatggtgagtatataaatgcataacattgaacatcaacatttttggttttttaaatgtttttttctttgaagaatgaagtccaggtttacttggttttagtaaatttagaaggatccatgcagacagcatttatgttaacattttattctctataatgtttttatgatgtgctttctccttccccttgcatttgaatatctgaatgttgatttgatttgcttctagtaatttggagttttgatttgtatttaatcatgggggtcattgtttgcctttttgaatgtgtaaatttcttttaatccaatgactctatcagacaagtggtaaaattttccattattttaagtcctggatatcttttagtaatttccctttttaaaaatatgaagaatctaattacctaaattatgatgtgtaaaatatttgttcactggctaattcattgtgacctataatttaggagttaacccttttgaatgagtgagcctc

SEQ ID NO: 75366 - DNA, 1083 bp, Homo sapiens
actgagctcaggcagtctgacttgagagcctgtgctcttacggtaggtggggagaagggtccatgcgtggatgtctgcatgagcttgtcagtctgcccaggtgaagggacagggggttctgttggagtgtaaggttcaaggtacaggtgactgaaatggtatctttcagtcctaccttgtaggctgagaaaagctatatcccatgactaccttccccttaaagagaaaatatggaacatttttagattatatcagaaatccaaagatgcctaaagtttcactggctgtgcagcggtggagagactgtcctcaggtcagcagcagcagtgtctgataacacctgcctcctgcagcaatgatgttgtagtgaatgccttgggcacaactatgttgtttgtcctccctgcgcccttcccccatctcccaatgccttttgtcctccagcccctttaggcaggccaagcagtgttaaaaggttactaatgccagggcagtatctctgaaagacactgttttcttttaaaggttcttactggctcgttgtatatgaatcgagccactggaagttgggttaaagatcagcttatttcaccctccctatagaacagacagtaaattgttctggtgtaataaagtcaatcattcattcattcattccttcagcaaaactatgctttggaaggcagtgtaagtaaaggcttagccaaatctctttgctcttgtttgtaaagtaaaatttagttttatttttaatgctcccaattttaattttggtgtcatctcaaaagataccagcctataacaatttagtggagttcttacagtctagtgtacttataagcatttataactactatttgaggcatatggtagttttcaggggtagcttggtggcctgttggcaaaggaaaaaaaagtggagcctctggtactagatgaacatataaagccactcagtacaattctgctctttaattttgctcacttgtgctttcgtacccattggtttcttcagacttacatgtgttagctgttttaaagcagacagagcctacgtagatttacattactagataaggcaag
